US008065093B2

(12) United States Patent
Miller et al.

(10) Patent No.: US 8,065,093 B2
(45) Date of Patent: Nov. 22, 2011

(54) METHODS, SYSTEMS, AND COMPOSITIONS FOR CLASSIFICATION, PROGNOSIS, AND DIAGNOSIS OF CANCERS

(75) Inventors: Lance D. Miller, Singapore (SG); Joshy George, Singapore (SG); Vinsensius B. Vega, Singapore (SG)

(73) Assignee: Agency For Science, Technology, And Research, Singapore (SG)

( * ) Notice: Subject to any disclaimer, the term of this patent is extended or adjusted under 35 U.S.C. 154(b) by 821 days.

(21) Appl. No.: 10/960,414

(22) Filed: Oct. 6, 2004

(65) Prior Publication Data

US 2006/0074565 A1 Apr. 6, 2006

(51) Int. Cl.
*G06F 19/00* (2011.01)
*G06G 7/48* (2006.01)
*C12Q 1/68* (2006.01)
*C12P 21/06* (2006.01)

(52) U.S. Cl. ............... 702/20; 435/6; 435/69.1; 703/11

(58) Field of Classification Search ...................... None
See application file for complete search history.

(56) References Cited

U.S. PATENT DOCUMENTS

| | | | |
|---|---|---|---|
| 6,208,983 | B1 | 3/2001 | Parra et al. |
| 6,306,087 | B1 | 10/2001 | Barnhill et al. |
| 6,468,476 | B1 | 10/2002 | Friend et al. |
| 6,714,925 | B1 | 3/2004 | Barnhill et al. |
| 6,757,412 | B1 | 6/2004 | Parsons et al. |
| 2004/0058340 | A1 | 3/2004 | Dai et al. |

FOREIGN PATENT DOCUMENTS

WO WO 2004/065583 8/2004

OTHER PUBLICATIONS

GenBank Accession for AW299538 [online], [retrieved Mar. 15, 2008] Retrieved from the internt <http://www.ncbi.nlm.nih.gov/sites/entrez?term=AW299538&cmd=Search&db=nucest&QueryKey=1>.*
GenBank Accession for R73030 [online], [retrieved Mar. 15, 2008 from the internet <http://www.ncbi.nlm.nih.gov/sites/entrez?term=R73030&cmd=Search&db=nucest&QueryKey=5>.*
GenBank Accession for BG271923 [online], [retrieved from the internet <http://www.ncbi.nlm.nih.gov/sites/entrez?term=Bg271923&cmd=Search&db=nucest&QueryKey=8>.*
Nielsen et al., *Science*, 254: 1497-1500 (1991).
Neilsen, *Curr. Opin. Biotechnol.*, 10:71-75 (1999).
Bergh et al., *Nat Med*, 1:1029-1034 (1995).
Elston, C. et al., *Histopathology*, 19:403-410 (1991).
Cattoretti, G. et al., *Int J. Cancer*, 41:178-183 (1988).
Isola, J. et al., *J. Natl Cancer Inst*, 84:1109-1114 (1992).
Andersen, T.I. et al., *Br J Cancer*, 68:540-548 (1993).
Bhargava, V. et al., *Mod Pathol*, 7:361-368 (1994).
Dudoit, S. et al., *Journal of the American Statistical Association*, 97:77-87 (2002).
el-Deiry, W.S. et al., *Nat Genet*, 1:45-49 (1992).

Miller et al., "An expression signature for p53 status in human breast cancer patients predicts mutation status, transcriptional effects, and patient survival," *Proc. Natl. Acad. Sci. USA*, 102(38): 13550-13555 (2005).
Shepard et al., "A zebrafish bmyb mutations causes genome instability and increased cancer susceptibility," *Proc. Natl. Acad. Sci. USA*, 102(37): 13194-13199 (2005).
Okada et al., "Gene expression profile linked to p53 status in hepatitis C virus-related hepatocellular carcinoma," *FEBS Letters*, 555: 583-590 (2003).
Nicoll et al., "Expression of the hypermethylated in cancer gene (HIC-1) is associated with good outcome in human breast cancer," *British Journal of Cancer*, 85(12): 1878-1882 (2001).
Qiu et al., "Down-regulation of growth arrest DNA damage-inducible gene 45β expression is associated with human hapatocellular carcinoma," *American Journal of Pathology*, 162(6): 1961-1974 (2003).
Zhang et al., "Tissue microarray analysis of maspin expression and its reverse correlation with mutant p53 in various tumors," *International Journal of Oncology*, 20: 1145-1150 (2002).
Chevillard et al., "Biological and clinical significance of concurrent p53 gene alterations, MDR1 gene expression, and S-phase fraction analyses of breast cancer patients treated with primary chemotherapy or radiotherapy," *Clinical Cancer Research*, 3: 2471-2478 (1997).
Aubele et al., "Genetic alteration in presumptive precursor lesions of breast carcinomas," *Analytical Cellular Pathology*, 24: 69-76 (2002).
Sambrook et al., *Molecular Cloning: A Laboratory Manual*, 3rd edition (2001).
Sambrook et al., *Molecular Cloning: A Laboratory Manual*, 2nd edition (1998).
Anderson, *Nucleic Acid Hybridization*, 1st edition (1999).
Egyhazi, S. et al., *Clin Chem*, 50:975-976 (2004).
Sorlie, T. et al., *Proc Natl Acad Sci USA*, 100: 8418-8423 (2003).
Chen, X. et al., *Mol Biol Cell*, 13:1929-1939 (2002).
Vega, V.B. et at., *Nucleic Acids Res*, 32:257-260 (2004).
Kel, A.E. et al., *Nucleic Acid Res*, 31:3576-3579 (2003).
Berns, E.M. et al., *Cancer Res*, 60:2155-2162 (2000).
van't Veer, L.J. et al., *Nature*, 415:530-536 (2002).
Forozan, F., et al., *Cancer Res*, 60:4519-4525 (2000).
Tanner, M.M. et al., *Clin Cancer Res*, 6:1833-1839 (2000).
Krop, I.E. et al., *Proc Natl Acad Sci USA*, 98:9796-9801 (2001).
Setubal et al., *Intro to Computational Bio Methods*, (1997).
Salzberg et al., *Computational Methods in Molecular Bio*, (1998).
Rashidi et al., *Bioinformatics Basics: Appl in Bio Science and Medicine*, (2000).
Oulette et al., *A Practical Guide for Analysis of Genes and Proteins*, (2001).
Ramaswamy et al., *PNAS*, 98: 15149-15154 (2001).
Lee et al., "Biochemical evaluation of patients with breast cancer," *J. Surg. Oncol.*, 19(4): 197-200 (1982).

(Continued)

*Primary Examiner* — Eric S Dejong

(74) *Attorney, Agent, or Firm* — Barnes & Thornburg LLP

(57) ABSTRACT

The present invention provides methods, systems and compositions for predicting disease susceptibility in a patient. In some embodiments, methods for the classification, prognosis, and diagnosis of cancers are provided. In other embodiments, the present invention provides statistical methods for building a gene-expression-based classifier that may be employed for predicting disease susceptibility in a patient, for classifying carcinomas, and for the prognosis of clinical outcomes.

24 Claims, 467 Drawing Sheets
(9 of 467 Drawing Sheet(s) Filed in Color)

OTHER PUBLICATIONS

DeVita et al., *Cancer: Principles & Practice of Oncology*, 5th Edition, 1997, p. 1569.

Affymetrix GeneChip Human Genome U133 Array Set HG-U133A, GEO, Mar. 11, 2002, XP002361324, abstract.

Raschella et al., "Expression of B-myb in neuroblastoma tumors is a poor prognostic factor independent from MYCN amplification," Cancer Research, 1999; 59(14): 3365-3368.

Amatschek et al., "Tissue-wide expression profiling using cDNA subtraction and microarrays to identify tumor-specific gene," Cancer Research, 2004; 64(3): 844-856.

Sala et al., "B-Myb protein in cellular proliferation, transcription control, and cancer: latest developments," Journal of Cellular Physiology, 1999; 179(3): 245-250.

* cited by examiner

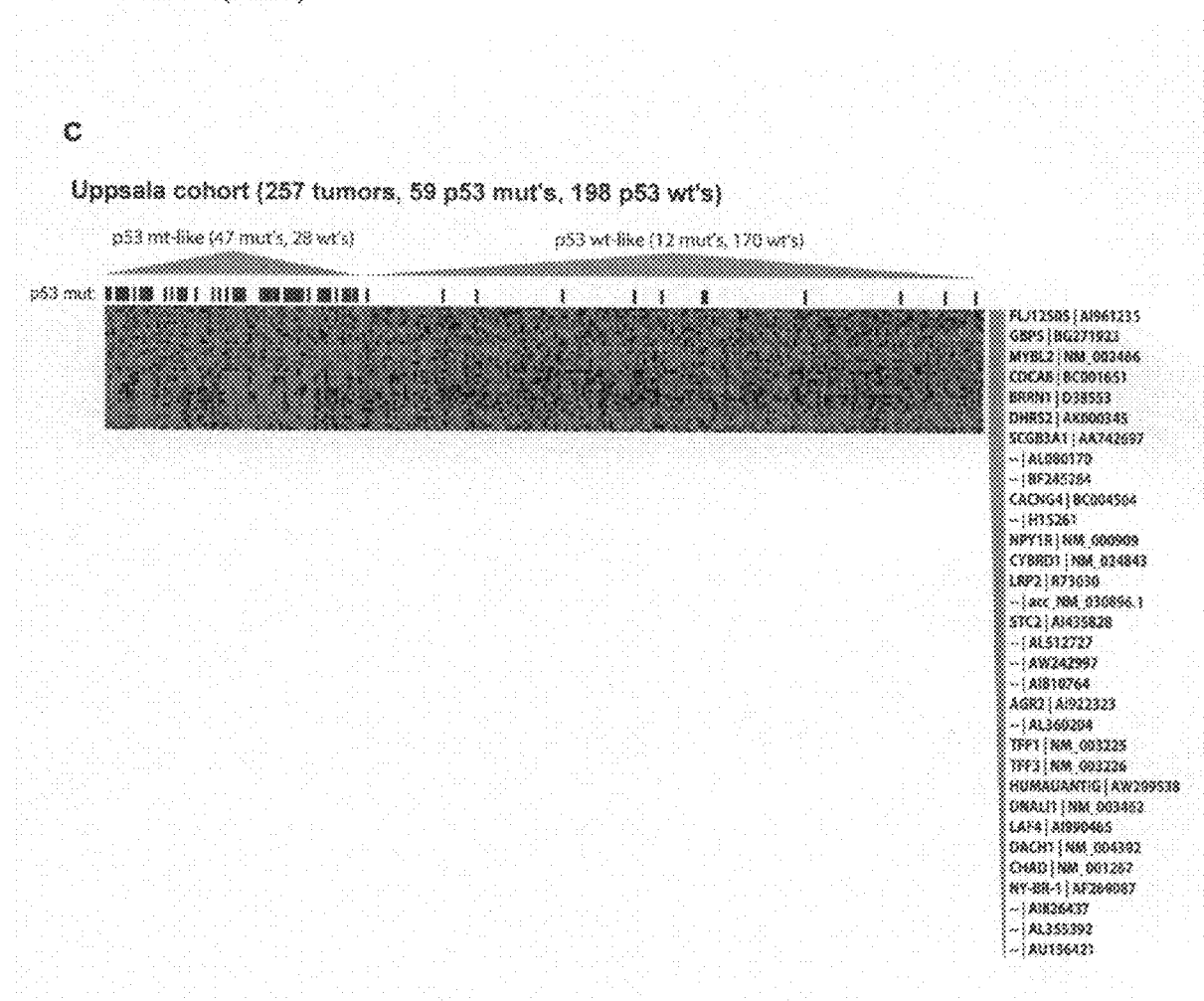
FIGURE 2 (contd)

FIGURE 9
SEQ ID NO: 1
Genbank ID        : NM_024843.1
Unigene ID(#167)  : Hs.31297
Unigene name      :        cytochrome b reductase 1        CYBRD1
>gi|13376256|ref|NM_024843.1|    Homo    sapiens    duodenal    cytochrome    b
(FLJ23462), mR
NA
GTGTCCCCCGCGGTGCGGAGTATGGGGCGCTGATGGCCATGGAGGGCTACTGGCGCTTCCTGGCGCTGCT
GGGGTCGGCACTGCTCGTCGGCTTCCTGTCGGTGATCTTCGCCCTCGTCTGGGTCCTCCACTACCGAGAG
GGGCTTGGCTGGGATGGGAGCGCACTAGAGTTTAACTGGCACCCAGTGCTCATGGTCACCGGCTTCGTCT
TCATCCAGGGCATCGCCATCATCGTCTACAGACTGCCGTGGACCTGGAAATGCAGCAAGCTCCTGATGAA
ATCCATCCATGCAGGGTTAAATGCAGTTGCTGCCATTCTTGCAATTATCTCTGTGGTGGCCGTGTTTGAG
AACCACAATGTTAACAATATAGCCAATATGTACAGTCTGCACAGCTGGGTTGGACTGATAGCTGTCATAT
GCTATTTGTTACAGCTTCTTTCAGGTTTTTCAGTCTTTCTGCTTCCATGGGCTCCGCTTTCTCTCCGAGC
ATTTCTCACGCCCATACATGTTTATTCTGGAATTGTCATCTTTGGAACAGTGATTGCAACAGCACTTATG
GGATTGACAGAGAAACTGATTTTTTCCCTGAGAGATCCTGCATACAGTACATTCCCGCCAGAAGGTGTTT
TCGTAAATACGCTTGGCCTTCTGATCCTGGTGTTCGGGGCCCTCATTTTTGGATAGTCACCAGACCGCA
ATGGAAACGTCCTAAGGAGCCAAATTCTACCATTCTTCATCCAAATGGAGGCACTGAACAGGGAGCAAGA
GGTTCCATGCCAGCCTACTCTGGCAACAACATGGACAAATCAGATTCAGAGTTAAACAGTGAAGTAGCAG
CAAGGAAAAGAAACTTAGCTCTGGATGAGGCTGGGCAGAGATCTACCATGTAAAATGTTGTAGAGATAGA
GCCATATAACGTCACGTTTCAAAACTAGCTCTACAGTTTTGCTTCTCCTATTAGCCATATGATAATTGGG
CTATGTAGTATCAATATTTACTTTAATCACAAAGGATGGTTTCTTGAAATAATTTGTATTGATTGAGGCC
TATGAACTGACCTGAATTGGAAAGGATGTGATTAATATAAATAATAGCAGATATAAAAAAAAAAAAAAAA
AAAAAAAAAAAAAAAAAAAAAAAAAAAAAAAA

FIGURE 10
SEQ ID NO: 2
Genbank ID        : H15261
Unigene ID(#167)  : Hs.21948
Unigene name      :        Transcribed sequences
>gi|880081|gb|H15261.1|H15261    ym30c11.s1    Soares    infant    brain    1NIB    Homo
sapiens
cDNA clone IMAGE:49796 3', mRNA sequence
TTTTTTTTTAAATCTTCATAGAGACGCCTTAGCAGNAAGCTATCGGCTTTGACAGTACACCGAAATCCTG
GCAGTGAACCATAAATTGACCATTACCATAAAAAGAGCTGCTAAACGAGAAACCATGTGCTCAGTATAAA
ACTAATTTCATGCTTTCAAAAGCACACAGTGGCTTCTAGCAAGATAGTGGCCCTGGGACTTGCCGAGACA
GATTGGTGAACACAAATGGTTTGCTCCTGATGCGTCTGCTTAGCCAAGCTTTACGTGTACTGGCAGTAAA
AGAGGTTCTCGAGCCTTCTATCAAACAAATACACACTTAGCTATAACTTTAAAGCTGAAGNTATTAAAAC
AGCTGCCTCAAATAAAATATAGCNGGAAAANCACATACACTTATTATACATACACACCCCATGTG

FIGURE 11
SEQ ID NO: 3
Genbank ID        : AI826437
Unigene ID(#167)  : Hs.283417
Unigene name      :        Transcribed sequences
>gi|5447108|gb|AI826437.1|AI826437    wk34b12.x1    NCI_CGAP_Pr22    Homo    sapiens
cDNA c
lone IMAGE:2417279 3', mRNA sequence
TTCCATGGGGAGAATGAAGCCATTTTATTTAGGGGAATGTTAAAACAAAGCCATATACAATCTGTAACAA
ATACAATACAATTGTTTGTTCCCTAGTCCTGAATAATTACAGTATATACAAAATCTGTAAGGCACTGGTT
CCCCCAAAAGAACAAATGAGTCTTCTTGTGAAACAGACAACGAAACCCCTATATTGCCAACTTTTCTCCA
AAAAATATGGCATTGTTTTTTTGTTTTGTTTACAAGAGGAATCACAATTGCTAAATTAAGTCACTTCTG
ATGCCATTTCTTTCATTTCCACTGCTATGTGTCTGGGTTTTCTAAGGCAATGTAACTACTGAACATGTTC
AAGTTTAAAAAACTATACTTCTCTCAGTGCCGTTCCACCCACAAACAAAGAAGAATCAGATCAGACCAAC
AACATAAAACTTCTAATGAATATGTATGACTGTAGGAACATGAAATTCAGTCATTATTAAGTACTTGCTA
TACTTGACTACACACCAATTGAAATGTGTCAAAGAATTCCCTGTAAATAAATCTCAGCATGTTTTCTAA FIGURE 11 cont'd

GAAGCTTTCT

FIGURE 12
SEQ ID NO: 4
Genbank ID      : AF269087.1
Unigene ID(#167) : Hs.326736
Unigene name    :       breast cancer antigen NY-BR-1 NY-BR-1
>gi|13469728|gb|AF269087.1|AF269087 Homo sapiens breast cancer antigen NY-BR-1
mRNA, complete cds
CTAGTCTATACCAGCAACGACTCCTACATCGTCCACTCTGGGGATCTTAGAAAGATCCATAAAGCTGCCT
CCCGGGGACAAGTCCGGAAGCTGGAGAAGATGACAAAGAGGAAGAAGACCATCAACCTTAATATACAAGA
CGCCCAGAAGAGGACTGCTCTACACTGGGCCTGTGTCAATGGCCATGAGGAAGTAGTAACATTTCTGGTA
GACAGAAAGTGCCAGCTTGACGTCCTTGATGGCGAACACAGGACACCTCTGATGAAGGCTCTACAATGCC
ATCAGGAGGCTTGTGCAAATATTCTGATAGATTCTGGTGCCGATATAAATCTCGTAGATGTGTATGGCAA
CATGGCTCTCCATTATGCTGTTTATAGTGAGATTTTGTCAGTGGTGGCAAAACTGCTGTCCCATGGTGCA
GTCATCGAAGTGCACAACAAGGCTAGCCTCACACCACTTTTACTATCCATAACGAAAGAAGTGAGCAAA
TTGTGGAATTTTTGCTGATAAAAAATGCAAATGCGAATGCAGTTAATAAGTATAAATGCACAGCCCTCAT
GCTTGCTGTATGTCATGGATCATCAGAGATAGTTGGCATGCTTCTTCAGCAAAATGTTGACGTCTTTGCT
GCAGATATATGTGGAGTAACTGCAGAACATTATGCTGTTACTTGTGGATTTCATCACATTCATGAACAAA
TTATGGAATATATACGAAAATTATCTAAAAATCATCAAAATACCAATCCAGAAGGAACATCTGCAGGAAC
ACCTGATGAGGCTGCACCCTTGGCGGAAAGAACACCTGACACAGCTGAAAGCTTGGTGGAAAAAACACCT
GATGAGGCTGCACCCTTGGTGGAAAGAACACCTGACACGGCTGAAAGCTTGGTGGAAAAAACACCTGATG
AGGCTGCATCCTTGGTGGAGGGAACATCTGACAAAATTCAATGTTTGGAGAAAGCGACATCTGGAAAGTT
CGAACAGTCAGCAGAAGAAACACCTAGGGAAATTACGAGTCCTGCAAAAGAAACATCTGAGAAATTTACG
TGGCCAGCAAAAGGAAGACCTAGGAAGATCGCATGGGAGAAAAAAGAAGACACACCTAGGGAAATTATGA
GTCCCGCAAAAGAAACATCTGAGAAATTTACGTGGGCAGCAAAAGGAAGACCTAGGAAGATCGCATGGGA
GAAAAAGAAACACCTGTAAAGACTGGATGCGTGGCAAGAGTAACATCTAATAAAACTAAAGTTTTGGAA
AAAGGAAGATCTAAGATGATTGCATGTCCTACAAAAGAATCATCTACAAAAGCAAGTGCCAATGATCAGA
GGTTCCCATCAGAATCCAAACAAGAGGAAGATGAAGAATATTCTTGTGATTCTCGGAGTCTCTTTGAGAG
TTCTGCAAAGATTCAAGTGTGTATACCTGAGTCTATATATCAAAAAGTAATGGAGATAAATAGAGAAGTA
GAAGAGCCTCCTAAGAAGCCATCTGCCTTCAAGCCTGCCATTGAAATGCAAAACTCTGTTCCAAATAAAG
CCTTTGAATTGAAGAATGAACAAACATTGAGAGCAGATCCGATGTTCCCACCAGAATCCAAACAAAAGGA
CTATGAAGAAATTCTTGGGATTCTGAGAGTCTCTGTGAGACTGTTTCACAGAAGGATGTGTGTTTACCC
AAGGCTACACATCAAAAAGAAATAGATAAAATAAATGGAAAATTAGAAGAGTCTCCTAATAAAGATGGTC
TTCTGAAGGCTACCTGCGGAATGAAAGTTTCTATTCCAACTAAAGCCTTAGAATTGAAGGACATGCAAAC
TTTCAAAGCGGAGCCTCCGGGGAAGCCATCTGCCTTCGAGCCTGCCACTGAAATGCAAAGTCTGTCCCA
AATAAAGCCTTGGAATTGAAAAATGAACAAACATGGAGAGCAGATGAGATACTCCCATCAGAATCCAAAC
AAAAGGACTATGAAGAAATTCTTGGGATACTGAGAGTCTCTGTGAGACTGTTTCACAGAAGGATGTGTG
TTTACCCAAGGCTGCGCATCAAAAAGAAATAGATAAAATAAATGGAAAATTAGAAGGGTCTCCTGTTAAA
GATGGTCTTCTGAAGGCTAACTGCGGAATGAAAGTTTCTATTCCAACTAAAGCCTTAGAATTGATGGACA
TGCAAACTTTCAAAGCAGAGCCTCCCGAGAAGCCATCTGCCTTCGAGCCTGCCATTGAAATGCAAAAGTC
TGTTCCAAATAAAGCCTTGGAATTGAAGAATGAACAAACATTGAGAGCAGATGAGATACTCCCATCAGAA
TCCAAACAAAAGGACTATGAAGAAAGTTCTTGGGATTCTGAGAGTCTCTGTGAGACTGTTTCACAGAAGG
ATGTGTGTTTACCCAAGGCTACACATCAAAAAGAATAGATAAAATAAATGGAAAATTAGAAGAGTCTCC
TGATAATGATGGTTTTCTGAAGGCTCCCTGCAGAATGAAAGTTTCTATTCCAACTAAAGCCTTAGAATTG
ATGGACATGCAAACTTTCAAAGCAGAGCCTCCCGAGAAGCCATCTGCCTTCGAGCCTGCCATTGAAATGC
AAAAGTCTGTTCCAAATAAAGCCTTGGAATTGAAGAATGAACAAACATTGAGAGCAGATCAGATGTTCCC
TTCAGAATCAAAACAAAAGAAGGTTGAAGAAAATTCTTGGGATTCTGAGAGTCTCCGTGAGACTGTTTCA
CAGAAGGATGTGTGTGTACCCAAGGCTACACATCAAAAAGAAATGGATAAAATAAGTGGAAAATTAGAAG
ATTCAACTAGCCTATCAAAAATCTTGGATACAGTTCATTCTTGTGAAAGAGCAAGGGAACTTCAAAAAGA
TCACTGTGAACAACGTACAGGAAAATGGAACAAATGAAAAGAAGTTTTGTGTACTGAAAAAGAAACTG
TCAGAAGCAAAAGAAATAAATCACAGTTAGAGAACCAAAAAGTTAAATGGGAACAAGAGCTCTGCAGTG
TGAGATTGACTTTAAACCAAGAAGAAGAGAAGAGAAGAAATGCCGATATATTAAATGAAAAAATTAGGGA
AGAATTAGGAAGAATCGAAGAGCAGCATAGGAAAGAGTTAGAAGTGAAACAACAACTTGAACAGGCTCTC
AGAATACAAGATATAGAATTGAAGAGTGTAGAAAGTAATTTGAATCAGGTTTCTCACACTCATGAAAATG
AAAAATTATCTCTTACATGAAAATTGCATGTTGAAAAAGGAAATTGCCATGCTAAAACTGGAAATAGCCAC
ACTGAAACACCAATACCAGGAAAAGGAAAATAAATACTTTGAGGACATTAAGATTTTAAAAGAAAAGAAT
GCTGAACTTCAGATGACCCTAAAACTGAAAGAGGAATCATTAACTAAAAGGGCATCTCAATATAGTGGGC
AGCTTAAAGTTCTGATAGCTGAGAACACAATGCTCACTTCTAAATTGAAGGAAAAACAAGACAAAGAAAT FIGURE 12 cont'd ACTAGAGGCAGAAATTGAATCACACCATCCTAGACTGGCTTCTGCTGTACAAGACCATGATCAAATTGTG
ACATCAAGAAAAGTCAAGAACCTGCTTTCCACATTGCAGGAGATGCTTGTTTGCAAAGAAAATGAATG
TTGATGTGAGTAGTACGATATATAACAATGAGGTGCTCCATCAACCACTTTCTGAAGCTCAAAGGAAATC
CAAAAGCCTAAAAATTAATCTCAATTATGCAGGAGATGCTCTAAGAGAAAATACATTGGTTTCAGAACAT
GCACAAAGAGACCAACGTGAAACACAGTGTCAAATGAAGGAAGCTGAACACATGTATCAAAACGAACAAG
ATAATGTGAACAAACACACTGAACAGCAGGAGTCTCTAGATCAGAAATTATTTCAACTACAAAGCAAAAA
TATGTGGCTTCAACAGCAATTAGTTCATGCACATAAGAAAGCTGACAACAAAAGCAAGATAACAATTGAT
ATTCATTTTCTTGAGAGGAAAATGCAACATCATCTCCTAAAAGAGAAAAATGAGGAGATATTTAATTACA
ATAACCATTTAAAAAACCGTATATATCAATATGAAAAAGAGAAAGCAGAAACAGAAAACTCATGAGAGAC
AAGCAGTAAGAAACTTCTTTTGGAGAAACAACAGACCAGATCTTTACTCACAACTCATGCTAGGAGGCCA
GTCCTAGCATCACCTTATGTTGAAAATCTTACCAATAGTCTGTGTCAACAGAATACTTATTTTAGAAGAA
AAATTCATGATTTCTTCCTGAAGCCTACAGACATAAAATAACAGTGTGAAGAATTACTTGTTCACGAATT
GCATAAAGCTGCACAGGATTCCCATCTACCCTGATGATGCAGCAGACATCATTCAATCCAACCAGAATCT
CGCTCTGCACTCCAGCCTAGGTGACAGAGTGAGACTCCACCTCGGAAA

FIGURE 13
SEQ ID NO: 5
Genbank ID         : AW299538
Unigene ID(#167)   : Hs.75528
Unigene name       :        nucleolar GTPase  HUMAUANTIG
>gi|6709215|gb|AW299538.1|AW299538 xs51a10.x1 NCI_CGAP_Kid11 Homo sapiens cDNA
clone IMAGE:2773146 3', mRNA sequence
TTTTTTTTTTTAATGTTTAAAAGGTTTTTATTAAATTATACAAAAACAGGCAGTTAGAAATTGTGTTTTC
TTCCTGCCCCATTGACATTTCTAAGGCCCTAATGCATTTGTTCTGAGGTTTGACAGTTGAAGCCCTTCAC
CAGTGCTAGGGAAATAAAGCCTCCTCAACCTTAAGGATTTCAGTGATAAGAGTCTGAAAGTCTAGCACTT
CAGGTAGACTTTGGATGAACTAAGAGGTTCCACAGTCACCCTGTCATATAACTGTCTGACAGAAATAGGG
GATGAGGTCTATAAAATGGAAGGGTGGTATTTCGTTTTTATTGGTAATGAATGATTTGGAATAGAAGCA
TACAGAACTGCAAATTTCAAGGACGTTAGTGTACATGGCCTGGCCTTTGAAATACAAGGAGAAAGTTGGG
TGCAGAAGAAATAGGAGAAAACTACAATAATTTCTGCCTCATTGAGTCTGTGAAGTAGACCCACTTATGG
CACATACGTTCCTGTCTTAGAGGCCTGGAACTAGCAGATCTCGTGGAAAGAGTTCTTTCCCATGGAAATG
ACAACACAGGCAGGTCATTTGAGTGGAGGCTTAAAAT

FIGURE 14
SEQ ID NO: 6
Genbank ID         : AL512727.1
Unigene ID(#167)   : Hs.232127
Unigene name       :        MRNA;  cDNA DKFZp547P042  (from clone DKFZp547P042)

>gi|12224870|emb|AL512727.1|HSM802858 Homo sapiens mRNA; cDNA DKFZp547P042 (fro
m clone DKFZp547P042)
GGTGACCACACGGCAATCCTTACCCTTTGTCTGTCCCTGTCTCCCTTGTCTCTGTACCTCTCTGCTTACC
CCTAGCTGTTTCTGTGTCCAGCCATCTGTCTCTACCTGGATCCCAATGATCCTGAAACACATCAGTAAAG
CCTTCTTCATCACTGCCACGCACAACAGACTTGTGCCTGGGAGTTCTATCTGTGTGAATGCAACTGCAGA
GGAGGAAAGAGTGAAGCAAAAATTGGGAGAGTTTAGGGGTAAGGGAAGTCTACCTCACAGAACAGAGGTA
CTTCCCTTGGGGTTGGAACCACTCGTGTTTGCAGTTTCAGTTTCTGGGAAAGAAAGGGAATGAACAGATT
TATCACACTGGAATCTTGAAAAGGCAAATCGCCAACACCTGAGACGCGGTCAACTCTGGTATGTGCCAGT
GAGGGGAGAACGGAAGGACCCAGGGCTCGCAGCCTCAGCCGGTCATTATGGCACCTTGCTATGGACCCTT
CCTTCAAGACCCACCATAAAGCCCATCCAGAGCCCTTCCAAGAGGCCCCGGGAGTAGTTTTCTCCAGAGA
GGGCAGTGGTACGGGACCAAGATTCCTCTGACTTATATCAAACCAGAGGCAACTCCCACACAGAGGCTG
TGGAAGGGTAAGCCTGTGTGCCTCAAGAAAATGCTTCAAAGCAAAAGCAAGTAAGAGATTCTAGATGAT
TCTTACCTGCTATGAAAGATGCCTTGATGTCTGAAGAGGCTTCGGCCTGATCTCCCTGAAGATGCTGAAA
TGGGGGAGAAGCCTGATCACCTCTGTGCAAGCAAAGGAGTGAAGATTATTTCTTGAACACCTGGACAACA
TATCTGTTCAACTAGCTTGCACCCTGGTGGAGCTGGGGCAGCATTTCTGGAATCCTCCTAACCATTGTT
CACTGCTTGTAGCAGAGTAGGTGGGCCTCAGGGTTAGTGACAAGTCCTTTCCTGCCCTTCCCAACACCCA
GCCACCTTGCTGCAGTCTCTGTAGCCTGGGCTCTGAAATACATGAGCTCCTCGGGAGCTGCCTATCCATC
CTACAGCTTAGTGGTTAGCTGTTTAATTGTAGGCCAAGAATTTCTCTCCCCACCACAGCCATCTAAATGA

FIGURE 14 cont'd

```
GTTTTACTAGCCAGGAACCTAAAAACACCCTTCGTGGGCTTCCCTATGACCCCAGCTCGATTGACCCTGT
AGGTTCAAAAGGTTTCGAGGTGGCACCTAACCAGAATGTGGGCAGAAGGCAGAGGAGAGGGAGCCTTCTT
TCTGTCTTTATCTCTTTATGCTTATCCTCATTGACCATGGGCTGAGTTCTTTCTCTGGGTCCCCTAATGT
GGGAATGGAGTGGTTCTTGCCCTCTGAGCTTACAGACTAAGAAGGCAGAAAAGCTTTACAACTACAGAGT
ACATGTGTATACACACAACCAACCTAAACACATCAGAGAATACATACTTAAATCAATTCACTTCATATAC
ACATCTCATTAGAAGACCAAGCTAAACTTCACTTAGAGGGCGGGCAAAGGACTAGAAAAGAATTTTTCTC
TTAAAAAAAATGAGTACTAGAGCAAAATTATGAGTGTCTAAGTATCTTAGTTATGCTTCATAAGATCTGA
CTGGGGTAAGAGATAAAGAGGTAAATAGGGCTGGGCGCGGTGGCTCACATCTGTAATCCCAGCACTTTGG
GAAGCCGAGGTGAACAGATCACCTGAAGTCAGGAGTTGAAGACCAACTTGGCCAACATGGTGAAACCCCA
TCTCTACTAAAAATACAAAAATTAGCCAGGCATGGTGGTGGACCCCTGTAATCCCAGCTACTTGGAAGGC
TGAGGGGGAGGATTGCTTAAACCCAGGAGGCAGAGGTTGCAGTGAGCCGTGATTGCACCACTGCACTCCA
GCCCAGGTGACACAGCAAGACTCCGTCTCAAAAAAAAAAAAAAAAAAGAAAAAAAAAAAAAAAAAA
```

FIGURE 15
SEQ ID NO: 7
Genbank ID        : NM_001267.1
Unigene ID(#167)  : Hs.97220
Unigene name      :        chondroadherin    CHAD
>gi|4502798|ref|NM_001267.1| Homo sapiens chondroadherin (CHAD), mRNA
```
TCGATGCTCCACGTAGGAGCTGGCTCGGCTGCCGGCTGCGGTCAGGGCCACCGTATAAAGAGGGCGGCAG
ACCCGAGCGCCTAGGACTCGCCGCTGCCCGCGCCCCGCCGCCGCTGCTGCCCCCAGCCCCGGCCCCAGGC
GTCCCAGCCATGGTCCGCCCAATGCTCTTGCTCAGCCTCGGCCTCCTGGCTGGTCTGCTGCCGGCGCTGG
CCGCCTGCCCCCAGAACTGCCACTGCCACAGCGACCTGCAGCACGTCATCTGCGACAAGGTGGGGCTGCA
GAAGATCCCCAAGGTGTCAGAGAAGACCAAGCTGCTCAACCTACAGCGCAACAACTTCCCGGTGCTGGCT
GCCAATTCGTTCCGGGCCATGCCGAACCTCGTGTCATTGCACCTGCAGCACTGCCAGATCCGCGAGGTGG
CCGCCGGTGCCTTCCGCGGCCTCAAGCAACTTATCTACTTGTACCTGTCCCATAACGACATCCGCGTCGT
GCGTGCCGGTGCCTTCGACGACCTGACCGAGCTGACCTACCTCTACCTGGACCACAACAAGGTCACTGAG
CTGCCCCGGGGTTGCTCTCCCCGCTGGTCAACCTCTTCATCTTGCAGCTCAACAACAACAAGATCCGTG
AGCTGCGCGCAGGGCCCTTCCAGGGAGCCAAGGACCTGCGCTGGCTCTACCTGTCGGAAAACGCGTTGAG
CTCCCTGCAGCCCGGGGCCCTGGACGACGTGGAGAACCTCGCCAAATTCCACGTGGACAGGAACCAGCTG
TCCAGCTACCCCTCAGCTGCCCTGAGCAAGCTACGGGTGGTGGAGGAGCTGAAGCTGTCCCACAACCCCC
TGAAAAGCATCCCGGACAATGCCTTCCAGTCCTTTGGCAGATACCTGGAGACCCTCTGGCTGGACAACAC
CAACCTGGAGAAGTTCTCAGATGGTGCCTTCCTGGGTGTAACCACGCTGAAACACGTCCATTTGGAGAAC
AACCGCTTGAACCAGCTACCCTCGAACTTCCCCTTCGACTAGCCTGGAGACCCTCGCCCTTACCAATAACC
CCTGGAAGTGTACCTGCCAGCTCCGGGGCCTTCGGCGGTGGCTGGAAGCCAAGGCCTCCCGCCCAGATGC
CACCTGTGCCTCACCTGCCAAGTTCAAGGGCCAGCACATCCGTGACACGGACGCCTTCCGCAGCTGCAAG
TTCCCCACCAAGAGGTCCAAGAAAGCTGGCCGCCATTAAACAGGTTCTGACCCAGCCAGTCCTGGTGACT
GGCCTCTGCCTTCCACCGGAGAGACTACTGACCTTCTCACCTCCGACCCATACCTTCTCCCCACAGCCTC
TGCTGATGCACAGAGCTGCCTACACCTAGACACGTCCTGGCAGGGGGCCTCGGGCACTCCACTACCAACC
CAGCTCCACCCAGCAGTGTCCTGGGGAGAAGGAAGGCTGAGCCTCTCCCCAGCCTTCATGCCTTCCCCAC
CCTCCAGCTCCTCTTGGAGAAGCTGTTGCTGAGACCCCCCCCCCCCCCCAAGTCAATCAGAACCACAAC
AGGTTGGTCATCAGGATGGCCACCCTCCCAGGATCATCCTTCCTCTGTTCTCTTTCCCTGCCACGTGGAA
ACAATCATCAGATCCTTGCCCCACCCCTTGCTTCCAGAAAGGGTTTTAAAGCCCATGCCCCAACTCTGCC
AGCCCCCACCTGCCAGGACGTTCTAGCAGGTCATCGGTGCTTTGCTGTCCATCTTCCCATGCTGCAATTT
CTTCCTGAGATTTCTATAAATATAAATGTATGTATGTAT
```

FIGURE 16
SEQ ID NO: 8
Genbank ID        : BC004504.1
Unigene ID(#167)  : Hs.331904
Unigene name      :        calcium channel, voltage-dependent, gamma subunit 4
        CACNG4
>gi|13325399|gb|BC004504.1|BC004504 Homo sapiens, clone IMAGE:3837002, mRNA
```
GGCACGAGGGGAGATCTCAGCACTTTGTCCGGAGCTGAGGAAGTGGTTTCTGTGTTTTACAGTTTTTCCA
GCCATTCTTTTCTTCCCCCTCCTGAAGCAAGCAAAGAGCGTGGAGGCGTGTGCAGGCTTGGAAGAAGAAC
TCTCCAGAACATGGAACTTAACCCTCTTTTGTATAAAACATGTGCTTTCTAAAGAAAAATTGTTTCTTAT
TTTTTGAGACTCCTTGATCCACCCTGGAACAGTCGCCTGTAGTCCTGGTAGCTGTTGTGCTTGGAAATAA
CGAGCGCATCCTTGCCTCAGCTACCTGCTCACAGCCCATGGGTGGACTCGGCCCCCTGGGGTTCAGACCC
```

FIGURE 16 cont'd

```
AGGTCCGTTCGGCCTAGTGATGATGTCATCGTCCATCCCATCTTCCTTTGCCCCCAGGAAAGGACGCATC
CACCGGTAGCGGCCCCAGCTGACTGTCGCCGTGTGCTGGGGATCTGAAATGAGGCCTGCCAGGGCCCCTG
TGTGCTGTGCTCCAGAGCCTTCGCTCCCATCAGGGTTGGCATCATCTGATGGCATGTCCAAGTGTGCCCA
GCAGCGGATGCTGAAGCACCAGAGCTCAAGGCCTTCACCTGCTCTAGGCCAGCCCTGTCACCACCTCCAC
TGCCATGACCAGGCCGAAGGCAGGGAACGCCCTCCCCAGTCCCGCTGTCCAGCAAGGCCCCGAGACTTTT
CTTCTGTGATTTCCAAAAGCAAGGCAGCCGTGCTGTTCTAGTTCCTCTCCATCCGCCACCTCCCCTCCCG
CTGCCCCAGAAGTTTCTATCATTCCATGGAGAAAGCTGTGTTCCAATGAATCCTACCTCTTGCCCAGTCC
CAGGCAGAGTAAGCAGGGCCCACCTAGGGACCAAGAAAGAGTAGGAAGAAGGGGACGAGCCGGGAGCAAA
ACCACCTCAGACACCCGGGCCTTCTCAGCCTTCTCCCCGCCAGCTGGGTCTCCGGGGACCCTGGGCC
CTGGGCCGCCCATTCCTGGCCCTCCCGCTGCATCTCAGACCTGACACCCAACGGGGGGATGTGGTGGCCT
GTGCCCACCTTCTCTCCCTCCTCCCGACCCGCCCCCTCGCCCCCACCCCTGTGTGTTTCGCCAGTTAAGC
ACCTGTGACTCCAGTACCTACTACTGGTTTTGGGTTGGTTGTTCTGTCTTTTTTTAATTAAATAAAAAC
ATTTTTAAAAAAAAAAAAAAAAAAAAAA
```

FIGURE 17
SEQ ID NO: 9
Genbank ID         : NM_000909.1
Unigene ID(#167) : Hs.169266
Unigene name      :         neuropeptide Y receptor Y1    NPY1R
>gi|4505444|ref|NM_000909.1| Homo sapiens neuropeptide Y receptor Y1 (NPY1R), m
RNA
```
CATTCCCACCCTTCCTTCTTTAATAAGCAGGAGCGAAAAAGACAAATTCCAAAGAGGATTGTTCAGTTCA
AGGGAATGAAGAATTCAGAATAATTTTGGTAAATGGATTCCAATCATCGGGAATAAGAATAAGCTGAACAG
TTGACCTGCTTTGAAGAAACATACTGTCCATTTGTCTAAAATAATCTATAACAACCAAACCAATCAAAAT
GAATTCAACATTATTTTCCCAGGTTGAAAATCATTCAGTCCACTCTAATTTCTCAGAGAAGAATGCCCAG
CTTCTGGCTTTTGAAAATGATGATTGTCATCTGCCCTTGGCCATGATATTTACCTTAGCTCTTGCTTATG
GAGCTGTGATCATTCTTGGTGTCTCTGGAAACCTGGCCTTGATCATAATCATCTTGAAACAAAAGGAGAT
GAGAAATGTTACCAACATCCTGATTGTGAACCTTTCCTTCTCAGACTTGCTTGTTGCCATCATGTGTCTC
CCCTTTACATTTGTCTACACATTAATGGACCACTGGGTCTTTGGTGAGGCGATGTGTAAGTTGAATCCTT
TTGTGCAATGTGTTTCAATCACTGTGTCCATTTTCTCTCTGGTTCTCATTGCTGTGGAACGACATCAGCT
GATAATCAACCCTCGAGGGTGGAGACCAAATAATAGACATGCTTATGTAGGTATTGCTGTGATTTGGGTC
CTTGCTGTGGCTTCTTCTTTGCCTTTCCTGATCTACCAAGTAATGACTGATGAGCCGTTCCAAAATGTAA
CACTTGATGCGTACAAAGACAAATACGTGTGCTTTGATCAATTTCCATCGGACTCTCATAGGTTGTCTTA
TACCACTCTCCTCTTTGGTGCTGCAGTATTTTGGTCCACTTTGTTTTATATTTATTTGCTACTTCAAGATA
TATATACGCCTAAAAAGGAGAAACAACATGATGGACAAGATGAGAGACAATAAGTACAGGTCCAGTGAAA
CCAAAAGAATCAATATCATGCTGCTCTCCATTGTGGTAGCATTTGCAGTCTGCTGGCTCCCTCTTACCAT
CTTTAACACTGTGTTTGATTGGAATCATCAGATCATTGCTACCTGCAACCACAATCTGTTATTCCTGCTC
TGCCACCTCACAGCAATGATATCCACTTGTGTCAACCCCATATTTTATGGGTTCCTGAACAAAAACTTCC
AGAGAGACTTGCAGTTCTTCTTCAACTTTTGTGATTTCCGGTCTCGGGATGATGATTATGAAACAATAGC
CATGTCCACGATGCACACAGATGTTTCCAAAACTTCTTTGAAGCAAGCAAGCCCAGTCGCATTTAAAAAA
ATCAACAACAATGATGATAATGAAAAAATCTGAAACTACTTATAGCCTATGGTCCCGGATGACATCTGTT
TAAAAACAAGCACAACCTGCAACATACTTTGATTACCTGTTCTCCCAAGGAATGGGGTTGAAATCATTTG
AAAATGACTAAGATTTTCTTGTCTTGCTTTTTACTGCTTTTGTTGTAGTTGTCATAATTACATTTGGAAC
AAAAGGTGTGGGCTTTGGGGTCTTCTGGAAATAGTTTTGACCAGACATCTTTGAAGTGCTTTTTGTGAAT
TTATGCATATAATATAAAGACTTTTATACTTATTGGAATGAAATTTCTTTAAAGTATTACGATGC
GCTGACTTCAGAAGTACCTGCCATCCAATACGGTCATTAGATTGGGTCATCTTGATTAGATTAGATTAGA
TTAGATTGTCAACAGATTGGGCCATCCTTACTTTATGATAGGCATCATTTTAGTGTGTTACAATAGTAAC
AGTATGCAAAAGCAGCATTCAGGAGCCGAAAGATAGTCTTGAAGTCATTCAGAAGTGGTTTGAGGTTTCT
GTTTTTTGGTGGTTTTGTTTGTTTTTTTTTTTTCACCTTAAGGGAGGCTTTCATTTCCTCCCGACTG
ATTGTCACTTAAATCAAAATTTAAAAATGAATAAAAAGACATACTTCTCAGCTGCAAATATTATGGAGAA
TTGGGCACCCACAGGAATGAAGAGAGAAAGCAGCTCCCCAACTTCAAAACCATTTTGGTACCTGACAACA
AGAGCATTTTAGAGTAATTAATTTAATAAAGTAAATTAGTATTGCTGCAAATAGCTAAATTATATTTATT
TGAATTGATGGTCAAGAGATTTTCCATTTTTTTTACAGACTGTTCAGTGTTTGTCAAGCTTCTGGTCTAA
TATGTACTCGAAAGACTTTCCGCTTACAATTTGTAGAAACACAAATATCGTTTTCCATACAGCAGTGCCT
ATATAGTGACTGATTTTAACTTTCAATGTCCATCTTTCAAAGGAAGTAACACCAAGGTACAATGTTAAAG
GAATATTCACTTTACCTAGCAGGGAAAAATACACAAAAACTGCAGATACTTCATATAGCCCATTTTAACT
TGTATAAACTGTGTGACTTGTGGCGTCTTTATAAATAATGCACTGTAAAGATTACTGAATAGTTGTGTCAT
GTTAATGTGCCTAATTTCATGTATCTTGTAATCATGATTGAGCCTCAGAATCATTTGGAGAAACTATATT
TTAAAGAACAAGACATACTTCAATGTATTATACAGATAAAGTATTACATGTGTTTGATTTTAAAAGGGCG
```

FIGURE 17 cont'd

```
GACATTTTATTAAAATCAATATTGTTTTTGCTTTTTCTGAGGAGTCTCTTTCAGTTTCATTTTTTCTCAT
CCCATGACTTCCCTCCGATGGT
```

FIGURE 18
SEQ ID NO: 10
Genbank ID        : AI922323
Unigene ID(#167)  : Hs.226391
Unigene name      :      anterior   gradient   2   homolog   (Xenopus   laevis)
    AGR2
>gi|5658287|gb|AI922323.1|AI922323  wn90h03.x1  NCI_CGAP_Ut1  Homo  sapiens cDNA cl
one IMAGE:2453141 3', mRNA sequence
```
CTGTTCAAAAAAGGTTTTATCCAAAAAAGTTAATCAAGACAAGCAACAGATACTGCAAAGCATTATATAC
AGCACCATAGTCCAGGGGCCAAAGAAATCAGGAGGGGCTGGGCAGTAGAGGAATTCCATATATTAATGAA
TGTGAGATTAAGTATAGAGTGAAGACATTAACACACAATTCTAATTTCTGTTAGGCAGAATGCTCCCCTA
CCCTGATGCCACAGCCTTTCACGTTTCCTAAACCCTAGTAACCTCTGATCTCCATCTGCCTCATCAACAC
GTCACCACCCTTTGCTCTTCTTCCAATTAGTCACATGTTGGCTGAATTTATTTCACTCCAGTACTTTAGG
ACCTTGACAGACAAATCGATTACAAGGTCAATTCCCAGGATTTCTTCAGGGTGTGTTCAGGAGTGCAGAT
GTTCTTTGGATGACCTTTCTACTAAATTAGACCTCTGAAGGAGAAAGCTACTTGCCAGAGGCT
```

FIGURE 19
SEQ ID NO: 11
Genbank ID        : D38553.1
Unigene ID(#167)  : Hs.308045
Unigene name      :       barren homolog (Drosophila)   BRRN1
>gi|559714|dbj|D38553.1|HUMORF007 Homo sapiens HCAP-H mRNA, partial cds
```
CAGGAGACGCCAAGGAAAGATGGGACCTCCGGCCCAGCACTGCCAGCCACAATGAATAACTCTTCTTCA
GAGACGCGAGGACACCCCCACAGTGCCTCCTCTCCTTCAGAGCGTGTGTTCCCGATGCCCCTGCCCAGGA
AGGCGCCTCTCAATATTCCTGGCACCCCAGTCCTCGAAGACTTTCCTCAGAATGACGATGAGAAGGAGCG
GCTGCAGCGGAGGCGCTCGAGGGTCTTTGATCTGCAGTTCAGCACTGACTCACCTCGCTTATTGGCCTCC
CCCTCCAGCAGGAGTATTGACATTTCAGCTACTATCCCCAAGTTTACAAACACGCAGATTACGGAACATT
ACTCCACCTGTATCAAACTGTCCACTGAAAATAAAATCACTACCAAGAATGCTTTTGGTTTGCACTTGAT
TGATTTTATGTCAGAGATTCTTAAACAGAAAGACACCGAACCAACCAACTTTAAAGTGGCTGCGGGTACT
CTGGATGCCAGCACCAAGATCTATGCTGTGCGCGTGGATGCCGTCCATGCCGATGTATACAGAGTCCTTG
GGGGGCTGGGCAAAGATGCACCGTCTTTGGAAGAAGTAGAAGGCCATGTTGCTGATGGAAGTGCTACTGA
AATGGGAACAACCAAAAAGGCTGTAAAGCCAAAGAAGAAGCACTTACACAGAACTATTGAGCAGAACATA
AACAACCTCAATGTCTCCGAAGCAGATCGGAAGTGTGAGATTGATCCCATGTTTCAGAAGACAGCAGCCT
CATTTGATGAGTGCAGCACAGCAGGGGTGTTTCTGTCCACTCTCCACTGCCAGGACTACAGAAGTGAACT
GCTGTTTCCCTCTGATGTCCAGACTCTCTCCACGGGAGAACCTCTCGAGTTGCCAGAGTTAGGTTGTGTA
GAAATGACAGATTTAAAAGCGCCCTTGCAGCAGTGTGCAGAAGATCGCCAGATCTGCCCTTCCCTGGCCG
GGTTCCAGTTTACACAGTGGGACAGTGAAACACATAATGAGTCTGTCTCGGCCCTGGTAGACAAGTTTAA
GAAGAATGACCAGGTATTTGACATCAATGCTGAAGTTGCAGAGAGTGACTGTGGAGACTTCCCGATGGG
TCCCTGGGGATGACTTTGATGCCAACGATGAACCTGACCACACCGCAGTTGGGGATCATGAAGAGTTCA
GGAGCTGGAAGGAGCCCTGCCAGGTTCAGAGCTGCCAGGAAGAAATGATTTCCCTTGGGGATGGAGACAT
CAGGACCATGTGCCCCCTTCTGTCTATGAAACCTGGAGAATATTCTTATTTCAGTCCTCGGACCATGTCG
ATGTGGGCTGGCCCGGATCACTGGCGCTTTAGGCCTCGACGCAAACAAGATGCTCCTTCCCAATCAGAAA
ACAAAAAGAAGAGTACAAAAAAAGATTTGAAATTGACTTTGAAGATGATATTGACTTTGATGTATATTT
TAGAAAAACAAAGGCTGCTACTATTCTGACCAAGTCCACTTTGGAGAACCAGAATTGGAGAGCTACCACC
CTTCCTACAGATTTCAACTACAATGTTGACACTCTGGTCCAGCTTCACCTCAAACCAGGCACCAGGTTAC
TTAAGATGGCCCAGGGCCATAGGGTAGAGACTGAGCATTATGAAGAAATTGAAGACTATGATTACAACAA
CCCTAACGACACCTCCAACTTTTGCCCTGGATTACAGGCTGCTGACAGTGATGATGAAGATTTGGATGAC
TTATTTGTGGGACCTGTTGGGAACTCTGACCTCTCACCTTATCCTTGCCATCCACCTAAGACAGCACAAC
AGAATGGTGACACTCCAGAAGCCCAAGGATTAGACATCACAACATATGGGGAGTCAAACTTGGTAGCTGA
GCCTCAGAAGGTAAATAAAATTGAAATTCACTATGCCAAGACTGCCAAAAAGATGGACATGAAGAAACTG
AAGCAGAGCATGTGGAGTCTGCTGACAGCGCTCTCCGGAAAGGAGGCAGATGCAGAGGCAAACCACAGGG
AAGCTGGAAAAGAAGCGGCCCTGGCAGAAGTGGCTGACGAGAAGATGCTTAGCGGGCTCACGAAGGACCT
GCAGAGGAGCCTGCCCCCTGTCATGGCTCAGAACCTCTCCATACCTCTGGCTTTTGCCTGTCTCCTACAT
TTAGCCAATGAAAAGAATCTAAAACTGGAAGGAACAGAGGACCTCTCTGATGTTCTTGTGAGGCAAGGAG
```

FIGURE 19 cont'd

```
ATTGAGTTCACTATGGAGAAGTCAGCAGCAGGAGGCCCATCCCTTACTCAGTTGCCGGGACATCCCCAGT
CTCGGGGGAAGAAGATGCCATGGGCTTATACCCAGGCTGTAGCCAACTACCAACGTGCCTGTTTGTTTGT
TGCTCTTTCCTTCTCTCCATCATAGTCTGGGTGCCAGCGCCCTGAAGCTCCGTGCTCAACTGATTAAACT
TTACTGCCCTATGGTGACCATCTAGGAGAGGGGAGGGCAGAGGGGGTGAGGGTACTATTCTGGATTGAGA
AAACCTATATCCATTCTTTATATCAATGTATAGTTTTAGTCTCCTAAATTGATCTGTTATTTTCCAAACT
ATTCTCTTGTAGAAAATTTTCCAGTGGGCACTTAATGGTGCCCTTGAAGAACTTCCTAATCCATGTACAT
AAAATACATCATATGTACACTTATAAATGTATATAGAATGCTCAAAAATAAAATTCTTAATAATAG
```

FIGURE 20
SEQ ID NO: 12
Genbank ID         : AL355392
Unigene ID(#167)   : acc_AL355392
Unigene name       :
>gi|10178502|emb|AL355392.7| Human DNA sequence from clone RP5-1187J4 on chromo
some 20q11.1-11.23 Contains ESTs, STSs, GSSs and two CpG islands. Contains the
gene for novel protein similar to mouse von Ebner salivary gland protein, the g
ene for a novel protein similar to rat RYF3, the LOC51654 gene for a novel prot
ein (CGI-05) similar to rat CDK5 activator-binding protein and the SNTA1 gene f
or alpha syntrophin (dystrophin-associated protein A1, 59kD, acidic component),
 complete sequence
```
GATCCATTATTTTAATAGTCGAAATATCTACATATTAAAGAGGCCAGGGAAAAATAAGTGAATAATCAAA
AACTAAATAAAGCTCAAATAAGATCTTAAAAGGTTAATTTCAGAAGCAATACTGATTCAGCCCAATTCAA
GCTACCTTTCTCCAGTACTTTTTTGGAAGAGAATGGGGAGAGACAGAGAGAGATGAGAAGGGAGGGAACC
AATATAATGAATTAATGAATTGTGTGATATAATGAATATAATGAACAATGAATATAATGAATTGTGTGAT
CTCAAAGTTCAAGACAATGGCTTCTTATAGGTAGAATGTTGAGACTCCGACCTTTTAGCAAAGGTACGTA
TCCAGGGAGTTTTTTAAAGGGAATCCAAAAGTGAAAAACTTCATAACATTGGAATTTTCTTATGTAAGAA
AGAAAATTTTGTTTCTTTGAATAATTTTATTTATCTGTTTCAAGGTGGGAATTTCATAAAGTAGGACCCA
GCTGTAGATTTTCTTCCCAGCCTCCAGCAAAATCATATTTTATCTGGCATCACACTTTAATAGTTAAAAA
TATATTTTCCAGTAGAAAAGATGACAAAAACTTGGAATTATACAATGCTCCTTGCATAGTATCTGTCTTT
AATGGTGAAAAGCTAAGTAGAAAGAACAATGTGTGAAAGCCGGCATCCCATTATCATCAGCAAATCCACT
ACATTCACTGGATTTGATATGATGGTCATAGAAATATTTTATTTGGCATGAAGGGAAAAGGCATAGCACG
TTTAAGAGGTGAGCGTCTGGTAGGAGCTCATTTAGAAAATGTTGAGGCCAGGCGCAGTCAGCCCACATCTG
TAATCCCAGCACTTCGGGAGGCCAAGGCAGGAGGATCCCCTGAGATCAGGAGCTTGAGACCAGGCTGGCC
AACATGACGAAACCCCGTCTCTACTAAAAATACAAAAATTAGCTGGGCGCAGTGGCGCACACCTGTAATC
CTAACTACTTGGGAGGCTGAGGCAGAAGAATCACTTGAACCCAAGAGGCGGAGGTTGCAGTGAGCTGAGA
TAACGCCACTGCACTCCAGCCTGGGCGACAGAGAGAAACTCTATCTCAAAAAAAAAAAAATTAAAAATAA
ATAAATAAATAAATGGGATGATGGAATGACTTGCTTTATATAATTGTGAGTATTCCATAAGATGCATG
GAAAAAAATCTAGCTAGGCTGGTCGTGGCGGCTCACTCCTATAATCCCAGCACTTTGGGAGGCCAAGGCA
GGAGGATCCCCTGAGATCAGGAGCTTGAGACCAGCCTGGCCAACATGGTGAAATCCCATCTCTACTAAAA
ATACAAAAATTAGCCAGACATGGTGGTGGGCGCCTGTAATCCCAGTTACTCGGGAGGATGAGGCAGGAGA
ATCAGAGAGGATGAGGCAGGAGAATTGCTTGAACCTGGGAGGTGGAGGTTGCAGTGAGCCGAGATTGCAC
CACTGCACTCCAGCCTGGGTGACAGAGTGAGACTCGAAAGAAGAAAAGAAGAAGAAGAAGAAAGAAAGA
AAGAGAGAAAGAAAGAAAGAAAGAGAAAAAAGGGAGAAAAGGAAGCAAGGAAGGAAAAAGAGAGAGA
GGGAAGGAAGGAAGGAGAGAGAGAGAGAAAGAGAGAGAGAAGAAAGGAAGGAAAGAAGGAAGGAAGGAAG
GGGAAGGGAAGGAAGGAAAGAAGGAAGGAAGGAAGGGGAAGGGAAGGGAAGGAAGGAAAGAAGGAAGGA
AGGGGATTGGAAGGGAAGGAAGGAAAGAAGGAAGGAAGGAAGGGGAAGGGAAAGGGAAGGAAGGAAGGA
CGGAAAAAGAGAGAGAGGGAGGGAGGGAAGAAAGGAAGGAAGGAGGGAGGGAGGGAGGGAGGGAAAATG
TTGAAATCTTTTTCAGTGTAAATCCATGGGTCTCAACCCTCGTTGCACATCAGAGCCATCAGAACCTGAG
AAACCTTTAAAAAATACTAATGGCTAGGCCCTACCCCAGATTCAGAAGTAACTGGTCTGGGTGGGTCCTA
GTATCCCAGAGGACTCTACTGTGTAGCCAGGATTGAGACCTGCTGATAGAAATGAAGGATGGGGAATTGT
GGGATAAAATGCAGAGGTTCCCCGGGACACTTTCCGGTGAGAAACAGGCTCCCCTGGCAGTGCCTGCTGG
GAGTCTCTGAGCTGAAAGTCTTCCATCCTCTCTGGGCTCTAGATTGGCAATGCAGCCAGGAGCAGGGAAC
GGTTATTCATAGGAGTTAACATTTCTCAAAGGCATTGTCATTCCTCAAGAGTATTAAGGGGTGGTCAACA
```

FIGURE 20 cont'd

AGACAAAAATGTCCTCAATAATCTTGGAGCACTGCCCTGAAAAGTGAGTCAAATGTTTGACCTTCTCCCT
AAGCAGAACAGCTCAGGTCAGGGTTAGGTTAGGTCAGAGTTTCTCAGCCTTGGTGGTACTGACATTTTGG
GCTGGATAATTCTTTGTCTGGATGCTGTCCTATGCACAGTAGGATGTTTAGCTGCATCCCTGGCCTCTAC
CCACTAGTTGTCATCCCCTCCAAGTTGTGACAACTAAAAATGTCTCTAGAAATTTCCAAATGTCTCCTTG
GGGACAAAATCTCCCCCTGTTGAGGACTGCTGGCAATTTTAGGAAGAGAAGTGCCCAGTGAGCAAAGGGA
TGTGTTGGGCTAGAAAGCCACAAAGGGCACAAAGAGATTGCCCAGGAGTCTGGTTGGGTCTGCCTTGCTG
GCCTCTGTTCCAGAGTCTGACATGTGAAAAGAACTCAGTAGCAACTTGCTGTATGAATAAACAAATTCTC
CATTTAACTCTTGTTTTTTCTTTTAAAGTAGAGTCTTGCTCTGTCACCCAGGCTGGAGTGCAGTAGCACG
ATTCCAGCTCACTGCAACCTCCACCTCCCAGGTTCAAGCAATCCTTGTGCTTCAGCCAACCAAGTAGCTT
GGATTACAGGAGTGCACCACCATGCCTGGCTTTTTGTATCTTTAGTAGAGATGAGGTTTCACCATGCTGG
CCAGGCTGGTCTCAAACTCCTGGCCTCAAGCGATCCACCCACCTTGGCTTCCCAAAGTGCTGGGATTACA
GGCATGAGCCATTGCGCCCAGCCTCCATTTCACTCTCATGGAAAACATAGACACCTGTGAGCAAGACAAG
GAGTCAGAGAGGGAGGGCTGCTGGCAGGCCAAGCACACCCTGGGCACAGGGAAAGGGACAAACCACTGCA
AAAGGTCCCAGGTGGCCCTGCAGGCTGGGTTCAACACACGAATGAATCCTCAACCCATGGATGGAACCTG
GCTGGCCATGGGCACAGCAGTAGGACACAGGCCAGGTGGGCTGGGCACAGCCCGGGGCTGCTGTGGGGCT
GCATTCTGGCCCCTCCCTGATGGAGCCCCTTGCTTATGCTGTTGCAGCTGTGTCCCGTGATCGAGGCTTC
CTTCAATGGCATGTATGCAGACCTCCTGCAGCTGGTGAAGGGTAGGTGCTCTGCTCTCTCTCCCACTTTT
TCCTTTACTACGGAGCTGGCCTCCAGACCCTGACTCCACCAAGGGAAGGCCTCCCCAAGTCAGGCCTGAG
CTGCAACTCAGGCCCAGAAGCAGGTGAGACAAGCATCAGTTGATCCCTGCCCCAGACGCGCAGACAGAA
TTCGCCACGACTAGGACTTCATGAGCTCTTACTATTTGTGCAGTTGTCAGGTCAGTGGATGCCCCAAGTT
CAAATCCCAGCTCTGCCCCTGACTTGCTCCATGACTTTGGGAAAGCTAATTTACCTCCTCATCCTCGGTT
TCCTCATCCATAAAATGGGGCTTAACCATCCCTACAACATAGGATTGTTAGTGAGGAATAAAAGTCTACA
GGAAAGTTCTGGGCACATAGCAGGTGTCCCTCTTGGCACAGAGAAGCACTTACAAATGCATGCTAAATGG
ATGGATGGATAGATGGATGGATGGATGGATGGACAGACAGAAGATGCTAAGATTACAAGCATGAGCCATC
ACACGCAGCCCCCGGACTAGTTTTTATGGATACTTTAGAAAACTGCAGCATCAAATAGTTCTATCCATCT
CGTTGCAGTTTCAAATTTTCCCTCCATCCAAAGGGTTTGAGGTATCTGAGAAATTAAAGCATGGGTTAAA
AACTGAGATATCTGGTTTAAAAAATAAAAATCAGAGATGATTCGAAGGGCAAAGACGGAAGGAAGTCATT
TCTCCCTCCCCAGCATAGCAGATACGGGAGGGCACAGGCTCCTGCCCCACATCAGAACTCTGCCATGC
TCAGGCCCCAGAGTGGAAACTGGCGGAGAAGAAGAAAAGTCTACCAACTGCACTTTGGGATCAGAAGAG
GCTCATTCCAAGGGCGACCAGAGAGGAGAAGGGAGAGCAGCATGCACTGAGCGCCACAGGGCATCTGCCA
TGGGCCACGCCCTCCCGCTGGGTGTTTTGTATAGGCACATCTCACTGACTCCTCAGACAACTCCATGAGG
TGGCAGTCATGACCCCCCTTCACTGTGATGAAAGAGGCTCCGAGCAATGAAGTCACTGTCCAAGTTCACA
GAGGCAGTTGGTGATAGAGGAAGACTTGAGTTCTGAGCGAGTGTCATTCGGATTGAGCCGTTACTAGGTG
CCAGTTGTATACATGAAGCAGGAATTACTATTCTACCGCCGTTTCCTTTTTTCTTTTTTTTTTTT
TAATTCCCAAAGAGTTCTTCCAATCGTCAGATATTTGGTCAGTATTCAGAGTAGGATCCAGAGTTCACAC
ATTACATTTTGTTGACAAGTCTGTAGATTTCTCTTTGTAAATCACATTTTTTGTTGTTGTTATAGCCAT
TTTCGGGGACCTTATTGACTTTAATATACTTTTTTTTTTTTTGGAGACGGACCTTTTTTCTTTTTTTA
AAGTAATTTTTACAGGAGTCATGCTCATCGTCTCTATGTCCTTCCGATTTTAGTACATGTGCTGCCCTGG
CGGGCACTATACCCTCATTTTAAGACGAGGAAACAGATTCAGACGCGAGAAGAGACCAGCCAAGGTCACT
GGGGCTCAAACCGAAGTCCAGCTGGCTCCTCCGCTGCCCCGAGGACGGGCCCGGAGGTCTCCCTGGAGCG
GTAGGCGGCCGGTCCCTGGCCCTCCAGCACTCCCCATCCTCGGCCATACACCGGGGCAGGTGACACACCA
CCGCCACCTGGCGGCCAAGTGGGGAATTCTGACGCGAACACGAGATCTTTGGGGGGAGCAGAGGAGCCAG
TTTGGATTTCAGAGTAGATGTTACCAGGCCTCTGGCTTCCAGCCTAAGCTTCCTTGAGATCCAGGTGCTC
ATAGGGTGTCCAGACCCAGAACCACCTGCATGGGGACGCGGCTTTCAGTCTGGTAGGGCGGTGGAGTG
TTACATACAATAGTTCAGTTCCGTTCCAAACCGGGACTTTGGCATAAAACCGACTGGGTTCCCATGCTCT
CATAGTATGGCTTTGAACAGGTCATTTCCCTTTCCTCAGACTTGGTTTCACCATCTGTAAAAGGGGGTAA
TAATAAGACCTACTTCCTAACGTTATCATGCAGATGAACCAGCTGACATGCAGAGGCCTGGCACTTAGTG
GATGCTCGATAAATGTCACTGTCATCACTGTTTGCATCATTATTATCAACATCATTATTACCTGCTCCTC
CCTACCTGCCCCCCATGCAACAGTACAGCTCCACCTGGAAGCAGCCCCCAACTTCCCCTCCAATACT
GCCCTCCACCCTCACAGAACTTTCTTCTTGTCCTTGAGCAGTGCCCATTTCCCTCAGCATTGACCGTCTG
GAGTTTGACCTTCTGTATCCTGCCATCAAGGGTGACACCATTCAGCTCTACCTGGGGGTGAGTGTCCCAG
GACCTTGAGGGTGAAGTGGGACATTGCTGCCCTTCTCTGACCACCAGGAGTCAGATAGCATGGGCCTGT
GTTAGGAGAGAAAATCCTGGTCACCATTAGGACACGGGCTGATCTAGAAAAATCACTGCAGGCTGAATAT
GTCCCATGCAAGTTTGTTTTGTTTTGTTTTTTTGAGACTGAGTCTCACTGTCACCCAGAGTGACATGGGG
GGGCCCGAGTGGGGACACTGCCCTCAGCCTTTCTCTCAGGCAAGTCCCTGCCAATCCCCAAACCTATG
ACAACCTTGAAACAAAAGCCAAGGATCAAGAAACACAGACCTAAGTTTCTCTCCTAGCTCTATGATTCCC
TGGCTATGTGACTTTGGGCAAGTTCCTTTACCTCCCTGAGCCTCAGTTTCCTTGTCTGCAAAATGTCAGT
AATAATGGCCACTGAGGAGAGGATGAAATGAGACCACACCATGCCTGGCAGACCAGAAGTGCCCAGTAAC
TGTCAGCTCCCTGTCCAATGTGGAGCTGCACAGCCATGCTGTGGCTGGACGCCCCAAAGGGCCAGACCAT
CCTGGTAGCATGAATCCCAGACTAGGTTTCTTTTGTTTTGTTTTTTTGAGACTGAGTCTCACTCTGTCAC
CCAGGCTGGAGTGCAGTGGTGCCATCACAGCTCACTGCAGCCTTGACCTCCTGGGCTCAAGCGATCCTCT

FIGURE 20 cont'd

CACCTCAACCTCCTGAGTAGCTGGGACTGCAGGCACTCGCCACCACGCCTGGCTAATTTTCTGTATTTTT
TGTAAAGATGGGGTTCCGCCATGTTGCCCAGGCTGGTCTCAAACTCCTGGGCTCAAATGATCCTCCCACT
TCGGCCTCCCAAAGTGCTAAGATTACAAGCATGAGCCAACACGCCTGGCCCCTGGACTAGTTTCTATGGA
TCCTTTGGAAAACTGCAGCATCAAATCGTTTCTTCCATTTTGTTGTAGTTTTTAATTTTCCCTCCATCCA
AAGGGTTTGAGGTGTCTGAGAAGTTGAAGCATGGGAAAAAAAACGAAGATATCTGGTACAAAAAATAAAA
GTCAGAGATTATCCGAGGGGCAAAGATGGAGTAGATGTTGCCACACACCTGAGCTCCAGGCTAAGCTTCC
TGGCAACAAATGCACAAAAAGGAAACAGGCTGAATGGTGTCATTTCCTTCTAGGTTGCTATTGGGTAAGC
TGCAGAGTTAAAATTCTTAGCTGACTCCCTGCTCTGTCTCCTCAGGCCAAGTTGTTGGACTCACAGGGAA
AGGTGACCAAGTGGTTCAATAACTCTGCAGCTTCCCTGACAATGCCCACCCTGGACAACATCCCGTTCAG
CCTCATCGTGAGTCAGGACGTGGTGAAAGCTGCAGTGGCTGCTGTGCTCTCTCCAGAAGAATTCATGGTC
CTGTTGGACTCTGTGGTAAACCTCAGCACAAGGCAGAGAATAGGGCCGCCCAGGCCACATCATAGGAATT
TCCTGAACACAGGGTGCCCCTAAGCAGGAATCCTCCATCAGGCTCAGTTTAATGGAGATCTCACTCCCTC
CTCTAATAGACCCTGCCTCTGACATAGCTCTAAACCTAAAATCCTCCCGGTAACATCCAGCCCCAGTCAT
GGTTCTACCCTCTGGAATCTGATGCAAATGTTTCCTCTACCAAATAACAGTCTCGTGAAATCAAAAGGCA
TCTTAGATATGCAGTAGTCCAGGGGTGATAAATACATCTCAGATAGTGAGTAGTCCAGGGATGGCGACTG
TGCCACTGCTCACCACTATGACACTCATGGCAGACATCACTAATCGATCAAGGCTCTCCTTTCTACTGAG
TCTGGATGCTGACACAACCTTGGAATCCTTATTAACAGGGCACAGCCGATAACCACCACCAGTCAACTAT
GTTGTGCCACCTCCTCCCGGGTGACTGACGGGGAAATTGAGGTCCAGAGGGGAAAGGGTTGGTCCAACG
TTATGGGAGGATGGCAGAACTTCAGGGCAGCTGACAGACAACCAATAACCAAGCTCTCAGGGGACTGGGA
TGGCGAGAAAATAGGGAGTGGTCACCAACTAGCCCATTCATGATTGCAGTAAAAATGAAATCACCTCTCT
ATGTCCTCTGAGATCAGGAAGCTGCCCCCAGACCCACAACCATCACCAGCCCACAGTAAAAGTCCAGGCC
AGCAGGACCCCATGCCCCATAGAAGCTGACCTAGGGGCTGTTTTTCCACCAATGACAGACACATGGCTTG
GGTCACTGGGCCCACCCAGCTTTTCTGGGGTCCTGGGAAACCTTCCTCCCAGCAGTGGGGTGCAGGAGAT
GTGCCTCCCTGTGCCCTCCAACTGACCTTCTCTGGCTCCTCTCACCCTCAGCTTCCTGAGAGTGCCCATC
GGCTGAAGTCAAGCATCGGGCTGATCAATGAAAAGGTTGGTCTGTTTGCCATCTGCAGCTTGAGGGGTGT
TTGCTGTGGTCTGGACACAGGCCTCTGGGGAGGAGAATCTAGTGGGACTAGTGTTTCATTCCAGCACTGG
GACACTCAAACCGCATCCCTGTCCGCACAGAGATTTCAGTCTAGCAGGCCAGTTTGACCTGAAGCAAATC
ATCACATGGATAGTATTTCCATTACAGCTGCAGTAACACAGGACAGGTTCTAGGGGCCATGAGAACACTC
TGGGCCCCTGATACAGTCTGGGACGTCAGGGAGGCCTCCCTGAAGGGAAGGGCATTCCAGACAGAGGGAA
CAGGAGACCAAAGGCTGCCAGGTAGGGAGAACAACACAACATTCAAGGATCTGCAAGAAGGACAGGGTGG
CTGGAACACGTGAGGGAGCAGGGAGCCCAGGAAGGCAGGCAGGGCCAGGCCACACAGAGCCTGTGGG
CCATGGTGGGCACTTGGGAGGCCACATGTGGGTCTGATCTCCTTCCAGGCTGCAGATAAGCTGGGATCTA
CCCAGATCGTGAAGATCCTAACTCAGGACACTCCCGAGTTTTTATAGACCAAGGCCATGCCAAGGTGGC
CCAACTGATCGTGCTGGAAGTGTTTCCCTCCAGTGAAGCCCTCCGCCCTTTGTTCACCCTGGGCATCGTG
AGTTCAGTTGTCTGCGATATTGGCAGCAACCAGGGGGACCCTTCTGTCTACTTTTCCTGTTCGCCCTCTT
GCTTTGTTAAACATTTCCACCACTCTCATCACTTAGCAGGGACAGGGGACAGGGAGCTCTGAACCAAGAG
CCAGGAGCTTTGTGGGTCCAATTCTAACCCTGTGACTTTCTTAGTCAGGAATCTCTGGACAGAAACTCAA
CTCATATGCACAAAAGGAATTGTATTAGCTCCTATAACTAAAAAGTCTAGATGCTATTGACTTCGGGAAT
AGCTGGACCCAGGTGCTCAAACAATATCCTCTTCATTCTCCTCTCTCCCACCTAGCAGCCTTGTTTTCCT
CTGTGCTGCCTTCATCCTCAGGCAAGCTATTCCCTCATGGTAGTGCCCAGGCTGCATTAGGCTCATATC
CTATCAGCTTGGCAATCACCGCAGGAAGAACCTATCTTTCCAATAGTTCCAGCAAACATCTCAGGGCTGA
CTCTCACTGAATGAGCCTGAGTCAGTTGCCCATTCTTGAGCCAATCAGTGTGTCCAGAAAATGGAATAT
GAAAACTTCCTGAGCTGGGCCACCTACACACTAGGGTAAGGGAGTGAGGGCTCTATGAATAGTGGCTGCT
TTCGTCGTCGTCATCGTCATCATTATCATTCCCCACAGCAAGCCTAGACTGTCATCTGTTAAATGGGGAG
TGGAGGCAAGTACTATCTCATTTAACAGATGAGGCAGGTGAGGCCCAGAGAGGTCAAACCCTTTGCCAAG
GTCCCAGAGCCAGGAACTGAGATTCAGACCCCAGAGCCTCCCTGCATAACCCCTAATTCCACACTCGGAT
CCTCTTGAGAACAATGGGGCCTGGCTTCTCTTGTTGCAGGAAGCCAGCTCGGAAGCTCAGTTTTACACC
AAAGGTGACCAACTTATACTCAACTTGAATAACATCAGGTAAACACACAAATCATCATGAAGATTCTGCT
GATGGAAATGAGTCCCGCCTGGTAACCATGGGTTTCTTTAAACACCGACTTTGTGGCTGTCAGGTGAAGG
CGGCTCCAGGGTAGGCAGGGAGGTCCTTCCGGATGCTCCTGCTGACAAGGACTGCATGTGAGGGAATGGG
GAGGAAAATGAAGTAGGCCTTGCAGCAGCCACGGCACAGGCAAACCCTAGCCGCGGCCAGCCCACTCTGG
ACACCTCCCAGGCCGTGGCAGTGACAGTCACCCGGCACAGAAGTGCAGGGCTCCAGCTGCCTCCTGCACC
CTGCCTGTTCTCCCTCCCCGCCACTTTCCTGTGGCCCCAGAGTGAGTGCAGGGCTGCCAGCTGGAGCCT
CTGGGGACAAGTCAGGCCCAGGGCTCTTTTGATCAGCCCACATAGGGCTGGGCTGTTTAATATAAATGAG
TTGTGCACATATCAAATCAGACTATCTGGCTGCCCTGTGCCCACAATCCTACATAGCAACAAACTGTCGA
GCCAGGAATTGGGGCGCCCTTTGAAGGAGCTTGGGCCTCCTTGTCCACCACAGCCCTGACTCCTGAGGTT
GATTTTCTGCTCACTGGACTGCTATTTGTTTTCTGTGCCCCCTCTATGCCCCCACCCCACCCCTGCCA
TTAGAATGCAAGCTCCACGACGCAAGGGCTTCATGTGGTTCACTGGAGCCCGCACTGTGCCTGGCACATA
ATAGGTGCTCAATAAATCGCTGTTGAATGAGTGGATGGTGAATGAGTGGGACTTCAGGGGCCGCTCTCAC
AGGCATCTTCCATTGCAGCTCTGATCGGATCCAGCTGATGAACTCTGGGATTGGCTGGTTCCAAGTAAGT
GTTAACAGGTGGTGCCTGAGGGCACAGGGGGTGGCCTGGAATGGTCCACTCTCAAAACAGATATTGCCCA

FIGURE 20 cont'd

```
GGATTTGCTTCAAACAAGGTCCCCACAGAAGCACCATGGGGGGCTGGCCGGTCTCCACCAAAGTCCAACT
TCCCTCGAGTGTTTACAGAGAAGCCACCACGTGTCAGACACAGCTGAGAACACACACACGCACACACAAA
TACACTCACAGATACACACTTTCTTTCAGTGAAGTTTTGATCCTGAATTAGAACACAAGTGCCCTTGACT
CACAATCTCATTCTGCACACGTAGACGCGCCTCAGTGCCCCTAGACAGCCCTTTCCTGCTGGGATTCAGA
CCGAACCCCAATACCTCAGTCTGGCGTGTTTTCTCTGGTTTTTATGATTTGTTTTTCACTATTTTGACT
TTTTTTTTTTTTTTTTGAGATGGAGTCTCGCTCTGTCGCCCAGGCTGGAGAGCAGTGGTGTGATCTTG
GCTCACTGCAACCTCCATCTCCCGGGTTCAAGCAATTCTCCTGCCTCAGCCTCCTGAGTAGCTGGGACTA
CAGGCGCCCACCACCACGCCCGGCTAATTTTTTGTACTTTTAGTAGAGACAGGGTTTCACCATGTTAGCC
AAGATGGTCTCGATCTCCTGACCTCATGATCTGCCCGCCTTGGCCTCCCAAAGTGCTGGGATTACAGGCA
TGAGCCACCATGCCCGGTGACTAATATTTTAAAACACGGAGAGTTCCACATGCAAATCAGGACTTCTGGC
TTCCCTCCAGAAGTCAGAAGTTCAGGCAATGCAGGGCAAAATTCCCTCAGGGCAAATTCAGCTGCAACAG
AGTGGTGGGGCCCCTGAGGATGGGGCATCCTCCAATGCACCCCAATCCCCCATCTACCAGGCCCCAGGG
GCGGCTGAGTTCATGCCCCAACCCAGCCCATCTGGTCCCTGGGAGCCCCCACAGCTCTGATCAGCAGGGG
ACCTGGAATTCCTACATCTCCACCAGCCACCTCACCCATGGGAGGAGCCACACCCACGAAGAATGATGG
GGGGGAACTTCAGATGCTCAACCAGGGTGACAGTGCCCTTCTCTCTCACAGCCTGATGTTCTGAAAA
ACATCATCACTGAGATCATCCACTCCATCCTGCTGCCGAACCAGAATGGTGCATACCTCTGCCATCTGTG
CCCCCTCTCTCCCCAGGGCTTGGCTTTACTTCCCCTGCCCTCATCTCCATGAATGGGGCCCCTTTCATTC
ATCTCCCAGCCATCCCTCAGAGCCTACTTCAAAATCTGCCTCCTCCCAAGAACCTTCTCAGCCCAATTCC
TTTGCTAGTGCCAGAGGCTGGGCTCGTAAAGATGAACCAAGCAGTGGGCCAGACTTGCAGGGCTGGAAGG
AGACAGAGGCATAAGCAGACAATGAGAGCAATGACAGAGGTGTAAGAGACAACTGGAGGCGCCTCAGCAG
ACCCTGTTCCCCCTCTTGCTAGTGCCTGGCCTTGGTCAAGCTGCACAATCCTTCTGAGCCTCAGTTTCTC
CATCTGTAAAATGGGGACGTAGAAGTACCTTCTTCAGAGGCACAAATCAGGAGGTGCCTGGCACAGTCAG
TGCCCAACACTCTAATTCAGCCCCAGGTTGAATGAGGGTGGGAAGGGTTTGTAACCTATACAGTTCCAC
CTTTTTAATTTCTTTATTTTATTAGACTGGAAAAATCTCAAAGTATAGAAACCTCTGCTGGGGATAATGG
GAGCCCCTGATGGTTCTTGAGCAAGAGCGTAAGAGAATGTGAGGACTGCATTTTGTGAGGGGCCAGAAGC
CAGTGCCAGAGGCAAAGGGAGGGTAGACGAGGCTGGGTCAATGCTGGGCCAGAGAACAGGCGAGCAGAG
GCAGAGGGGCTGTCTGATCAGGCCTGCCAGGCCGGGCTCCCCTTCAGGAACCCTGAGCCTGCCCTGG
CTGCCCAGTCTCACCCCAGGCCCATCAGTTTCTGACCACATTTGTTATTTCAGGCAAATTAAGATCTGGG
GTCCCAGTGTCATTGGTGAAGGCCTTGGGATTCGAGGCAGCTGAGTCCTCACTGACCAAGGTGAGTGGGT
GTGGCCCTAAACATCCTGCCCCAGGGAGGGCACAGCCACTGAGAGCCCTGGCTGGGAGGTGGGGCCTGCA
CTCCAACCCCAGCCTACAGGTGACCCTGGGCAAGTCCCTTCCCCTCTCAGGGCCTCACCTCCTCATCTGC
AAGTGAGAAGGTTGGCTGTGCTGAGGATGGAACCCTCCTAGCCTGGGGTCAGTACACTTTTTCCACCCCC
TTGTCATTCATTCATTCATTCATTCAGTAATTCACTAAATATTTTTCGAGGGTCTTCTATAGGCAA
GCCATGCTTCTGAGTGCTTGAGGCCACCGAAATGAACAAATGGAAAACACTCCCATCTTTTTCAAGCCTA
CCTTTTAGCAGAAGAGGCAGATACACAAGCCCTAAAGATGTAACATCAGGCTGAGTGGAGGAAGGCTGAG
AAGAAAAATAAAGCAGGCTCAGGAGGAGAGAGTGATGTCAGGGAAGGGGGTGCTGTTTCAGATGGGGTGG
CCAGGGAGGGCCTCTCTGAGGAGGTAACATTTGAGCCAATGCCTGAGGAGGTGAGGGGTGAGCCCTGTGG
GTAGCTGGGAGAAGTGTCCCGTCAGAGGGACAGCGTATTAGGCCGTTCTCACACTGCTATAAAGAAATAC
CTGAGGCTGGGCTCAGTGGCTTGTGCCTATAATCCCAGCACTTTGGGAGGCCAAGGTGGGCAGATCACCT
GAGGTCAAGAGTTCGAGACCAGCCTGGCCGACATGGCAAAACCCAGTCTCTACTAAAAATACAAAAATTA
GCTGGGCGTGATGGCGGGTACCTGTAATCCCAGCTACTCGGAAGGCTGAGGCAGAAGAATTGCTTGAACC
CAGGAGGCGGAGGTTGCAGTGACCTGAGATCACGCCATTGCACTCCAGCCTGGGCAACAAGAGTGAAATC
CATCCCCCCCCAAAAAAAAAGGAAAGAAATAAATACCTGAGACTGGGTAATTCATGAAGAAAAGAGG
TTTAATTGGCTTGTGGTTCTGCAGGCTGTACAGGAAACACGATGCTGGCATCTGCTCAGCTTCTGGGGAG
GCTTCAGGAAACTTCCAATCATAGCGGAAGGCAAAGGGGAAGACTGCACATCACATGGCCCAAGCAGGAG
CAAGGGTGGGAGGTGCTACACACTTTTAAACAACCAGATCTCACAAGAGCACACTCACCATCACGAGAA
CAGCACCAAGAGGATGGCGCTAAACCATTCACAAGAAACCAGCCCCATGATCCAATCAGCTTAGACCCCA
CCTCCAACATTGGGTTCTACATGAGATTTGGGCGGGACACAGATCTAAACCATATCAGATGTCAAGTGC
AAAGGCCCTGAGGCAGGGATTGTTGGTGTTCCAGGAAAGATGAGGAAGGAGGCCCAGGATCTGAGGCAAC
ATCCAAGGCAGGTAACCTCATAGGCCTGAGATGCATGCATGCACACACACATATACACACACACGCAC
ACCTTTATACACCTATACACATACATACACACGCACATACAAACACATACACCTTTATACACATACATAC
ACACACACACCTTTATACACCTATACACATACATACACACGCACATACAAACACATACACCTTTATACAC
ATACATACACACACACCTTTATACACCTATACACATACATACACACGCACATACAAACACATACACCT
TTATACACATACACACACATACACACCTTTATACACCTATACATATACATACACACACATACATATTG
CACACATACACACCACACATACACACTACACACACACATACACACCACACACACATACACACT
ACACACACACATACACACACACATAATACACACACACACATACACACTACACACCACACACAT
ACACACATACATACACACATACACAGAGACGCACACATACACATATACACACATACACACACTACACA
TGCACATACACATACACACACACACACCATGTGGCCAGATGGTCTCAGCTCAAGGCCAGGATCATG
TCCATCTTGTCCATGCCTCTGTCCCCGGTGCTCAGCATGGCCTGGCACACAGTAGGTGTTCAATAAATGC
TTGGTGAGCAAATGACTCTCCGTGGCATCTGCTGGGGAGAGGATCTATGGCAGTGTCACCCTCGCTCCCA
AATACTACCCTTAAGAAGAACAGCTCACAGTCACTGTGTGCCAGGCTCTGGGGCATCTCTCCCCCTCTAG
```

FIGURE 20 cont'd

AGTGGAGCCAAAACTTCAAGAAGGCAGGGGTTTCTGTCTGCTTTGTTCTCTGTTGTGATCAGTGGCTGCA
CACAGTAGGTGTTTAGTAAATGCCTGCTAACTGAGATGGACACCTTACTGTCATTAGCTCATGCAGAGGA
GGGGCCCAAAGCAGGGGGTGATCAAGGCGGGTGCTAAGTGCAAATCCCACTTCTGCCACCTACTGAGTGC
GTGACTTTGGAAAGGGGCTTTTGCCATCTTCAAGTCTCAGTGTCCCCATCTGCAAAATGGAGATGACATC
AGGACCTGGTGTGGCATTAATGTTCACACACAGACCCTCCACCCCGACCCTTCTAAGAATTCTGTATTTG
TGGGTTCAGGGTCATGGTCCCCGGTGCCAGCAGTCACCTTATGGAGGACAAAACCAGCATAAACCACAA
GGCAAAAGGTTAAAGAAACCTGTTTTCTGACTTTTCCCCTCCAATTCCAGGATGCCCTTGTGCTTACTCC
AGCCTCCTTGTGGAAACCCAGCTCTCCTGTCTCCCAGTGAAGACTTGGATGGCAGCCATCAGGGAAGGCT
GGGTCCCAGCTGGGAGTATGGGTGTGAGCTCTATAGACCATCCCTCTCTGCAATCAATAAACACTTGCCT
GTGATGCCTGCCGTCTGGAGTCTCTTTGTCCCGGCACAGGAGTCATTTTGCCCCTGGCAGGCTTGGGGAC
TGGATGGCTGAGCCACACCTGGGTCATGTTCAGGCACATCTGAGCCAATCTGGGTGATGTCTGGGCCACA
TGTGGATGATGTCCACAGTCTTGACCACCTCCCTGTGCTTCAGGAATCAGAAAGCCAGCTCTTCCCACCT
GCCTTCATGTCAGCCTCAAGACCATCTTCAGTGGGATGGCTTTTAGGGTGGGGACATATGTTTTGTTTA
TCTTGGCAGTGTGGTGGACAGAGGACTCTCTGAACAATGTGGATCTGGGGCAGATGAACTAGGCTTGGA
GCTCTGGCTGGCCTCTTAATGCTTCTTTTGACTCTGGGATGTAGTTTCCCCTCTGTGGGCCTCAGTTTCCT
TCTCCGTAAAATGGGGATAGTCATTGTCTCTGCCTTGGAGGGCTTTGGTGAGGAGTAAATGAGAGAACAG
TTCCAGATACATGGTAGATACTCAGACAATGTCGTCTGTGGGTGGTCATTACTGCTGTTGCCTGGCCTCT
GGAGTGTTCAGCCTTATCACCAAAGTGCCATCCTGCTCAGACAGTGCATGACTGCCTTGTCTTTCTGGCC
TCCCTGATGTCAGGGCGCTTGGGACAGACAATAGGGTCCCTGTTCTCCAGACCTCAGGCCTGCCCAGTAC
CTTCAGTTACACGAGGGCCTTGCAGGAAGGGATAGGGTAGGCATCCCAGGAAAATGCGTTGCTCATCATG
AGAGCACAAACAGGCATAAGATATACAGCTCACAGCCCAGAAGGGCAGCCAGGGACATTGGCCAGGCCAA
GAGGCACACAGAGGCACCAGGCCACAGCCTTGCACAAGGTGCTTACACCATTGTCAGTGACCACTTACCC
AACAGCTACTGAGTGCCAGGGCTGTGTGGAAGTTCCCCACGCATCCCAGCTCCCAGCCAAACAGCTGCCC
AGTGCCAGGGCTATGTGGAAGCTCCCCACGCATCCCAGATCCCAGCCACACTTTGGGTAGGATTTTGTTC
CCCACACATCACATTCCATTATTTTTCTAAATCATATTCAATCTGCATTTGAACTCCCATTCACAAAGGA
GGTGACAAAGTCCATCTCCATCTTGCCTAGGGTTGGACTCTTCTGGCTCCCTAGGGTCATACAAGGATCT
TTTGGGGGCTTCCAGGGAGCCTGGAGGATGGAGTAGCCCCTCTAGTCTGGGTCCCACCTGGTCCTGATGA
AGGGATCCCTGTCCCAGTCCACGTGACCCTGTCAGAGTCAAGTAGCTCCTCCACCCCAGCCAAGCGGGC
ACAGGGATCCTTCTCCAAAACAGCCCGAGCCGTATATCCTCCGCGTCCCATCACCCACACCCTCTGGGGC
TTCCTGGGGGTCAGCAGATACATAACCCTGGCTTCCTCACCCTTTGGGGGAGGGAACAACTCTAGGACAC
CTGCTGTAGACAGGCTCCCAGCTCACCAGCGGGACTGGGCCCCAGTTGTCCATGCTGATAACCAGCGTGC
TGACACAGTTTTTTTTTTGGTGGGGGGGTGTGGTTTGGGGTTTGGTTTGGTTTTGTATTGTTTTGTTT
TGTTTTGTTTTGTTTTTGAGACAAGGTCTTGCTCTGTTGCCCAGGCTGGAGTGCAATGACACAATCTCA
GTTTACTGCAGCCTCAAACTCCTAGATTCAAGTTATCCTCCTGCCTCAACATTCCAAGTAGCTTGAATTA
TAGATGTGCACCACCATGCCCGGCCCAATATGCTCTTTATAGGTTGCCTCACCTCCCCACCTCACTTCCA
CACTCCCCTACCAGTGTTCCCTGGGGTCATCTCCCAAATCAACTACCTGCACTCCAATCCTGTTCTCAGG
GTCTGCTTCTGGTGAACCTCAATCAAGATAGCCATTTGCTCCAGGCAGGCACTATTCTAAGGATCTTCCA
GACCTTTGGTCACGCCACCTTCCCCAGCGCCTGTGGCACAGGCTCCCCCACACCTGCACCTGACAAATG
AAGAAACCAAGGCTCTGACAACTCTGCACCACTCCCAAGCAGCCCCAACTATTACCCCACACCACCTCC
TTCTTCTCTCTGCTCCTTTATCGCCTACCCACTTGGGTTTCCACCTCCCCAAAAAAAGAGAGGGGTTGT
TCTCCTGTGCCAGCCTCCTGATTTGGGCCTTGAAACACAACCACCCTCCATGAACTGCTGAGGCTCCTCC
AGGCTGGGAATTCCACGACTCCACTGCCTTGCTGGGCTGCGGGAGGAAAACTCCTCAATTTCCTGCTGTC
TTAGCAGCAGCAGCAAAGAGAAAACACCAAGAGATCTCATTAAATCATCGTGCCTTGCAGGAATTAGTAC
TGTGTTTGTCTTACAGATGGGAGATGAAGTAACAAACAGCTGGTGATGTGATGGGCTGGGCGGGAACC
CAGGCCTCACCCACTTTGCCCTGAGCCTCCCAGCTGAATCCACAGCAGGTTATAGATCCAATTTTCTTTC
TTTCTTTATGTCTTTTTTTTGAGACAGGGTCTCACTCTGTCGCCCAGGCTAGAGTACAGTGGTGCAATC
TCTGCTCACTGCAACCTCCGCCTTCCAGGCTCAAGCAATTCTCCTGCTTCAGCCTGCCGAGTAGCTGGG
ATTACAGGCATGCGCCATCATGCCCGGCTGATTTTGTGTTATTAGTAGAGACGGGGTTTCGCCATGCTG
GCCAGGCTGGTCTCGAACTCCTGACCTCAAGTGATCCACCCGCCTCGGCCTCCAGAGTACTGGGATTAC
AGGCATGAGCCACCGCGCCGGGCCCAGTTTTCTTTTTCTTCAAAATAACGGTAACAACCAGCAGCCTCT
GCTCCCAGCACAGTGTTATCTACTTCCTGTGAGTTGAGCATTCCCCTTTTACAGATCAATAAACTGAGGC
TCAGAGAGAGGCAGTAACAGTGTCTTGCCCATCTCCGTGCCTGCCTAGGGCTTCCCTTTTGTGGAAGAC
ACCCCCATGAAACCTCCCATCTCTCAGCAGAGATTAGTCAATGAGGTAAGCATATGGAGGCCGTGGGCT
CCGGTCTTTTTCATTTAGAGACCAGATTTGGGAAGGAAAGAAGACCTCAGTGGTTCCACTAACACCCTGC
GCCTTCCTGGTGACTCAGGTGAGCAGTTAACCCAAGAGCTTTTCTCTGCCCTTGGCAGAAGGAAGACAGC
CCTTCACAATAATATTGAGACCCAGTTTGCAGAAATGAAGGGGACCTATCAACTCTTAAATCATATTCTA
ACCCAAAAAATCTGAGATTCTAAAATAAGAATATCCCATCTAATCTATGCTGCCAAGTCATATTAGGTTG
ATGCAGCAACTTAATACTGACACTAGCCCTTTGCTTTTGAGGTTAGCCAAAACGAGAACTTCAGAGCTGC
CATTGACCTTGTGCTTCCTGCACAGCTGCTGTCTTCTAGACCCCACCCTTCAGGTTGGGCACGGTGGCTC
ATGCCTGTAATCCCAGCACTTTGGGAGGCTGAGGCAGGCAGATCACGAGGCCAAGAGATCGAGACCAGCC
TGGCCAACATGGAGAAACCCCGTCTCTAATAAAAATACAAAAATTAGCCAGACATGGTGGCACGCACCTG

FIGURE 20 cont'd

```
TAGTCCCAGCTACTCGGGAGGCTGAGGCAGGAGAATCACTTGAACCTGGGAGGCGGAGGTTGCAGTGAGC
CGAGATCACGCCACTGAACTCTAGCCTGGGCAACAGAGAGAGACTCCATCTCAAAAAAAGAAAAAAAAAA
AAGAACTTGCCCTTCCATTGTCAGCCTCTCTGCCCCAGGTCTCCAGCCAAAGAACACAGTTTAACACCTG
CTCTGTCCATGCCTCTGAGTTGTGAAAGGGAAAGACATTAACCCCAGGAGGAAACCCTGTGAAAAATCCA
AAATCCACCTAGAGAAGAGTCACACCTGCCATTGGGGTGCCCATACTAGACAGCAATTAATGAAGCCGTC
AATGCTGACACAGCCAGCTGTGCACACTCGCAGTGGGGATGCCAGGATTCCCACATCAAAGGACCCTGGC
ACAGCAGTTTGGTTGGGAGCTAGGTCTCCGAGTCTTGGAGCTGCGTGGCATAGTGACACCAAATTTCTCT
TTCACTGAGTGGTCAGACCCCTCTCTGGGCCCTGATTTCAAATCCCAGCTTTATCATGGACATGCTGTGT
GACCCAGAGCAAGGTACTTAACGTCTCTGAGTCTCAGTTTTCTCATCCATAAAATGGAAGTTAAAAGAAA
TAACTTTTTGAACACTTCCTATATGCTAGGCCCTGTACTGAGTTGCCTTAACGAACCTTCACCATACCAA
AAAGACATAAATGGATCTATCATTCCCATGTTACAGACACGAAAAGTGAGGCTCAGAAGAGAAAGCCACT
TGCCCACAGTCACACAGCTCCTGATTGAAGGTGGCAGTTTGAGCCCAGGCCTGTCTGGCTGCAGAGACCA
TGCCATTGGTGACCACGTCATAGCAAAAACTGATGGCTTGGACAACCTAGACAGAAAGGGCATAGGTCCT
GAGACTCGGCAGAGCTTGAAAGTAATTTTAAAATTAAAAAATTTTTTAAAAGACTATAGAGAATGGCTAC
CAGAAGGTGGACCCCAGAGCCCCCCTGCCTGGCCCTTGCCACCCACCTGCTCTCCTCCCTCTGCCTCACC
CCCACACAATCACTCCCGTGGGTTCTATGACTGCCACATCCTGTACTAGGAGCCCCCGCAGGGCCCCTCC
CGAGAGCTGGGGTCCCTACCAGGCTCCACAGCTCCAAGGACGTTCCAAACGGAAATGACCCACTCTCAA
AATCACAGGGCCCCACCCGCCTCCTCCCTAAAGCCTGTTGGTCCAGGACTCAGGGCCTGCCCCTCCAGCC
TCAGTTTTGGCCAGAAGCCCCTTGCCACCCAGTGCCAAGAGGACCTCTCCCTCCACTGAAGAGCTCCTCT
GAGCCGCAAGCCTGGCCAAGGGGCTGGACTTCCTGCCCGGGTACCCACCCGCCTGGGCTTCTGAGCTCAG
GTTAAAAAAGTTGTCTTTCTGGGAAGCTGGAGACAGAGGCCAAGGAGAGATTCCAGATAACCCCATTCTT
GGAGATGTAAGGCCAAGGAGGTCAACGGGGCATTTCTCAAATATTTCTTGAGCACCTATAAAACGTTGT
GAAGTGGCACACAGATTTTTAGCACCAGGCGAACCTGGGCCGGAATGCCGGCTCTGCCACTCACTACCTG
TGTCACCTTGGGTAAGTTATCTCTCCATTCTGAGCCTCAGTTTCATCATCTGTATCTTGGGCCTGATATC
AATGATCTGAGACCATTGGGGTGAGGACTCAATGATGCGATGAAGCTTGTGCAGCCCTCAGCATGGTGCC
TGGCACATAGTATGGACTCCAGAAGTCAGGGTCGGTATGGCTGGCTCAACCCAGGAAGTGGAGAGGGTGG
AAAGATGAGTGTGCTGTGCTGAGGGCAATGGGGAAAGAGATCTGACTTGAGTGAACTGATAGAGAAAG
TGTTTGACACAGAGACTGACTAAGTGCTGGTTGGATGAATAGTGGATGCATTTGACATCAGCTTGGAAGA
GCAAATGCCACAAGCACAAATTTCACAGCCCAATCAATACAAAGCAGTTTGTGTATGCAAACAAACACAA
AACCATTCTCTTTCCGTTATCCGATTTGGTCACTGTTTTGAAATCCTGTGCCACCAAGTAGCAAAAAACT
GGATACTCAAGGCAATGCCAGGACATTCTAAGGCACTCCAGCGTAGGCTTAGCCACTTCAGGGGTCTCCT
CGCCTTGCTCAAGGGCAGCGTCTACCCTCTGGGTGGCTTCTTCATGGGCATGGCATGGAGGGCAATGGTA
GCTCCTCTGTGGGCCCTGTTTATAGTGACATCTGCCCTAGAGATGTCTGCATTTTGGCTGGTCCCTGCCT
TGCAGTTCCAGAAGCTTCGTTTCCTAGTGGAATGCTCCTGCCCACCCAGACAGCCCCTGCCTGCAGATTC
TGGGGTCCCAGCTATGCCCTTTCAGACACGTGGCAGGGCTGAGGTTCTGCTGGTAGGAACTGGTGGTACA
AATGCAGTGTTTGGAATATTTCTCTGCTAGCTGGTAAAGATCTGTAGCTTTAAGCCCCCCAGGTGCCTAC
CGCTACCACCTCTCTGACACCTCCCCCAGAACCTCTATCCCATAGCAAACTCAAGATCCAGAAGCCTCCA
GTGTTAAAAGGAAGTGCTAGGCTATGAGGAATGACTCACACTTGTAATCGCGGCACTTTAGGAGGCCAAC
ACAGGAGGATCGCTTGAGTCCAAGAGTTCGAGACCAAACTGGGCAACATGGCGAAATCTAGCCTCTGCTA
AAAATACAAAAATTAGCTGTGCATAGTGGCATGCTCCTGTAGTCTCAGCTACTTGGAGGCTGAGGCAGGA
GGATTCCTTGAGTCTGGGAAGTCGAGGCTGCAGTGAGCCAAGATTGTGCCACTACATTCCAGCCTGGGTG
ACAAGGCAAGACCCTGTCTCAAAAAAAGGGGAAGTAATACATCCTTTAACCTCTCACAATGTCATCCA
ACCATATTAACAGCTGTTGGGCACTCACTGCTTGCTAAGTGCTTTGCACATATTATGGAACATATTCCTC
ACAACGACCTAGAATTGTCCCCATTTTACAGATGAGAAAACTGAGGCATGAAGAGGTCCTGTGACTTGCT
CAGGTCCCACCCTCAGGAAGTGGCAGGGCCCAGCTTTGAAGCCAGCCCACGCTCTGGAGAAGGGCACTCC
AGGCCGAGGGATCCACAAGCACAAATGTACAGTGGCAGGAAGTGCAGGCTGTGTTCGAGGACTAGCGGAT
CTGGAGCTGGGGCAGAGGCAAGGGAAGGAAAGCTGGAGAGATGGTCCTAGGAGAGGCAGAGCTGGAGA
TACACAGTGACAGGGCCCCGGTGAGGACGTCAAGGCTCCCACCTCTGTGTCTGCAGGTCCTGGCCAAGAG
AATGCTGCTGCTCTGGATGTCACTGCTTGCTGGACGCTGCTGCCCCAGGCCCAGGGGAAGGCCCAGCACC
TACTCTGCCTTCAGAGGACAAGAATCAGTGGGAAACAGGTAAATGTTAAGGGGTGAGCGTCAGAGGCATG
AACTCAGGAAAGGCCAGGGGTGGGAGACGGCCACCACCTCCTGCTCAATGCTTTCTCCTGTACAGGCCTCC
CCCTTGCCACAGAATTCACCTTACCTCACCCAGAGCTGATCCTGTCTCCCCCTGCTCTAACACTTGCCA
TGGCTCCTCAGTGCCCTCAGGAGAACCTCTGAGCCCCTTATCCTGGCATTCAAGCCCTGCATCTCCAGC
CTCTTCCACTGCCTCCTTCCCTGACCACCCCACAGACTTCACAGCTCCCTCCTGTGCTAGGCTGTTCCT
CTGGCCTGAAATGCCTTTCTCTCCTGCTCAACCTGGTGCATCTGGGCCCATGCTTGAACGCAAAGTTCTA
ACCACCTCCTCTGGGAATTCCTCTCGATTTCCCCAGGCAGAAGGGATCTCTCCTTCCTCTGAGTTCCCAC
AGCCCTTTGGTGACGTCTCCTCTGCGGCCTTATCCAAGTGTGCTGCGCCTGCTGTCCCATCTGTCTGTAG
GGCTGGCTGCCTCTGTCCCTAACTCCTGACTGAGCTGTTTGTCATCCATCCAGCCCCATCCCCGCTCGCC
ACGCTGCAGCCTCACTTATCTTTCTGTTTCCTACCACGCCAGGCTCACCAGCACCTCAGGGCCTTTGCAC
GTTCTGTTCCCTCTGCCACCATGGCTGTCCCCGAGATCAGCCTGCATGATGGATTCCTCCACCTCACTCA
GGCCTCAGCTCAGAGGCCTCCTCCTCAGAGAGGCGCTTCCTTTTCACCCCATCAGAAACAGATCTTCACC
```

FIGURE 20 cont'd

CAGTCATGCTCCGACTCCACTGTATTTTTTCTTTTGCACAGATCACTCTGGAATATTGCCTTGCTTGCTG
ATCTGAGTGCTCGGCTTTTGTCTCTCTCCCTACCAGGAAGTAAACTCCATGAGGGCAGGAGCCACACTGC
TTCTGTCCCTTGAGCCCAGGAGAGAGTAAGCACTCAGTAAGTGCTGGCTGCCAAATGACTGAGTGAATTT
GGTGAAAGGTTGAATGAACAGTACAGCCCCACACTGAAGCGGGGCTTGCATCCTCGGACAGTTCAGACCT
GTTCTCAGAGCACTACACCCTGGACTGCATGCTCAGCCTGCCTGTGACAGGGGCCAGGAGCAAAGGTGTT
GCTGTCCTGGACCACCTGCCCTTTGTAGGCAAACGCCTCTCCAAGAAGAGCAGTGGGCTGGACCTGTCGC
AGGTCGGTCGGGAACTGCTTTCAGGGAAGAGCCTCCCCCTGCTGTGGGAGCTACTCAGGGCAGGTGGAT
AAGTGGAGGGCTAGGACTGCCTCTGGCCTTTCCTGGTACCCTGAGCAGCTGTGTTCTCAGCACGGTGTCT
TTGGAGGTTCTCTATAGCCTGGAAAGTGCTAAGCAAGTCTACTTTTCTTGACCCTATGTCTCTCCAAGCT
GCTTGAAATCTTCCTAGGAAGAAAGTAGGGTCTCAATCTGGGACCTCAGCCCGGCAGCCCTCCTGCTCCC
TACACTCAGCCTACAACTGGGTTTTCTGCAAACCTACATAGGTTTTTGAAAAATATTTTTAATGAATTGC
CAACATATAAAAATCAAGAAGATTTTAATCAAAATCTGGGTTTCCCAATTGTATTAGATTGTGAGGACTG
CCATAACAAAGTACTATTAATACAAACTGAGCACCCTGGACAACAGAAACATATTGTCACAGGCACAGCG
GCCGACATCAGTAATCCCAGCACTTTGGGAGGCCAAGATGGGCAGATCATTTGAACCTAGGAGTTCAAAA
CCAGCCTGGGCAACATGATAAAACCCCATCTCCACAAAAAATACAAAAATTAGCCAGGCATGGTGACGCG
TGCCTGTAGTCCCAGCTACCCTGGAATCTGAGGTGTGAGGATCACCTGAGCCCTGGAGTTCAAGGCTGCA
GCAATCCATGATTGTGACACTGCGACTCCAGCCTGGGCAACAGAGTAAGTCTCTGTCTCAAAACAAAACC
TCCAGGTAAGGCAAGAGGGCTCGCACCTGTAATCCCAGCACTTCGGGAGGCCAAGGCGGGTGGATCACTT
GAGATCAGGAGTTCGAGAACAGCCTAGTCAACATGGTAAAGACCAGTCTCTAATAAAAATACAAAAATCA
GCCAGGTGTGGTGGCACGCACCTGTAATTCCAGCTGACTGGGAGGCTGAGGCAGGAGAATCACCTGAACC
TGGGAGGCAGAGGTTGCAGTAAGCCAAGATCACACCACTGCACTCCAACCTGGGCAACAGACTGAGACTC
CATCTCAAAAACAAACAAACAAACAAAACCCACCAGAGCCGGCACAGTGACACACATTTGTAGTCCCAGC
TTCTCAGGAGGCTGGAGAGGAGGATCGCTTGAGCCCAGGAATTTGTAATGTGATTGCACCTGTGAATAGC
CACTGCATTCCAGCCTGGACAACATAGCGAGACACCATCTCAAAAAAAAAAAAAATCCGTGCTAAAGGC
AGATATACAGCAGGGAGCCTGACCCAGAAAAGTTTTCCTCTGGCATTTGAATTTGTTGCTGCCTCTTCCA
GTGGGCACCAGATGAGTCACCAGCTTGTACCTAACGTTCAAAAAATACCTAAAACTCGGCTCCTCTCAGC
TCAGGGAGGTGCTGGTAGCTGATGGTGCAGAAGGGAGCAGAGCAGATGGGTCCTGAGCAGATGGCAGAGG
GCTTACCTGCCACCTTGCCTTCCCTGACTCTCGCTGGCCTGCTTCTCTTTTGCAGATGCTTACGCTCCTC
TACTGTTCCCTCCCCATTTTACAGAGGCTGACACGGAGGCCCAGAGAAGGGAAGGGACTTGCCTGGGTC
GTCAAGCCTTGGAGAATGGAACTAGAGCTCAGCGTTCTACAGCTGGGCTGGGGGCAAGGGAAGGGGTTGT
CCCAAAGCTGCTCCCACCCCTCCTGGGCTCTGCCCCTATTCCAGCAGATCCGGATACTCACACCCCACAG
AGTCACAGAGGCCTGGCCAGGCCACACCAACATCCTCCATGCCTCTCACAGGTTGGTCATAGAAGACGCC
AAAAGACCTGAGATCACCCTGCAAATCCTAAGTGATAGCCTGCTGCAGGTCACGTTGCGCTGCAAACTGT
ACCTCTCACTCCAGGAGTAAGTACACACGGGCACTTCCGCATCACCCATTTGGGTGCCAGGCAGACCAAC
CCCTCACTGCCATGAATCAAGAGGCAGCCATGCAGGGCTAGCAAAAGTCACATGCCTCATGTCACCACAC
GATCCTTTCCACTTGGGCGTGTTTCAAAGCCATTTTTACTGATAAGGAAACTGAAGCACGGAGTGGGAGA
AGAACCTGCCCAGGAACACACAGTAAGTCGGTGGTGCAGGTTGGATAAAACCCTCTGACTTTCATGTCAG
GGGACGTGAGCCCATCTGAGCAAATGGGCAGGACAGTGTATTAACAGGATTACCCGAGGAAGGTGTGGTT
CAAGCACGCCTTGGAGTCTGGCACTCCTGGGCTGGGCAACTTGGGCAAGAGGTGTCCATTCTCTGGGCTT
CGGCTTCCTCATCTATAAAATGGGTATAATTGGCCAGGCACGATGGCTCAGGCCTGTAATCCCAGCACTT
TGGGAAGCTGAGGTGGGCAGATCACTTGAGGTGAGGAGCTTGAGACTAGCCTGGCCAACATGGTGAAGCC
TTGTCTCTACTAAAAACACAAAAATTAGCTGGGCATGGTGGTGGGCGCCTGTAATCCCAGCTACTTGAGA
GGGTGAGGCAGGAGAATCGATTGAACCTGGGAGATGGAGGTTGCAGTGAGCCGAGATTGTGCCATTGCAC
TCCAGCCTGGGCGATAGAGCAAGACTCCGTCTCAAAAAAAAAAAAAAGATATAATTCTGGTTTCCTGC
TGCACTAGGCTGTTGTGAGAGTTCACCTGCAAAATTCTGAACTGCAGCTGATTGGACAGACCAGAGGTTG
CAAACACAACAGCCAACAGCAGCAGTGATACAAACCAGTGTTTGCAAGTAAAACAGAAATATTCCTAAAT
GCCCTTTAGGAACGTGTCCACTCTTGTTTTTCTTGTAAAATTTGGCTCTCTTCATCTAGCTTCCACCTTT
TTTTCTTTTTTTTATTTTTTCAGACAGAATCTTGCTCTGTTGCCCAGGCTGGAGTGCAGTGGCGCGAT
CTGGGCTCACCACAACCTCTGCCTCCCAGATTCAAGCAATTCTCATGCCTCAGACTCCCGAGTAGCAGG
ATCACAGGCATGCGCCACCACACCCAGGTAATTTTTTTATTTTTAGTAAAGACAGGGTTTCACCATGTC
GGCCAGGCTGGTTTCAAACTCCTGGCCTCAAGTAATCCACCCGCCTCAGCCTTCCAAAGTGCCGGGATTA
CAGGGGTGAGCCACCGCTCCTGGCCAAACTTCCCCCTTTTAATAGAGATGTGAGTACAAATAAATATTTC
TTTGATAGACACGTGGACACAGAGAAATATTTCTCTGCAATATGGTAAACATATCATTCCCCTTGTAGGG
ATAGTGCAGTAAAAATGGAACCTGACCACTGGCCTGGTGGGACCACAGCAAACTAGAGAGCACATGGCC
CATCTCAAGGTCACCCTCAGCCCCAGATGTTTGCCACTCTGTGAGACCAGGGGATCCAGTGTTGTCAGAT
CATCTGGGTTTTCCATATTTTAATGAATCCTCCAGTTTTTAATTTGAGCCCTTCAGGCAACGGCAGGC
TATCAGCTTGTGACCTCTGGCCTCAACTTTGGGCTCCGCACTTTCATCTGCCCAAATACACTGTCCCTAC
AGGATCCCGTGGCTCAAAGTCATCAAGAGCATTCACATTGGAGTACGGCTGGAACAGACAGGGAATACCA
CCAAGGTGGCTTTCGAGGAGTGAGGAGTGCCACAGCCCACCTGGACACCTGAGCACTGAGGCTCTGCAGC
AGTGAGTATGTGCCTGCTCCAAAGCTTCCACTGGGCAAGGCTGCGTGCCAGCCCTTTCTTTCTTTCTTTT
TTTTTTTTTTTGAGACTGAGTCTTGCTCTGTTGCCCAGGCTGGAGTGCAGTGGCACAATCTCGGCGCAC

FIGURE 20 cont'd

```
TGGAACCTCCGCCTCCCAGGTTCAAGCAATTCTCCTGCTCAGCCTCCCAAGTAACTGGGATTACAGGCAC
CCACCACCACACCTGGCTAATTTTTGTGTTTTTAGTAGAGACAGGGTTTCCCCATGTTGGCCAAGCTGCT
CTCGAACCCCTGACCTCGAGTGATCTGCCCACCTCGGCCTCCCAAAGTGCCAGTATTACAGGCGTGAGCC
GCCTTGCCCAGCCAGATGCCAGCCCTTTCTGCACTGATCCTTCACTGAAACTCCGGGCTGGGACTGCCTC
TCCCCAGCTAGTTGTCTGGAGTGGCCGGAGCACCGGGAACAGGGTCATCTCCAAGGCCACAGATGGTACC
CATCAGCATCTCCTTCCTCCATGTCAAATGTCATTGCTAAGAGCTGAGGTTCAAGCCTCAGCTTGGACAC
TTCCTAACAATGGGGCCTGGCCAAGTTATTTGACCTCTAGGAGCCTCAGTTTCCTCACCAGTAAAATGGA
ATGGCTCACAGTACCCAACCAGCATGGCTGGTTGTGGGGAAAAAAATGAGCTAACCCATGTGACTCACT
TAGCACAGAGCCTACCACATAAAATGGTCACGATCTATCGTTCTTATGTTTACCCAACACAAAACCTCCA
AGAATCCTTCTATGACCACTGTCAGGTGTGACCTCTCCCTGCTCAGAAATTCCAGAGACCTTTATCAGAA
AGAGAAATAAAGAGACAGAGGCAGGTGGGTGCCATGGCTTATACCTGTAATCCCAGCACTTTGGGAGGCT
GAGGCAGGTGGATCACGTGAGGTCAGGAGTTCAAGACCAGCCTGGCCAACATGGTGAAACCCTGTCTCTA
CTAAAAATACAAAAATTAGCCAGGCGTGGTGGCAGGCGCCTGTAATCCCAGCTACTTGGGAGGCTGAGCA
GGAGAATCATTTCAACTCAGATGCAGAGGTTGCAGTAAGCTGAGATCACACCACTGCACTCCAGCCTGGG
TGACAGAGCAAGACTCTGTCAAAGAGACAGAGGCAGAGAGAGAACCAGGAAGAAATAAAGAGAAGCAGGA
GAAAATCAGGGAGGGAGAAAGCAAGAAGGCAAGCAGAAACAGAAAGAGGGGAAGAGAAGAAAGAAGGGGC
AGGAGGAGGAAGGCAGGGAAGGAGCAGCCACTGGAGCCCCCATGCCACACAGGCCTAGAGGGGCTTCCTC
AACCCTGCCCTGACTCGCCCTCCTGACTGCAGTCTGCCAGCCATGGTGTGTCAGACCCCACCAGCCACCC
TCTCCACTTCCTCTAGGATGGACACCCTCCTGGCAAACAAAGCCCAGCTCCTATCCACTGCTCCTTCCCC
ATCCTGATGGAATGACAGGAGGTGGATCGGGAGGACGGGAGGCTTCGAGTGGACCGGAAGGAGGCACTGT
AAACAAGGCGCAGAGAAGGAAATGGGCCAAACGAGGGAGAAGCAGGGAAACCAGGCTCCTGGGTCCAAA
GCCCAGCTCTACCTCTTCCCGTGTGCAGGATCTTGAGTAAGTCACTTCCCCTCTCTGGGCTTTAGCCTCC
TCATCTGTCAAATGATGACAATGACAGTTCCCATCTTGTGGCACTGTCGTGAGGTTCAAATGAGATTGTA
CATGTTGATGTGCAGGGCTGTGTCTAGCACATAGCGAGCCTGCAAATATGTTTGCTGTAACCAGTTGCCC
AGGGAGGCCCTTCCCACTGAATTTCTTCTTCCTTCATTTCTATGAAGCTTGTGGCCCCTGCAGCCCGGG
CCAGAGAGCCTCAAGGCCTGAGCACCTGGCCCCCAGCCCTTCCCAACATCAGCCCAGGGAAGCGTGGCA
GACCTGCTCTTTTGGCTGGAAGTCTACAATGACATCTGTTCTGCCTCCACACCAGCAAGGAGTTCCACGT
GGACCCCAGGACTCCACAGTGAGTGCTAGAAGAAGGGGAAAGGGGCGGGGAGAACTATTATTGCTCCAT
TTTTCACATTAGGAAACCAAGGCCCAGATGGGGAATATGACTGGTCCAAGGTTACGTAGTGGGTAGGATC
AGGGCTACAGCCAGATCTCCTGCCTCCCGCTGGGCTGTCCATCACACACAGGAATGGCAGCTCTGAGAC
AGTCAGAAGTGAGCCTGTCATTCCACATCTACAGAAATTCTTACACCAGTGGGCAAGGGCATTCTTTGTA
TTTTACTAGTTATGTGGTGAAAAATAAATTTAACTTAGCCAGGCGTGGTGGTACACACCTGTAGTCCCAG
CTACTGGGGAGGCTGAAGCACCAGAATTGCTTGAACCTGGGAGGCGGAGGCTGCAGTGAGCCAAGATCAT
ACCATTGCACTCCAGCCTGGGCGACAGAGTGAGACCCTGTCAGCTTTGTTGTATGTATAGACATTTTCAT
AATAAAATGTCAGGAGAAAAATCATTGAAACAATACAAAGTTAACCTGTCCAGATAAATCATGGTGAGAA
ACCTCCTCTTACGCTGGGACGGACCAGTGGCAGGCGGTACATCCAGTAGTTACAGCTCATTGAGCCCCAC
TGAGCTCCCTCCCCAACCAGCCAGCTCAGAGCCCGTCTGCAGGATTTTAAAGACCAACACACACTTTGCC
CCTTTTCCAGGCTGCAGACCTCATTCAGCTATTGTCACGGATTGAGCTGGAGCCCAGGCCCAGGGTGGGT
GTGTTGCCAGCTCCTCCTCCAGAAGCCCAGCCAGGGTCTCAGGGGAGATTCTGAGACAGGAGCTGGGCCA
GGTCAGGCCACATGGGCGTGTTCCCTTAGGCCAGGGTTTCCTGCCGTGGACTCCAAAAATCACTGCACCT
GCTACACAGGCATTGTGAGGATTTAATGAGATGATGTAAGTAAGGCACTTAGCTCAGGGCTCAGCTCAGG
TGACCATGGCCCTGTGCCTGCCATTACTATTCACTCCTGAATAAGACCCAAGCCTGCTGGGGGGACACCT
AGATAATGGTGGGCAGTGACTGTACACAGGTCCCTCCCACTACATCAGTGCAACCCTCCAGTAACCCTGC
ACTGTCACCCCCTTCTACAGGTGAGCAAACTGAGGCTCAGCAAGGTGAGCTCACTCGCCCAAGCTCACAT
CGCTCAGTAAATGGTAGAACCAGGATTGGAACCCCGTCCCTGACTCCAAGATCCTTGCTCAATGTCCTTT
CTCCAAAGTGTTTCAGAACAGAGCCCCTGATAGACAAGCAGTAACAATAACCACAACAGCTGACAAGTAT
ATGGCAGTACTAGGTGCCGGGTTCTTTTCTAAGCACTTTATACAAATTAACTCATTGAATCTTCACAACA
ACCTCTGGGCTAGTTGCAATTATTATCCCTATTTTACAAGTGTGAAAATCAAAGCACAGAGAGATTAAGA
AACTTGCCTCAGGCCACACAGCTTCCCAGTGGTGGAGCTGGAACTCCGGTTCCAAAACTCTATACTCTTA
CCTGCTATGTATGTTCAGGAGAAGGAGGATGTTATCCCACCTCCAAAAAGCCCAGGGAGGGTAAGTGACC
TGGCCAAGGTCACACAGCAAGTTGCTGCAGTGCTAGAACAGAACCCCAGACCCTTGACTCCAAGATAGC
CTTGCCCCCGTTCTTCCAAGCTGGGAGCTGAGGAAAGCCATCTTTAGTCAATGCCTGCACCTTTTCTGCT
GTAATTTCACCCAGGCTTCCAGTCAGTCCAGAGGGAGCATACAACTGACCATCAACACCCCTGATCCTCC
CACGGTCCGCCTTGACGGCCACACGGCCACCATCATCCAGCCGGGCTTGCTAGTGCTACTGGGGCTCAGC
ATCACCTCCTCTGTCTCAGTTTCCTGGGTGAGTGTATTAGTCTATTTTCATGCTGCTGATAAAGACATAC
CCAAGACTGGGTAATGAAAAGGGGTTTAAGGGACTCACAGTTCCACGTGGCTGAGGAGGCCTCACAATC
ATGGCAGAAGGTGAAAGTCATGTCTTACATGGCAGCAGACAAGAGAGAATGAGAACCAAGCAAAAGGGGT
TTCCCCTGATAAAACCATCAGATCTCGTGAGACTTATTCACTACCATGAGAAAGTATGGGGAAATTGC
CCCCAGGATTCAATAATCTCCCACCGGGTCCCTCCCACAACAGGTGGGAATTATGGGAGTTACAATTCAT
GATGAGACTTGGGTGGAGACACAGCCAATCATATCAGTTAGTGAGACGCAAAGGTCTTTGTTCCCTAGGG
GGCCTGGGTCCACTGTGAGAACCCCTCCAGGGCCAGCGAGCTGTGCCTGCTGCTAAAGTGTTAAAATACT
```

FIGURE 20 cont'd

```
TTAACACCTGCACCCCTTTGTTCACCTCTGGTGCTCCACAAGGACCTCAGCAACTAAAGGATTCTGCCTC
CAAGACCCTCAGCTCGGAGCCCTTGCCAGGTGGTGGTTAAGCCCTTTGACTGCCTCCCTTGGGCGTGATG
GCATCAAAAGCCATCACAGGAGGAAGTCCAGAGGCCTGGAGCTCATGGAGCGCTGCGGTGTTTCTCCACT
CCCCCAGAGAGAGGGTTACCCAGGCTAGAGAGGGCGGGGCCCTGGGAGGGAAATCTGGGGAAATACAGCCT
CCCAAAAGTTTCAGCTTCTCTATTCTGAGCCCCCTTGGGATTCCTCTATTTCCCGTTCCACGGACTTTGAAG
TTGAGAAGGTGCCTCAAATAAGCGGTCAGGAGGGTCCCCACCATGGGTGAGCCACATGGCATCCATGGGG
AAACAGTATCCTGGGGTCTTAGTTGACATGATTCTGCGGCAAAAAAACAAACAAACAAACTGGTCATCTC
TGGCTTGTGGGAATCACTTCTCGGCCTTTCTTGGTGAAGATCATGTATCTGGCTGGTGGGTAACATCCT
ATTTCTGGCTTATAAGGTGATCGTGTGAGTTACGGAGGCCCATAGACAACCCCCTCAACACCAAGGGGTC
CTCTGGCTTCAAGGCAACAGTAATTCTAGAGCCAAGTGACTCTCATTACAAAAGGCTGTCCCTCCACTGG
GCTGAGTCCCTCCAGCTGTGTCCAGCCCTGGCCCCACTGCCATCCAAGAGCACCCAGCACCCACCTGTGC
CCCCACCCCGGCAAGGCCCACACATGCCTGGTCTGGATCAACATGAACCAGTAGCTGGAGAAGACAATG
ACACAGGGTGGGGTGAGGGCCAGATGAGAAGGGACCAAGCCCGAACAAGCATTCCTGGGGGCTGGGGT
CAAGGGGTCCCTCCGGCTAGAACACAAATTCTTCTCCTGTTCTGACCTAATTTCAATTCTTCATAGAAA
CTTTTTTTGAAGGCTGCATTTTCCCTAAGAAATCAGGAACTACATGACCGGGCATGGTGGCTCATGCCTG
TAATCCCAGTACTTTGGGAGGCCAAGGCAGGCAGATCACAAGGTCAGGAGATAGAGACCATCCTGGCTAG
CACGGTGAAACCCCATCTCTACTAAAAATACAAAAATTAGCCAGGCATGGTAGTACACACCTGTAATCC
CAGCTACTCAGGAGGCTGAGACAGGAGAATTGCTTGAACCTGGGAGGCGGAGGTTGCAGTGAGCCGAGAC
CATGCCCCTGCCGTCCAGCATGGGTGACAGAGACTCTGTCTCAAAAAAAAAAAAAAAAGTGGAGTCCCCA
GGACTGCTGATCCCTGTGAGCATCTGAACACTGGTGTCCATCCTTCCTCAGGCCAGAATCTGCTGACC
CAGCTGAAATGTCCTTCCTGTTCCTCTGTCATCTGTTGCAGGAAGGACATTCAGGGGCCCTTCTCTTACA
GCTTTTGAAGAGGGTGTTTCTGCCCATCACAACAGTGATCCCCACTTTCTCTGTCACACCCACATACCAT
ACTCAGAGCAGCATTAAACATCTCCAAGACAGCTGACTTCTGCCTGGGGTTGGCTAAAAACTGCCCACAG
GTGGCCAGGCGTGGTGGCTCACACCTGTAATCCTCCCACTTTAGGAGGCCAACACGGGAGGATCACTTGA
GCTCAGGAGTTCAAGACCGGCCTGGGCAACATGGCAAGACCCTGTCTCTACAAAAATATTTTTTTAATTA
AAGAATTGCCCACAGGTAAGGCAGAGGAGGCAGGGTAGAGATGCTGAAATCCGGGGAGTGTCATATGAGG
GGGCTGCGGAAGGGACCATGGGTGCCCTCCTATTCTTCACCCGGACAGCAAGCAATGATGGAAGGTTAGA
ACTGGGACAAGTGCGCAGGGAGGGCTTCTCGAGGTGGGTGGAGGTTGGCATGATGGAAATCGGAATGGAA
AAGGCCCTCAGAGGTGATGGCACCCAGAGCTCACATCTCCAACACCTGCAGGGGCAGGCGGGTAACACCC
AGGTGAAGAGGCCCAGGTGGGGCCTTTGGTGAACACGACCCCGCCCAGTGGGCGGCTCCACTCTGCTCAG
TCGAATGTTCTCAGCACAGCAGAACCGCAGATTATCTTTAAGAGACACCAGAAAGCTGAACTTTCTGAGA
TTTCACCCCCATCTTTAGATATCCGCAACAAACCTAAACTCTTCCAAACACCATTGCCTTGGTTTGGGCT
CCCTCAGAAGCAGACTCTGAGCTGGGAAGTGAAGGTGGCTTCGGGGGAGGTGATGCCAGGAAGATGGAG
GGAGGAGGACTGAGTGCTACGAGTGTGTGCAGAGCTTCTCTGCTCCGTAGATCTCGGGGCTTCCGACACG
GTTTGTGTAACAATCCCCCATCCACCCATGTGATGATTTGGTGAGTGCCTGTGTCCCCAGCCAGACAGTG
AGCTGCCCCAGGGCAGGGACCCCTCGGTTTCTTGTTGCATCTCCAGCACCCTGTCCAGTACCTCGCATGC
AGGAGGCACTCAAGAAATACATGCAGGAGAAACAGCTCAGACCTCACTCATCCGAGAAGTCACCTGAGAT
CCCTCCCCACCAGGCCCAGAGAGATTAAGTGATTTATTCAAGGTCACACAGCAAGTCTGCAGAGCTGAGC
CCAGAACACTGGCTTCCCCAACAGAGCTTCTCCCTGAGCTCCGACTCATGTTGGGACTTAGAGTGACACT
AGAGGGGCCGGCAGGTAATGACAATTAGGCCAGCAAGGGGGTATCGGACCCTCCCCTGAGCTCTAAGTGA
TGATGTGGGCATGGGTTGGGGCAAAGGCTGGTCAGCGCAGGAGAGGGAGCAGGAGGGGCCCAGGCCAGGC
CCCCAAGGTCAAATCTGGGAGACTCAGTTTGCCAAAAATCAATTCCCAGCCAAATGGCTAACTCACTGAA
ACTCAAATTGCAAAATGACCAATTCTCCAAGTTTACCAAATTTACCCATTTCCCAAAATCTTGCTTTAAG
GATAATGTTTCATGTATTTTATAAGCATTTGTGAATATTTCCTTCTTTGATATATTCAATGGATATTTC
TTATTAATATGACCAAATTTCTAGTGTTTTAAGGTTAATTTTTTAGTTTATTCCGACTTGTTTCTAATCC
TTTTTTTAAGGACATTTTCTGTTTCTACCAACATTTTAGCATTTTCGGGGGGGAGCATATAGTGTTTGG
GGCTATTCCCCTCAATTAAAAAATAGCAAAATTCACTAACAGGTTTATAAGAATCCTTCAACAAAGTGAA
CATTCCTTAAAATGTTGCTGAGAAGAATGTGTTCAGTCACTGAATAGGTTCAAGGATTTCCCTTAATAAG
GTTCTTAGTAAATGGGTGGAGCAGCCCTTTAGAGACCAGCTTTCCCAGCTGGAGCTGCTTGCTGTTCAGG
GGCTGCCTGATGGGGATGGAGATAGTCCACCCTGAGCAGGGTGGGGAACACACCCTGTCCCTTCCCC
ATTCTGAGCAGTGGAGCAGCCAGGGACCACCTCTGCCCACCAGGGCACTGAGGTCCCTGCCCGCCCTC
TGGCAGAGCTGCTCAGAGAACACAGCCTCCCTGTGCCCAACATCAGGGTCCTTCACCAGGCCCAAAGG
GACCTCTCAGAGGTAAGCCTGGGGAAAAAGAGCTGCCTGAGACGCACATGGGTGGTCGTGGCTATAAGTG
ACTTTGAGCCCTAGAGGTGCCTCGTCTCATCCTCAGAAGAAGAAGCTGAGGAGGCGCTTGTGTCCCGGC
CCTCAGCCTTCTTACCTCGCCTCCTCTCAAAGCCATCCTGCATGTGACTCCCCACTTACAGATGAGGAAA
CTGAGGCTCCCAGGGCTGCACGAGTCCGCAGGGACCCAGACCACAGGGCTCTTGGAGAGCATCAATGC
CCCTACACAAATGACCTTCACAATGAGCTCCATGAAGTTGATGCTGTAATTCCCTCCCACTTAACAACGG
AGGGAACTGAGGCTCAGAGAGTCAGAGAAACGTGCCCAGGGCAGCAGAACCGGATCCAACAGGGGTTCA
TCTGACTTCAAAGTCTGTACCCTTAGCCCCAACCACCCACCTCCCGAGAACTCCAGACCCCAGAACAGGG
CTGTTGCCTCTGATGCCTGCTGTCTGTGAACCGCAGAGGGTGGAAACCAGGGCCTGCCCAAGGGCACCCA
AATACCAGGGAGGCAAAATGCAGCAGAGACCAGAGGGTAGAGGAAACCAGCGAAGGAACCACAGAGGAAC
```

FIGURE 20 cont'd

```
CCCCAGGAGAGTTTGCCAGCTCTGAATCTGCCCCTGGAGCTGCCCTGCCTGCCCAGCCCTCCTTCCTTCC
CACTGTGGGCTGAACCTGAGAAGAGGTGGACAGGGGTCAGGGGAATGGGCGGGTCTTAGAGATGCCCTTC
ATTTCTTTAACTCCCACCTTTAAAAGATTCCCATCTGTAAACAGCAGAGCAGGAGGGACCAAGGCAGAGA
CAATCATACGGAACCTCCTGGCTGCATGACCATGGGCAAGCTGCTGACCCTCTCTGAGCCTATCGTTCAT
ATCTGGAAAATGGGGATAAAGAAAATTCTGGCCAGGCATGGTGGCTCATGCCTGTAATCCCAGCAGTTTG
GGAGGCAGAGGCAGGTGGATCACGAGGTCAGGAGTTTGAGACCAGCCTGGCCAAGAGACCAGCCTGGCCA
ATATGGTGAAACCCCATCTCTACTAAAAATACAAAAAATGAGCCGGGCATGGTGGTGTGCACCTGTAGTC
CCAGCTACTCGGGAGGCTGAGGCAGGAGAATTGCTTGAACCCAGGAGGTGGAGGTTGCAGCGAGCTAATA
TCACGCCACTGCACTCCAGCCTGGGCAACAGAGCGAGACTCTGTCTCAAAATAATAATAATAATAATAAT
TCTCCCTAGGAGCTGGAAGTCAGGGCTCTCCTTACAAACATGAGGAAGTGTTAGGACCACTGTCTTCAGC
CAGCCCTGCTCAGGCACTTAACAGAACTCAACCCTAATCCCACACAGAGAGACCCTGCGCTGCACAAAAG
GAGGCAGCAGGGGCCGGCAGCAGTGTGCCTCATCAAACCCTGCTTCCAGCCCCACCCTGCAGACCCCTTT
CCTAGATTCAGCCCCTGGTGTCCCTAGTAGGGAGGGGAGGCCCAGACGCACTCCAGTGAGGACCACAGGG
GCCACTACAGGGCCTGCAAGGCCTGGGCTGCTCCAAAAATGATGCTGCAAATCCTGGCCAGGTGGACCCG
TCTGCTCAGAGTGCACCCAGCGTGGGCAGGGCCCACCTGTGCTCTGAATATCAGAGAGGAGCAGAGTCAG
GACCCAGCCTGAGCCTTGAACCAGCCCCAGCAGCTGTCTCCTAACTGGCCTGTGAGAAGCAAAGGAAAAG
AAGGCAAATGAGCTCATTGGCTTACTCGCCGAGTTACCTCCCGGCTTCCTTATGCTCTTGTGCAGGCCAC
ACATGACACAACTGCAGGGTGCACCACTTGTACAGTAGTTTACATGAACAATGCCACCTGGAGTTGGGCA
GTGCACAACCTACACAATCTTACATGGCTGCCCTGATGACCCACTCATTCATTCACCATCACTCAGTCAG
TCAGTAACCTCACTGACTGCTCTGTGCCTGGCCCGGTGCTGGGCAATGCTGAGACAAAAAGATGAGTTAG
ACTCAGCCCCGGAACCCTCCAGGAGCTCCCATTCTGGTGGAAAACAATAGGTGCAGGAGCAGACAGATCC
CAGCAGCATGGTCGGGTCTGGCAGAGGTTTGGGCATTGTGGGTGGCAATGCGTGAGAGGCTCTAGCTGGT
GAGGGGCCCACTTCAGGGCGACCCAGGCAGGACAAACCCCGACACAGAAATGTTAGAGGGCCCTTGACAC
ATAGGCTCTCAGGAAGAGTCCCAGAGTCTGATCTGTTCCTTCCCTCACAAGCTTTCCTGAGATTCCCCCT
CCCCCTCCTTTCTCTCCCCTTGTCCAGGGGTCCCTAACTCTGCCCTCTTCATCCAGGGGAAAGTGTATCC
TTAGGACACACACGGCCCCTCTAAGGTGTAGTGGGAGCAGCCTCAGGCAGAGCTGGTATTTGGGCATCA
AGGACAAGGATGGTGGGGAACGTGCTCTGCTTCTACCCACAGGATTACCTGCTGCTGGCCATTCTGGGCA
AGTAGTGGCTTCTGACCAAGAGCCAGTCCACCCCCGCCATGAGTTTTCCAGCCCCTGATGGCCTGCAAA
GGGCCACAGTGTTCCAAAACCTCAGCTGCAATACAGAGGGTTCTTGCCTGAGCAAGAGTCAGTTCTGAGT
ATGCTAAGGGGTTCTGTGAGGAGGGGAGACTGTCTTGAAATATTTAAATGCGGGCTTTTTCCCCCTGATA
TTTCTTGGCTTCCCGTGGCCCCTGAGAAAGGAATTCTGAATTCTATATTCAGTGTCTCCAGGAAGGGAGA
GTTCCTCAGAAAATGGTGAAGAGGTGTTTGAGTTTCAAAAGTCCCAGCCCTGACAGGATAGGGTGTGGAG
GGGACACAAGGAACCATGCACACCGGAAAGCCTCGCTGATGGAGAGGGAGGAAGGAAGCAGGAAAGATGA
GGGGCTTGGGGGTCTCTAAGAAAGCGGGAACCACAGAAGCCCAGAGACGCTTGGGAGACCCTGAGTGCGG
AGGAAAGGAGCTGAGGGAGGCGGCAAGACCCCAGGCTGGGAGCTGGGTCCAAGTGGGTGGTCATGAGAC
AACCACACCCCAGAGTCCCCAGGCCCACAAGGCATGGCGCACGCTCAAGAACAGTGCCATCGTGGACGCG
GGCCCAGGACACACACATGCCCCGCCCCAGCTCCCCTCGCCCACGTGGCCCTGGCAGGGCAGGGCAGTGA
ACAGAAAAGATCCCGCCCCAGAGTCAAAACGTGCACGGTAGGTGTTCGCCGGGGCAGAGAGAAGGCAAA
GCACAGAGCGCCCCACCCACAGGCACCTGTCGCTGTCCACAGCAGGTAGGCCTGGCCCCAGGAAAAGGCA
GATGAGGAGAAACTTCACACTGATTATGATAAAATCCCTGGGAGCAGCAGGATGGAGGCTCGTGGCAGCC
TCTGTCTTGGGAGTGAGCAAGCATTCAGCTCCCTGGTAGCCCTGGCTGGCCTCAGAAAACCAGAGTTTCC
CGGGGGCCCTTCACCACCACACAGCCCAAACCATGGAGGCTTTCATGGGTCTGGGGCAGGATCGCTGTCC
CGCAGCAGAAGGTTGGGGTTCAGAGCGAGCCTCGCTGTGGGTTCTTTACGTGGCTCCCTGATCTGTTTCA
TTTATGAACCACAAGCCCAACCTTGAAGGGAAAAAGACCCCAGTGGGCAGCCCAGAGGTCTTGACCTA
GAGGGCAGGACCACCCTGCACATGAACTTGCAAAGTCTCCCAGCCCTTGGTGTGCATATATGACACGACT
AAGATTGGGTGGAGGCTGGAAGACAAGCTGAACCCTCACCCCAAGCCCAGAGATTTCCCACCCATGTGTC
AGCTCGGTGCCCAGCACATGGTAGATACTTGGTACAAAATGCTTGAATGGAGAATTCCTTGGGACCTTGA
AGAAGCCGGGCAGGCCTTGGCCTCCTCAGCCAGGATGGCCTGTCCAGGCACCGGCAAGCCTTTCCCACCC
ACCACGAAAGCCCCTCGATCCCCTCCCAAGATTTCCACAGATGCATCTTCCACGGTGCATCTCACTTTGC
AGTTTGCAGGCTCATGCACCCATCTTCCCATCAGATCTTCAGATAACACTGGCTGGTGCCAGACAGGGAG
TGTGATTATTCCTATTTGTAAGGTGGTGAGGACCACAGATAGGAGGGTGGGTAGATGGAGGATGG
GTAGATGGATGGTGGATGGATGGATGGACGAATGAATGTAAGGATAGATAGGTGGATGGTGGATGATGA
ATGGATGGAGGATGGGTAGATGGATGATGGATGGATGGATGGATGGATGGATGGATGGATGGATGGGAA
TGTAGGAAGATGGATGACGGATGGATAGATGGATGGATAGGAGGGTGGGTAGATGGATGGTGGATGGATG
AATGGATGGGAGGATGGTTAGATGGACTGTGGATGGATGAATGGATGGGAGGATTGGGTAGATGGATGGT
GGATGGATGGATAGGAAGGTACGAAGATGGATGGTGGATGGATAGATGGATGGATGGATAGGAGGGTGGG
CAGATGGATGGTGGATGAACGAATTCATCATCACTAATCTAGCCCCACTCCCAGCTGAGACACACAGTCG
CTGGAACCAAGAAGAGAGGCAGGGTCAAGGATTTCAGATTCCCCATGTTCATACAAATATTTTTCAGAA
TAAATAACTCTTACCTATTTATTAGAGCAAAGAGCTCTTCTAAGTGATACCTTAAAACAAACAAAACCTA
GTTTGAAATGTTACATGGAATCAAACTGCTTTTTTATCCAAAGTAAATTCATAATTCAGACATTTCACTA
ATTGACATCTTCCTCCACAAGATATCCAAGTGCTTGAGGTCAACAAGAGCAAGCCAAATCTCAGATGGAT
```

FIGURE 20 cont'd

```
CAAGAATCTCGAACATATTCACATTATTTGAAATGCATATGATTAATTCCCACTTCTGGGAATTTCCTAA
AGAAATAATCAGAGATGGCTGGGCGCGGTGGCTCATGCCTGTAATCCCAGCACTTTGGGAGGCCAAAGTG
GGCAGATCACCTGAGGTCAGGAGTTCGAGACCAGCCTAACATGGTGAAACCCCATCTCTACTAAAAATAC
AAAAAAAATTAGCCTGGTGTAGTGGTGGGCGCCTGTAATCCCAGCTACTTGGGAGGCTGAGGCAGAAGAA
TTGCTTGAACCCAGGAGGCAGAGGTTGCAGTGAGCCGAGATCATGCCATTGCACTCCAGCCTGGGCAACA
GAGCAAGACTCTGTCTCAAAAGAAAAAAAAAAAGAAAAAGAAAAAAAAATAATCAGAGATGCAGACAAA
GATGGTTACCATAGCACTGGTTTTATGGTGAAAATTTGAGAACAATCTAAATGTCCAACAATACAAGATT
TATTTTTATGATAAATTCCTAATAAAAAATTTGTACAGGCATTAAAATAATGTTTTAAAAGAGCATTCAT
AAGAAAATACAAGAAGACTAGGATACAAACCTATTTAGAGATGATCTGAAAATTAAATGTACATATATAA
AATAAATGAGCTGGGCACAGTGGCTCACACCTGTAATCCCAACACTATGGGAGGCCAAGGCAAGCAGATT
GGTTGAGCTCATGAGTTCGAGACCAGCTTGGGCAGCATGATGAAACCTCATCACTACAAAAAATACCAAA
AAAATTAGCCAGGCATGGCGGTTCATGCCTGTAGTCCCAGCTACTCGAGTGGCTGCGATGGAAGGGTGGC
TTGAGCCTAGGAGGCAGAGGTTGCAGTGAGCTGGGATGGCACCACTGCACTCCAGCCCAGGCAATAGAGC
CAGGCCTTGTCTCAATAAATAAATAAACTCAAAATGTAGGCTGTGATTGTCAGACAGCTTGAGTGGTAGG
ATCGCAGGTTACTTTTATTTTATTCTTAATACTGTTTCCAAAACTTTTATGGTGAACATGGTTGACTTTT
ATGATTGGGGAAAATGTTCTCATTCATTCAATAATTGTAGGGATAGGTATCGACACTTTGTGCCACATG
AGCAAAACACAGCAAGAATGGTTTCTGCCCTCACAAAACTTGTGATGGAGACGTTAAATAACCCAGCCAA
TAAAAAGACAAAGGACTACAAATTCCAATGAGAGCCAAGAAGGAAAACTACAGGGTGCCAGGAGAGAGAA
GAATGGCAGCGTGGCCAGGCACAGTGGCTCATGCCTGTAATCCCAGAACTCTGGGAGGTTGAGGAAGGCA
ATCACTTGAGGCCAGGAGTTCAAGACCAGCCTGGCCAACATGATGAAACCCCATCTCTACTAAAAATACA
AAAATTAGCCAGGCGTGGTGGCACTTGCCTGTGGTCCCAGCTACTAGGGAGGCTGAGGCAGGAGAATCGC
TTGAACACAAAGGCGGAGGCTGCAGTGAGCCAAGATCGTGCCACTGCGCTCCAGGCTGGGTGACAGAGTG
AGGCTCTGTTTCAAAATAAAAACAATGGCTAGGGTAGCCTACTTTAGAAGAGGTGACCGGGGAAGGCCTC
TTGAAGGAGAAGCTGTTCGAGCTGAGACCTGCAGTGTGAGTGAGCCAGGTAAAATGTGGAGGAAAGGGTT
CTGGGCAGTGGGAACAGAATGTGCAAAGGTCCTGGGGTGGAAATAAGGTGGGTCTATCTGAGAAACTAAC
AGAAAGCCAGTGCAGACAGTGAAATAAGCAAGAAATGGTAGGAAATGAGGTTGGAGAGGCAGGCAGAGGT
CCAACTGCACAGGGCCTCAAGGGCTAGGCCAAAAATATGGGCACCATTCTGTGCGGAATGGTGATTCACT
ATTTTAAGCAGGAGAGTGATGTGATCTGAATATGTCAGACTTTTTTTTTTTCTTAAGAGAAGGGGTCTCA
CTATGTTGCCCAGGCTGGTCTGGAGCTCCTGGGCTCAAGCAATCCTCCTGCCTCAGTTTCCTAATGTCAT
GCACTTTTAGAAGAAAAGAGATTGAGCCAGAGCTACAAAGCTACAGACTCCCAGAGCTTTGGGGAAATC
CAGTGCTGTTTTATTGTGAGACATCAGGGATCAACCCTGAGATGTTCAAACCAACTACCCTGAGGGAGCT
CATATCTCTGCCCAGTGTTGTTCTGAAGAGCGGTGGAGACAGGAGAAAGGAAGGCTGAAGGTGGAGGGAA
CTCCCTGCCTCACATCAGCTATCACTTTAGGCACTCAGAGCCACTGTCTTCTCTGATTCCCATAAGCCCC
ATCAAAGAGAAGCAGACAGGGACTTGTTAGCCTATTTGACAGACAGAGAAACTGAGGCTCAGAGGAGCTG
GCCCCATTCATTCGTGCATTCCTTCATTCATGCATTTACTGCACGCTAGGTGGAGACAGGGATGTGCAAG
ACGAGTGAGACACGCCCCAGCCCTCAGGCATCTCATGGACTATCGGATCAAGAAGACAAGGGGCATATCC
TGGGAAAAGGCTTTGCTCCAGACATGTCTGCCTTTGAATCTCAGTCCTGCCACTTCTGCAGAGAAGTAAC
TTCTCTGAACCGCAGTTTCTTCACGTCTAAATGGGGAAAGTGGTGATGCTGCTGAGGAGGAGGACGGGGG
AGGAAGAGGAGGAGGAGCGAGGAGGAAGATAGGTTGTTGTAAGAGTGGAAAGCATTTGCTGAGTGCTCAG
TAGTGGGATTTTGGAGGTTGTGGGCAACTCCTTCTGACCCAAGTTTTAGTGTGATTTCCATGACACACCC
TGTCTCTCCATCCTGGGCAGCGTTAGTTCTCCCTTATGTGAAACCCAAGCTGGCTGAGCCCACAGGCAAA
TGCAGCCATAGTGACACTGGAGCTATTCAGAGCCAACCTGTTGCCCTTCTATAAAAGATGCCCACTGGC
ATCCTGAACACACGAAACAATGTGTACCCAGTGGGTGCAAGAGGCAGGGGGTGCTCAGAGGAGAAGCAG
CAGAACCAGAGTGCCCATAAGCCACACGTCCTCTGGGAAGGAAGGGAAAGCCCTCTTGGGACAGACACAC
TCAATTTTGACTTACAAAGCAGAAACCACAGGCCTAACCCTGAGTATTGACATCTGTGAGCAAGTGGATT
GAAAAGAAACAGCCAAAACTGAAACATCTGCAAACACGTCTTAAATACAGTACTTCGCTTTGAAACCTCT
TACACATTTGTGACAAGGTTTGTTCACATATCTACTTTGGGAGCATGTGCCCAGAAAACTTTATACCCCC
ATTGAAAATGAAACTTCAGGCCAGGCACGACGGCTCATGCCTGTAATCCCGGCACTTTGGAAGGCCGAGG
AGGGTGGATCACCTGAGGTCAGGAATTCGAGACCAGCCTGGGAAATATAGTGAAACCTTGTCTCTACAAA
AAATACAAAAATTAGCCGGGCTTGGTGGCCTATAGTCCCAGCTACTTGGGGGGATGAGGTGGAGGATCA
CGTGAGCCCAGGAGGCAGAGGTTGCAGTGAGCCAAGATCATGCCACTGCACTTCAGCCTGGGTGACAGAG
TGAGACCCTGTCTCAAAAAGAAGAAACTTCAGAGTGAGGTTAAATGTCTCTATACCGGCTTTCTGTCT
AGTAAAATCATTCTAAATGATCCATTTTGGGAGGAGATAAAGAAACATAACCCCCAAAATCCATATTT
TACTGTTTCAAACAAGGTGTAAATAGTTGTGAAAATCTAGATTCTGTAGATAGGAGAATGGCATAAAATC
AAAGACCTGAGCGTGGCTGATGCAATAGTAGATAATGATGATGATAGTAGATTATGGAGACTCACATATC
CTAGGCAGGGTGACATATTTCATCTTGTTTAATCCTCACAGCAACCCTATGATAGGCATGATTTCATCCC
CACTTTATAGATGAGGAAACTAAGGAACAAAAATATTAGATAATATCCCAAGGCCACACAGCCAGGAGGC
AGCAGAACCAAGATTCATATCAAGGCCTGTCTGGCCCCAAACTCTGTGACCAGAAACTCTGCCTTTTCCT
AAACCATTGGTTCTTCACCGTTTATACATCACAAGGCCCATCAAGAATCTCATTAAAGCAACGTGGGGAT
ATCATTGAGCCCAGGAGTTTGAAACCAGCCTGGGCAACATAGTGAGATCCCATCTCTACCAAAAACATAG
GAAAAGCTAGCTGGGCATGATAACATGAACCTATAGTCTCAGTTAAGGTGGGAGGATGGCTTGAGCCCA
```

FIGURE 20 cont'd

```
AAAGGTCAAGGCTGCAGTGAGCTGTGATGGCACCACTACATTCCAGCCTGGGCAACAAAGTGAGACCCTG
TCTCAAAAAAAAAAAAAAGAATCTCATTAAACGTATCTCTGAGAAGTGAACATTAACACCAAATTTTAT
ATGCAACTTCAGAGGGTCCAGGGACACAAACTGCCTGCAGTAGCCCCCCGTGACCTCGTGTGACTGGCAG
AGATCTGACACTGATTACGCCAGAGGACTGAGCCAAGGAAGGCAGGCCATGGCCTCCGAGTTCCAGGGGC
CTAGACAGACACAGACAAGCACATAAAAAGATAAAAGCATAAACATGTATGCAGACATGTGTGCGTCACT
AAAGAATCCTTAAGTTTCTGTCCCTGGGACATCCTCGGCTCAACCTGGCCTATTGTGATCTCCTCACACA
GAGGCTATTAAGAGTTGGCAGACTGCATTATCACTGGTCATTGTGATCTCAGCCAAGACTTGGCCAGCCT
TGAAAAGGACTTCCCTTCAAAGAGTCTGCAGGTCAAATCGCTTAGGGCTCAGGGACAAACTGGCCGTTGT
TCCCAGCTGATAAGCCACCCTATGTCACGTAATCCACCATGGGGACCCTGGATTAGCAGAAGTCAATGGC
TGCCCCACCTCCTAAAGTTGAAGAGGAGAGAGACAAAGAAGCAGGAAGCCCCGAGGCCCATCAGAGGCTG
CCTCCCGGATGTGCCCCTTCCCCTTCATGACCTCTGCGGTTGGGTTCATTGTTTGGGTTCAGAGAATCAT
TCGAGGCACCAAACTCAAGGGCCACACCCACCAATGGGTGGCACAAATTTCATCTCAAAGATGATTCAAT
TTCCCTCAAATGTCCAAGAAAAATAAGACCCAGGACAGTTGAGTTTCGTCTCCTACTTATCATCATGAAT
AAAACTCTAAGTTCTGCCCTCTGACATTTGATGCAAAGGTCTACGTATCTAATACAAAGGTCTATGCACT
GTCTGTTCAGCAATGTCCAAAGTGGGCCTTTGACAAATGAAACCGTAGTTGAGGTTCATGGCATGAGAA
CCTCAGTGGAGCTGGAGAGGTCCTGCAGCCTAGGGAAGGCCAGGCAGCAGACATGCTGAGCCTGCTTGAA
GGCAGGACCCCAGTCCAATGCCTAGCCTGCAGGTCCCTGAAGCGGGCATTCACCACCCCTGAGGCAAAA
TCAGCTTCCTCACCTGGACTCTTGCTTTGTAAGGCTGTGGTTACACCAAACAGCATGATAGGACGCACAA
AACAAATCACAAATCTTCAAGTGATAGGAACCTAGATGATGACTGGGCCTTCTCCTGCTGTACAGGGAA
AGCCTCAGGCCCAAAGAATAGGTTCTAGAATTTGGGGAGCCATTCAATGAGATAACAGGTAAGAAGGAGC
CCTGTCCAAAGACTAGATTTTTTTTTTTTTTTTGAGACAGGGTCTTGCCCTCTTACCCAGGCTGGAGTG
CAGTGGTGTGATTAAGGTTCACTGCAGCCTCGACCTCCTGGGCTCAAATGATCCTCCAAACTCAGCCTCC
CGAGTAGCTGGGACCACAGGCACATGCCACCACGCCTAGATAATTTTTGTATTTTTGTGGAGACAGGGTT
TCGCCATGCTGCCCAGGCTGGTCTTGTACTCGTGAGCTCAAGCAATCTACCTGCCTTGGCCTCCCAAAGT
GTTGGGGTTACAGGCATGAGCCATTGCTCCAGCTGAATTTCTTAAATATAAATGAGAACCTCAGCAGCC
TAGTGACACCATTCAAGTCTCATTCCAGGGGCAACCAGGGGAAGCAAAGTGGGCTGAGCCAGTTATGTAA
CTCCCAAGCTTAAACCCCTCCACCTTCCAATCACCCTGAAAACAAAAATCCAAAGTCTACCACAGTGTAT
CCCTCAGGATGCATCTGGTCACAGGCAACAGAAAACAGGCCCTTATTGATGATTTCACCTGGAAGGTGTT
CAGAGCAGGGCAGCTCCTTGCCTGGTAACATCTGCGGATCAACATCTTCCTTCCCATTTCTCTACTGTCT
CCTTCATCTTCAGCCAAGCTCTCACCCCTAGAGCTACTCAAGCTCATGCCCATTCAGGTTTTTTATACTT
TCCAACCACCCTGCATCCATTACTCACTCCCCAGGTCTTTGCATGGTTCGATCCATCATCATGTCACCCA
CGTCTGGGATAAAATGTCACTCAGCACAGAGGTGTGGGTCCAAAGGAATCTCACCCCCTCTTCTCCATCA
TCTTTGTTTCTCTTTCTTCACACATGTATCATTATCAAGAATTGTCAGGCTGAGTGCTGTGGCTCCACATC
TGTAATCCCAGCACTTTGGGAGTCCAAGGCAGGTGGATTCCTTGAGTCCAGGAATTTGAGACCAGCCTGG
GCAACATGGCGAAACCCTGTCTCCACTAAAAATAGAAAAATTAGCTGGGCGTGGTACCACGCGCCTTTAG
TCCCAGCTACTTGGGAGGTGAGAGGATTGCTTGAACCCAGGAGGCAAAAGTTGCAGTGAGCCAAGATCAT
ACCACTGCACTCCAGCCTGGGAGACAGAGCGAGACTCTGTCTCAAAAAAAAAAAAAAAATAGAATTGTC
CTGTTATCAGTGTCCCCCACTAAGGGGTGAACTGCATGAGGGAGGACACAGTATGGCATGTCCCCTGCCT
GATCCCTACCACCCACCACAGTACCTGGCAGGGAGAAAGTGCAGGGCTCTTTGCTGAAAGAATGCATGT
GTTGCACACATGCTGGAACCCTGACAACTTCCCACTTCATTTCCAGAAAGGAAAAGTCGGTACTGGAAGG
TCATTTTATGTCCAGTAGGACAATCCAAGCCCAAATCCTAGACCAGCTCCAGACTTCTGGGTGTCTTGGG
GCATGTGACCCCTGCTCTGGAACTCTGTCCTCACCTACAAAATGAGGGTGCAGAATGGACTAGACTAGTG
GTTCTCCAATCTGGGCCGCCTGCAGAGAGGCCTTCTAAAACAAATTCCTGCACCTCCACCCTTACTTATT
AAAGCAGGATCCAGAAGTTGGGGAAGAGAGGAACCAAGAATTAAAACCTGTAACATACGCACCAAGGTGA
TAATGATGTCTATTGGGACCTTCAGGTTCTTCTGAACTCAGAGGTACTGGAATAAAGGGCAGGCCCAGGC
CCATGGCTGCCACATGGACTCTCCAGAGAACCTTCCAGATGCTCTGCCCAAGCCCAGCTCGTGCAGCTCC
CGGAACCAGCTTCCTTTCCCTCCGAGCCTGATCCATGCTCATTCACTCATCCCTGGGATGAGCTAGGAGT
GTCAGTCTCTCCCAGCTGACCATCAGCAGCCTTAGGGCTGGAACCCTGTCTGTGATATGCAATGTTCTAC
TGCTGTCCAGAAACACTGCCTGGCACAATATGTGTCTGTGGAATGAAGGAATGAACAAGAGCACGCAGG
CCCATTACTGTGGGCTTTTGGAGCCTGCAATGAATTAAGATGCTCAGAGAGGCCGGGCACGGTGGCTC
ACCCCTGTAATCCCAGCACTTTGGGAGGCAGAGGCGGGCGGATTTCTTGAGGCCAGGAGCTCAAGACCTG
CCTGGCTGACATGGCAAAACCCCATCTCTTCTAAAAATACAAAAATTAGCCAGGCATGGTCGTGCACACC
TGTAGTCCCAACTGCTCAGGAGGCTGAGGCAGGAGAATCACTGGAACCCAGGAGATGGAAGCTGCAGTGA
GCTGAGATAGCACCACTGCACTCCAGCCTGGGTGACAGAATGAGACACTGTCTCAAAAAAAAAAAAAAA
AAAAGTCACTCAGAGGATCTCCAGACAAGGAGAGGCCCACCTCCACCCTGTGCAGTCAGGCCCAGAGCC
TGGACCATGAAACAGAGGTTGGGACACATTTGCCATAGGGAACAGGGACTGCCCCCATACAGTCAGTACTC
TATGAATGCACAAGAATGTCATGTATCTTGGGGCTGATTGAATCCAATAGACAGGGGCCATCTACTCTA
CTTACTTCAGGCACGTTTGAACTGAATTAACTACCTAGACGCATTCATAAGGTTTTTTCCTTTCCGTCAA
CTCTTTTTTTTTTTTTTTGAGACAGAGTCTTGCTCTGTCACCCAGGCTGGAGTGCAGTGGTGCAATCTCG
GCTCACTGCAAGCTCCGCCTCCTGGGTTCAAGTGATTCTCCTGCCTCCACCTCCTGAGTAGCTGGGATTA
TAGGCATGTGTCACCATGCCTGGCTAATTTTTTGTATTTTTGGTAGAGATGGGGTTTCACCATGTTAGCC
```

FIGURE 20 cont'd

AGGATGGTCTCAATCTCCTGACCTCATGATCTGCCCACCTTGGCCTCCCAAAGTGCTAGGATTACAGGCA
TGAGCCACCGCATCTGACCCTTTCTGTCAACTTCTATACTAAATTATTTATCTGCTTCTTCTAATCTTCC
CAGCAACCTTCTCCCAGGAGAGGTGAATGCCCCAAACTCACCTCAGGGCCGCCCACTCACTACAGAGCCT
GTGAACACTTTTCTGTCTACCTGGGATGTTTCTCTGCAGGATGATCATAGATCACCTCAGTGACACCCGC
TCATCCTTCAGACAGCAGCTCTCACATCACCTCCTAAGGGAAGCCCTCCCAGATTTCTCCTGTTCCCTCA
CAGAACTGGGCTCCTTTCCCTCAGAACATACCCTTTCTTCACTAGTCCCTCAATAAGTAGTGGCGTACAC
TGAATTACTTCATTCACATCTGTCCCACGCATAAAACTGGAAGAGCCCCACCACCAGAGACAGGGTTGGG
TCTTTCCCACCTGCCAGAGCCTGGCACATTTGTAACCAGAGAAGTGCATGATGGTAATGGAAGCCAAGGA
CCACACAACCGGCAAGCGGCCTACCCAGGATCTGAGCCCAGAACTTTCTGACTCCAGGCCAGGCGTGGTG
GCTCACGCCTGTAATCCCAGCACTTTGGGAGGTGGATCACCTGAGGTCAGGAGATTGAGACCAGCCTGGC
CAACATGGCGAAACCCCATCTCTACTAAAAATACAAAAATTAGCCGGGCGTGGTGGCGCAAACCTATAAT
CCCAGCTACTTGGGAAGCTGAGACACAAGAATCACTTGAACCCCAGAGGCAGAGGTTGCAGTGAACCAAG
ATTTCGCCGCTGAACTCCAGCCTGAGAAGCAAGAGTGAAACTCCATCTCAAAAAAACAAAAAAAACTTTC
TGACTCCAGTGCCCAGAGTCAGTGGCTCAGCAGCTCATGGACTCAGTGCTGAGTGCCGTCCATGCCCAGA
GCACAGCACGGGCACCAGAGAGGGCTCCCCTAGGGCTGCTACCTGCCAGCCTCTCAGGTCCCTCTGCTCT
GTCACTCTAGTGCCCCAATGGCTCCTAACGGCTTAAAATGGAGAATTAAAATCAGGAGATGTCAATGG
GCTGGTTCATGTTCTTGACTTTGCCCCACAAAAGAATCTGAGAGCTAGTCCAAAGTAAAAGTAAACAAAA
GGGTTTATTACAAAGCAGGCTGGGCCCGGTGGCTTACGCCTGTAATCTCAGCACTTTGGGAGGCCAAGGT
GGGTAGGTCACCTGAGGTCAGGAGTTCGAGACCAGCCTGGCCAACATGGCAAAACCCTGTTTCTACTAAA
AATACAAAGATTAGCCGGTGTGGTGGTGCACACCTGTAATTCCAGCTGCTAAGGAGGCTGAGGCAGAAGA
ATCGCTTGAACCTGGGAGGCGGAGGTTGCAGTGAGCCAAGATCACACCATTGCACTCCAGCCTGGTGACA
GAATAAATTTCCGTCTCAAAAAAAAAAAAAGAGTTTATTACAAAGCAAAACAACCCTCTGACAGCTCATC
AAAAGTGAGACAGCTCCGTGTGATGGGAGGGATCTTCCTTTATGGGAGATTTGCATGATTATTCATCAAG
GGGCAAGAAAGAGGGCTGCTACGAAACACGTTGGGGGTGCTTTATGAGGCCTGCATATTCAGTGGCTGT
ACGCGCTATTACATACATCGCATGTCTCATTAAAATCTTAAATCTCTACCCATGGGTATAGCTAAACTAA
AGTTTTTTTTTAGCATCAAAAAGAGCCTAGGTCAGTTTGAGGTCATTAGTTCCAGGTTTCCGCACCTGTG
CAGGCCTGGGGATTTTTTTTCCCTCAGTTCTTCCTCCTCTTTGCTACAGGATGTCTTTAACCACAAGCCC
CCGATGCGGTTCATGGAATACCAAGTGGCTTGTTCTTGCCATAAATTTGATAAGTGTTTTTTTAAAGAGA
GGCTCTACTATCTAACCTACCTCAGAGAGACAGACACCTGGCCTGCCCGCCCCCTTCACAAGAAGCTCCA
AGCACTCCGAACATCTTTCAGGAAGACACTGGCAATGTTGCAGCAATGAGAAGGGGATGATTTGGAAGGC
AGCCTGAATCACGCTGCCCTTATCAGCATGCTTGGATTGTGTCCCTTCTTGTCTGACTTTTCAGACAGAC
ATTGGGCTATAAAATTGGGATGCAGCTCTGTCATCAACAGTCTGGCGGCAGGAGCAGAAGGAAAGGCAGC
TTCCGAAAACTTGGACCCATCCACCCCAGGCAAGGTAAGAACTTGCTGCGTCGAACGGGTGAAAGAGAAG
GTCCAGCTCTCAGGTAGCAACAAGCAACGCACAGTCCATCTAAGGACCCATAACGAGGGTTTATGCATTT
TTTGATCGCTTTAGCAATGTCCCTCCCCTGCTGAAATGCACTCTGCCTAGCACAGGGAAGGTGGTTGACA
ATTGCCTGTTATGCATTGGTTTTCAGAGAATGGATTTAGTCCTGGGATTCTCAAAAGGTTTCACTCAAGT
CAAAGTCTGACAATATTGCCATCAACTCAGTCACAGGCATAGATTTTTTTTTTCTGCGAAAGTATGCTTA
GATGTCATGTGAGATACTGAGGTTGAATTTCCCGCAGATGAGAGTAAAATTTTAAAAACTAATGAAGCTG
TGTTGAGATTTTTTTCATAAGGCCTAATTAATTCAAACTGAAGAATTCTCACTGGCTTCATTCAGATTGT
ACCCTTCCTCACATTCCTGCCATAGTTGCTCTTCTTTTTAGGGATAGAGTCTCGATCTGTTGCCCAGGC
TGGAGTGCAGTGGTGTGAACTTGTCTCACTGCAGCCTCAACTTCCTGGGCTCAACCGATCCTCCCACCTC
AGCCTCCCAAGTAGCTGAGATTACAGGTGTGAACCACCACGCCCAGCTAATTTTTTTTTTTTTTTTTTT
TGTAGAGACGGGGTCTCACCCTTTTACCCAGGCCGGGATAGACACTTTTTAGGGTGTTGGCAAATGGCA
AATGGCTTGCTTTTGTTAATGCCTATACATGGCAAGGGCAAAGATTCACAACCCAGCCTGGCGCAGTGGT
TCACACCTGTAATCCCAGCACTTTGGGAGGCCGAGGCAAGTGGATCACCTGAGGTCAAGAGTCAGAGACC
AGCCTGACCAACATAGTGAAACCTCTTCTCTACTAAAAATACAAAATTAGCTGGGTGTGGTGGTGTGCA
CCTGTAATCCCAGCTACTCAGGAGGCTGAGGCACGAGAGTCACTTGAGCCTGGGAAGTAGAGGCTGCAGT
AAGCCAAGATTGCCCCACTGCACTCCAGCCTGGGTGACAGAGCAAGACCTTGTGGGGGGGGGGGGGG
GGAAAGGCCCCAACCCAATTTTACAAAACAAGCTCACCTTGCCTCACCAAGGTAAAATGCCAGGGGACA
CAAACCTCCACCTCACCCTAAACATTAGAGGGAAAAACTTGGGAATCACACTTTTGGAGGAAAGTGAGGG
TCAGTGGTGGGGATCAATCTCTGAAAGTCACCCAGCACAGCTCACACTCAAACAGGGGTGTCCTGACTGG
GTGTGGAACCAGCTCTCTGCCTCCTGAGTCTCAGAATCCTCAGTGTGAGCAGACATATGCACACACCCCA
GTGACAAGAGATAGACCTGAGAGTGCAGCTGCAGGATTCAGAACTCTCCAGTTCCCCAGTTAGTGACTCA
GATGGCTCCAGGGATGTGACAGAGGAAGGTGGCATGAGAATATGTGACCTGAAGGTAACACCAGTGAGCA
GGGCTTGGCCTGTACTTAAACGCAATGACCAGCCTGGAGAGTAGGTCTATGCACAGTTGAAAAGAAGTAG
GGAGGTCAAGGCGGGTGGCTCACGAGGCCAGGAGTTCGAGACCAGCCTGGCCAACATGGCAAACCCTGT
CTCTACTAAAAATACAAAAATTAGCTAGGCGTGGTGGCAGGCACCTGTAATCCCAGCTACTCAGGAGGCT
GAGGCAGAAGAATCGCTTGAACCCGGGAGGCGGAGGTTGCAGTGAGCCAAGATCATGCCATTGCACTCCA
GCCTGGGTGACAGAGCAAGACTCCGTCTCGAAAAAGAAAAGAAAAGAAAATAAGTAGGAAAAAGCCCTT
TCTTCAAGACACTGACTGCTACATACTGCAACATTTTCCCATGACTGCAGCATACAGACTAGAATATCTA
CGATGGGAATGGCACCCTCCCGCAAGGGCCAGGACCCTGGTATGTGGACGTCCTACACAAACGTACATTG

FIGURE 20 cont'd

```
TGGCCTGATGGTCCCTGGGGAATGTGGTGTCTGAAGAAGCCCTCTTTTGCAGGTATCAGCCACCACGATG
CTGACTCTCTGGGCCCTGGCTGTCATGTTGGCGGTCGAGGAAGCACTTGGCCAGCTGGAGCTCGCAGATA
GGCCTTCCCTAATACCCACTTTGCCTGTCCGTTTTCCACCTGGATTGCTCCCTGGAAGTCTGTCAGTCTC
AAAAGTCCCTCTAACCGGAAAATACCCAGCGAGGACCAAAGGAGGCAGGTGTCCACCCGTCACCAAGTAC
TTCATATCTGACAGCAAACTCGAAGACTGTAAGTAAGGGCTACACACCCTTGGTCCTTTCAGCCCCTCAC
GCAGGCTTCTCATTCCTAAGCTCAGCGGGGGGTTCTGTCTTCTGAACATGTGGGTCCCGAACATGAGGGG
GTGTTGGACTCACCTTAGAAGCTTGTGATAGAACAGTTGCCCAGGCCCCCTAGCCATTCTGGTCCGGCA
CTACTGCAGTGGGCCTGAGAGTCTGGCTTCCTCATCTGCTCCAAGATGGCACTGAGGCTGCTTGTCCAGG
GTCCACACGTAGGTTAGGGGTGGTCTACACAACCCTGGAGGAGGGAACTCTCCCACCCGGCAGACTGATT
ACCTCCCACCTCACCTGGAGACTGTGCGGAGAGACTGCCCATCCCCTCCCTGCTGGGCCCCAGGGCTCAC
CCAGACTCCCACAGGTGCTGAAACCTCAATCCGCTTTAACAGGAGCCAGGAAATGGGAAATCTGGGCCCC
GCCATCATCCCCTTGACCAGACTTGTTCTCTCCAAACTCCTTTTGTTCACTCACTCCCTGAGTCTCACCT
CCTGCATTAGACAATGAGGAATTCTTTCCTCCAAGAACCCCGCAGAGGGTGAGGGCAGAGCAACTCAGGA
ATTTAAGGCTGGGCAAAGAAGTGACTCCCACTGAGGAGCCAGAAGGAGCAGGGATTTATTAGCAAATGAA
GGCCAGCAGGAAGGCTCTCAGTGCTCTGACGCCAGCCTCGCAGTCATGGCCCACCTCAGCCATCCAGGAT
GAGAGGACAGGGCCACACAGGGAGACCTGGCACATGCTGCATGACCAAAGGGCCAGCCCCACAACTACAA
TGCGGACTGCTTTGACTCGGGAAGAACATGTGCTTTGCTCTTCCAGCAGCCTTCCTTGGTACAAAATACT
TCAAATATATAGAAAAAGACCAGACATGGTTTAAAAAAAAAAAAAAAGACAGCTTTGTACCCATCACA
CAGTGATTTGGAGGTAATGGTGGTTAATTTTGGTTGCTTTGTTTTGTTTTTGTTTGTGTTTGTGTTGAGA
CAGGGTCTTGCTCTGTTGCCTAGGCTGCAGTCCAGTGGCACGAGGCCCCTTCACTCCATGCCCAAATCCC
TTTAGATGTACTCAACAGCAGGCTGATCTCATAGTAGTTACTAATAAATGGTAGCTCTTAATAAGGGCAC
AGGCAAATTTCTCTGACACCAGGCTGTCCTTGGAGTAGGCAGTAGCAAGCACTGTTTTTTCCAGGAGGCA
CCATATACAGTTCCTATGGACCCCTCAATTCAAATGTGCCAGCTGCCTGGCAGGAAAGCTTCTTCTTGCT
GAACCAACTGGGAAGGCCACAGCAAGAATGTGTCTCTTGACCCTTTTCAGATATGAATGCCACCTTGCCC
CTGCAGATTGAGAAGATTCTGAAGTGTGAGAAGGTTAACTTGGCTGGTTTGCTTGGGACCGTATTATCCA
CAGTGAGCGACTTGGACCTGCTGTCTCTATTAGACCTCACTTCACCCCTTGATATACTTGGAGGTGCCAG
CCTCAGTGGTATCCTAGGTGAGGGAAGTGGCGGCAAGTCCTCGAAACTTCCATTGCTCTCAGAACTCACT
GGTGCTGTCAGTGGTCTGCTACCCCAGGGGACGGAGGGTCTGGTGAGCCTACTACCCACTGGTTCAGACA
AGAACCCTGTAAAAGGACTCCTCGGTGGCACTGGTCTCTCCACTCTCCAGCGGCCTCTGAAGGATGTGAC
CGACAAAGTCCAAGACCTCAAAGAGTCTGCTCAGGGCGTGCTGAACAGCACCCTGCCCTCAGGCATCAGC
GATGCACTCCCAGACCTGCTGAAAAATGCTGACCTGGAACAGCTCTTGCTGGGGTAAGTGCTTCCTTGAC
CCTATGTATGACTTCTCCACCAGAAACCTGCTGATTTGGATGCTCATGTTCAACTTCCAACAGTCCCACG
GATTGGGATGGGTATATTGCTTGAGATTGATATATTTCACCAGAAATATTCTCGCTCTATGCTGTGCCTA
TATCCTTTCAGGGGAAACAGGATCAAGATTTTTGAGCTTATAGGCCTGGGCACATTAGACAGCTGAGGG
GTCAAGGGACTGGATGGTGGCTTGGTAGGCTGTTAATTATCTGCTTCAAAGGCATTTCTCCTGCTGTCCA
GGCTGATTCGTTGAAACAGGACTGACTCTTGATGCTTTCGCTTTGCAGATTACAGGTTGAAAAAGTAACT
GTGGAGAGCATGAAGTCAACCACGACAGGCGATGGGATCCATGTCCAAGCCACGACTACGGCCTTCATAG
GTGGAAAAGGGTGAGTCTGTGCACACAGCAGTCCACTGGGTCCCCCTGCCCCAGGGTTGTAACATCCAGT
GAGCAAAGACCAGGTAGAGACAACAGAGAGGACAGCAGCATGGGTGAGGATGGGGCAAAGCGGGCACTGC
ACACAGCTGCCCCTCTCCCCAAGTACAGGTGGGCAAGGCAAGAGAATGGTCCAGGGAGCCTCATCCTCCA
ATAATGTGAACAAAAATGTTGACGGGCTGGGTGTGGTGGCTCACGCCTGTAATCCCAGCACTTGGGGAGG
CCTAGGCGGGCGGATTACGAGGTCAGGAGATCGAGCCCATCCTGGATAACACAGTGAAACCCCGTCTCTA
CTAAAAATACAAAAAATAGCTGGGCGTGGTGGCGGGCGCCTGTAGTCCCAGCTACTCGGGAGGCTGAGG
CAGGAGAATGGCGTGAACCTGGGAGGCGGAGGTTGCAGTGAGCCGAGATCACGCCACTGCACTCCAGTCT
CGGTGACAGAGCGAGACTCCATCTCAAAAAAAAAAAAAAAAAGAAAATGACAGGACCCACTCACCCCACC
CACCCCACTAAGCCACTAGGGAAGGCAAAACTAGGTCATGAAAAGTGCTGAAAGAGGCAAGGTTTTAGAC
TCAGTTAGTTTCACTTACAGGAATCTGTCCAAAAAACCTAAGTACAGATACATTTAAACACAAAGACATA
GGGGTATTCATGATGGGAATTTAAAAAACAAAAAACCTGAAACAAAAGCAAATAATTAAACCAAGTACA
AGATTAGAAATGCTGACAACATTTATAATGGTATACAGAAATGCTTGTGAAGTTGTTTTTTTTTGTTTT
GTTTTTGAGACAAGGTCTCACTCTGTCACCGGGCTGGAGTGCAGAGGCACAATCACAGCTCACTGCAGC
CTGGATCTCCTAGGTTCAGGTGATCCTCCCACCTCAGCCTCTCAAGTAGTTGGGACCACAGGTGTGTGCC
AAGGTGCTCAGCTAACTTCTTTTTTTTTTTTAATTTTTTGTGGAGACCAGGTCTTGCTATGTTGCTCAG
GCTGCTCTCAAACTCCTGGGCTCAAGCAATCCTCCTGCCTGGGCCTCCCAAAGTGCTGGGATTACAGGTG
TGAGCCACCACGCCCAGCTATTGTTAGTTTTATTTTATTTTATTTTGAGATGGAGTCTCATTCTGTCGCC
CAGGCTGGAGTGCAGTGGCGTGATCTTGGCTCACTGCAACCTCTGCCTCCTGGATTCAAATGATTTTCT
GCCTCAGCCTCCCGAGTAGCTGGGACTACAGGTGCACACCACCACACCTGGCTAATTTCTCTGTTGTTGT
AGTAAAGATGGGGTTTCTCCATGTTCATCAGGCTGGTCTCAAACTCCTGACCTCAAATGATCTGCATGCC
TCGGCCTCCCAAAGTGCTGGGATTACACGTGTGCACCACCATGCCCAGCTATTGTTGGTTTTAAACTAA
CAATAGCAAAGTTTACTTTGCTGAAACTTCTAACTTTCCTGCTCTGTGGAGTTTGCATTTCATAAGCAGG
GGGAAATGCATATTAACCAATGAAGGTCAGAATATCCATGAAAGGAAATTACAGACAAGATGGGCTTTGG
AATGTGGGAAGGAATGAGGGCCTGCCAGGCTGACAGCGCATGTACAGGAAGGTAAGGAATGTGACTGTTG
```

FIGURE 20 cont'd

```
GCCAGGCGAGGTGGCTCACACCTAGAATCCCAGCACTTTGGGAGGCCAAGGTGAGTGGGTCGCTTGAATC
CAGGAGTTGGAAACCAGCCTGAGCAACATGACAAAATCCTGTCCCTACAAAAAATCCAAAAATCAGCCAG
GCATGGTGGCATGTGCCTGTAGTCCTAGCTGCTAGGGAGGCTGAGGTGGAAGGATCACTTGGATAGGAGG
AGGCAGAGGTTGCAGTGAGCCGAGATTGCACCGCTGCACTCCAGCCTGGCAACAGAGTGAGACTCTGTCT
CAAAAAAAAAAAAAGTGACACAGATACACACACACACACACACACACACCTTACTGGTAGAAACACT
TAAACAAGGGCCATTCACCTGAAAAATAATGAATGTGGCTTCTCCTGGAAAGTCAGAGATCTGGGTGCCC
TGAGCCTAACTGCATGGGGTCCACGGGCAGCCGGAGCTCAGCAGCAGCTCCTCCTTCACCAGGTGCCTGC
CCTCAGGGCACTGCAAACCCCACCATGCCCACGGTCCCGCACCACAGTGGAGTTGGGGAGGTCAACAGCC
ACGTGTCCTCAGGCTCCTCCCACAGCAATACCTTCAGGACCACCTCACCCTCCACCTCCCCAGTCAGACC
TCCAAAGGCATTGAAATGGGTGTCGGTCTCATGTGATTACCGAGATGTTTTTCTGCTTTTTCACTCTAG
GCTAAAGCCCACTTTAACAAAAATACCGTCACTGTGCCTGGAAGTTCTCTCTCTTCAGACACTAAAAATG
TCAGCGTTTCCCTAATTCTGTCCTACGCGATGCTGAAGGTCATCATCACTCACACTGCCAAGCAGAGCTC
TGTGCAGGTAAGGGTCGTCCACAGGGCCCGGCGTGGCTCAGCACTTTCCTCAAGCTCAGCCGGTCAGCCT
CTGACAGCAAGAAGGTGGGGGTGAAAGTGGATTCTGAATGTTCTTTCAGGTTAATACACGACTGCCATGG
GATGCACCTTTTCCCTTCATTGTCATGTAAATGGGTCCTGGTTTATGTTGGTGGAAAGCAGAGAACAGGG
ACTTGGGGAGAAAATGTGGTCTGAAGCCGGGTGAGGTGGCTCATGCCAGTAATCCCCACACTTTGGGAG
GCCGAGGCAGGCAAATTGCTTGAGTCCAGGAGTTCAAGACCAGCGTGGACAACATGTTGTCACCTTATCT
CAGCAAAAAATTAGCCAGGCGTAGTGGTGCATGCCTGTAAGTCCCAGCTACTTGGGAGGCTGAGGCAGGA
GGATCACCAGAGCCAGGGAGGTTGAGGCTGCAGTGAGCTGTGATTGCATCACTATATTGCAGCCTGGGTG
ACAGAGTGAGACTTTGTCTCAGAAAAAAAAAAGTGGGGAGGAGGGGTTCTAAGTGCCATCTGTGTGCTA
GGGGCAAAACCAGGTGTCTTTACATAACCAACATCATTTCATCCTCAAAACAGCACTAGGATGTAGGGTT
TCTTATCCCCGTTTTACAGATGACGAGAGTGAGGGAAGGAAGCACCAACAGTCACAGAATGAGCAAAAAA
CATAAGGCAGTTGTTCATTTGCTACCGGCCCTAGAAGTGGCAGAGGGAATAGTAGCAATAGTAACAATCA
TAATTGACTTTTCTCTATGTGCCAGGCTCTCTTTGAAACAAAATATAATTTTTTTAAGAGTGTGTCCCA
AAGTGATCAAATGATCAAGTGCAGAACTCTCTTCCCACAAAGGCATACAGAGAGACAGGCTTCAGATTGG
ACAAGGTGTAATAGAAAAGTAAGATTTTACATGTTGCATGCCCCCACCATCCTTCAAAGAAAGGAAACAT
TATCAAGGTGAATGTTTAGAAATAGGCCTTGTCTGTCATGGTCACACCAGCTGCACCAGCACCCAGGTGA
CCAACTTACACCAGACGATAAATATTTGTATGTATGATCTGAATGATGCGAGAGTGTTTCATACTGCAAC
ATCCTGCAGCCCTTACTCAACACACTCTAAATGACTACTTCTTTCCAACAGAGAAATAACCTGGATGCAA
GAATCACCAAACTAACCTACTCCCACCGGCCAGACATAAAATCTAAGCCAGCTACTGGGTTAACATCACC
AAGGACGGTGGGAGCTTTGTCACCGGGCAAACGGTGAGTGCTGAGAAATGAATCAGAGCAGAGTTGAGAG
GAAGAATTGCAAGGAGCAGTGTTTAGTGGGTTTAGTTACTCCCTAAACTCTGAGGCTCAGAGTGTCTGGG
TGTCCCTAGGATGAGGGAGTCCAGCCAGGCTGGTGGGCTCAGCCCCCAAAGGGAGAATGGAGTGAGCAGG
TTGGCTTAGGAGGATAAGGCCAGGCAGACAACCCTCTGACCTGGGACCCTGTTGGCCATCGCGCACTGTG
ACATGTTTGCTGAGTAGCCAGGCCAAGGTGTTATTGTTAACTCATGTTCATTTGTATTAATTCAGGAAT
TAATCATCTCATTCGTGAGCAAGATTTCGAAAGACAAACTGATCACAGACATCAAACTTCTGAGGTACTG
TCTGTAACTACATAATCTGCCTGTCTATATAAGAGATATCTAAGGTCTGATAAAATCGCATAACCGGCT
GGGTGCAGTGGCTCACGCCTGTAATCCCAGCACTTTGGGAGGCCGAGGTGGGTGGATCACAAGGTCAGGA
GTTCGAGACCATCCTGGCCAACTTGGTGAAACCCTGTCTCTACTAAAAATACAAAAATTAGCTGGGTATG
ATGGCAGGTGCCTATAATCCCAGGAGGCTGAGGCAGGAGAATTACTTGAACCCGGGAGGCAGAGTTTGCA
GTGAGCTGAGATCATGCCACTGCACTCCAGCTCTGGGCAACAGAGCAAGACTCTGTCTCTAAGGAAAAAA
AAAAAAAACTACATAAGCAAAATAATCACAAGGTTCTTGGGAAGTATCTGCAAAATTACAGAGAAATCAG
GATGGAGTTTTGAACTCACATGCTGTTGTTCATCTTACATTGACTCTTTCTGCTCAGTAGTTTCCAATTT
ATAAGTGACTTTAAGGAGCAACTGACATCCTACTTAGCTCTACAATGGAGTTGTATTTTCACCTGAATCT
AATATTTCTCTGTACTTTGTTTCCTGACAGCTCTGAACACAATACAACACCCCCAAGTTTCTTATGTTT
TCAATATATTTATTGATGGTATGTGAGAAAAGATTGTAGTGCCAGGTGCTCAGTGCCATACACACTCTGG
AAAGAAAAGGTCAGGAATGGCCAGGCATGGTGGCTCACACCTGTAATTCCAAGACTTTGGGAGGACGGGG
TGGTTGGATCACCTGAGGTCAGGAATTCAAAACTGGCCTGGCCAACATAGTGAAACCCCATCTCTATAAA
AATACAAAATTAGCCAGGCGTGGTGGCGCATGCCTATAATCCCAGCTACTCAGGAGGCTGACGCAGGAGA
ATCGCTTGAACCCAGGAGGCGGAGGTTGCGGTGAGCCGAGATCGATCGCACCATTGCACTCCAGCCTGGG
CAACAAAAGCAAACTCCATCTCAAAAAAAAAAGAAAAGAAAAATGTACACATCGATTGTATGTAAAT
TACACATACCTCAATAAAGCTGTTAATAGTGTGTATGGTATACAATCATTTGTATAAAATAATCACAAAT
ATAAATCATTTTATACACAGAGATTATCTCTGAAAAGATACATTAGAAAATGATTAATGTGCTGGATTTT
GTAAAAGGGAACTAGGGGATTAGTAGGCGGGAAGGTGATTGATTACAGATACCTACTGTATTGTTTGGAT
TATTTACCATATGTATGTTTTACCTTTTGTTTGTTTGTTGTTTTTGAGACAGGGTCTCACTCTGTCACCC
AGACTGGAGTGCAGTGGTGCACTCTCAGCTCACTGCAGCCTCCACCTCCTGGGTTCAAGCCATTCTCCTG
CCTCAGCCTCCCGAATAGCTGGGATTACAGAGATGTGCCACCACGCCTGGCTAATTTGTGCATTTTTAGC
AGAGACGGGGTTTCGCCATGTTGGTGAGGCTGGTCTCAAACTCCAGACCTCAAGTCATCCACCCGCCTTG
ACCTCCCAAAGTGCTGGGATTACAGGCGTGAGCCACCACACCCGGCCTGTTTTACCTTTTTATAAAATT
GAAATAATTTCAAAACCTGCTTTAAGTGCCTTCTGAAGAAAGGACTAGGGTAAGGAACCATCACAGATAA
ATGTTCTCAATAGAAGACGGACCCTAAGAGTAGAAACCAATCCTTGAGCGCTGAACCAGCACCTGAGGAA
```

FIGURE 20 cont'd

```
GAGGTTCCTGTTGTGCAGGTAAATGAAGAAGGTCTAAAGGACATCATGGCCAGACACACAATAAAAGCCC
CAGTATATCCTAATATACACAATCTGTTTGAGAAGTAAAATCTTTTGATGATCTCTCCCATTTGATAAGA
CCTTATAATGTTCCATGGACTGTGCTAAACTCTCTAGAAGCATGATTGTGTCACTGAATTCCACGTGAGA
TATGCATGTGATTATCTTCATGTTTCACATCAAAAAACCAAGCCAGGCTGGGCACAATGGCTCATGCCTG
TAATCCCAGCATTTTGGGAGGCCGAGGCAGGCGGATCACTTGAAGTCAGGAAGGAGTTTGAGACCAGCCT
GGCCAACACAGTGAAACTCTTTCTCTACTAAAAATAAAATAAAAAATTAGCTGGGCGTGGTGGCAGGCGC
CTGTAATCCCAGCTACTTGGGAGGCTGAGGCAGGAGAGAATCGCTTGAACCCAGGAGGCAGAGGTTGCAG
TGAGCCAAGATCGTGCCACTGCACTCCAGCCTGGGTGACAGAGCGAGGCTCCACCTCAAAAAAAAAAAA
AAAAAAAAAAAAAACACACAAGACAGAGAAGAGGAGAAGAGTAAATTAACTACTCAATTTCAGACAACT
CTCAAGCAATAAAGTGGGGATGTGAACCAAAGTCCTCTGACTCCAAAAATTCCATGCTACCATCTCTTGG
ATATTTTTTTCATGATACCCACAGAATGAAATAACCTTGGTGGTGAAGGGGGCTGAGAACCACTACTCGA
AACCTACTAATAGGTCCAAGGGAAAAGAGACATAATTTTTTTAAAGCCTAAAAAGTAATGACATCTTTTT
TTTTTTTTTTTTTGAGACTGAGTTTCGCTCGTCGCCCAGGTTGGAGTGCAATGGCGCGATCTCGACTCA
CTGCAACCTCCACCTTTTGGGTTCAAGCTATTCTCCTGCCTCAGCCTCCCAAATTGCTGGGATTACAGGC
ACCCACCACGATGCCCAGCTAATTTTTTTTGTTATTTTAGTACAGACAGTGTTTTGCCATGTTGGCAAG
ACTGGTCTTGAACTCCTGACCTCAGGTGATCCACCTGCCTCGGCCTCCCAAAGTGCTGGGATTACAGGCG
TGAGCCACTGTGCCCACCTGGTAATGACATTTTCTAAAACTCCAAGTGCTGTCAGACCTCACAGGCTGA
AAAAGAGGTCCACTGGTGGCAAAGGCCAGGGAGGCTTTGGAGGGCAAGGAGGCTTCCAAGGAGGCAGAGG
AGGAAGAAGAGACCACAGCTACAGGAAAGAAGATGAAGTTTGAAAAGCTTCTTCTATCCTTGTCTTTTCC
TCTTCCATTTGAAAGGACTCGGGTTTTTACTCTGTGCCTGATCCATCACAGAGCCTTCTGAGGACATTCC
AAGATTGTCTACAGTCCTGTGGTCCACTTGGAAATTCAGACAGATAATATTTCAAGGGGATAGTTGGTTT
TGACTGAATACTCATGAAAACTTTTAAAGAAATGAGTGATAGAGCTAACCCATATCTGTAAGTTTTGATG
GTTTTTCTTGTTTTTATTTTTTTGAGAAAGGGTCTTGCTCTGTCACCCAGGCTAGGGTGTGGCGGTGTA
ATCGCGGCTCACTGCAGCCTCTATCTCCTGGGCTCAAGTGATCCTCCTGCCTCAGCCTCTCAAGTAGCTG
GGACTACAAGGCCTGCACCACCACACCCAGCTAATTTTTTTTTTTTCCTGTAAAGTCAGGAAACCTGCC
ACATTGCTCAGGTTGGTCTCCAACTCCTGGGCTCAAGCAATCCACGTGCCTCAGCCTCCCAAAGTGGTGG
GATTACTGGTATGAGCCACCATCCCCAGCTTATGTTTGAATTAATAGTTGTTTTTTTTTTTTTTTTTT
TTTTTTTGAGACGGAGTCTTGCTCTGTCCCCAGGCTGGAGGGCAGTGGCATGACCTCAGCTCACTGCAG
CCTCCACCTCCCAGGTTCAGTGATTCTCCTGCCTCACCCTCCTGAGTAGCTAGGACTACAGGTGCCTGCC
ACCATGCCCGGCTAACTTTTGGATTTTTCTTTAGCAGAGTCAGGGTTTCACCATGTTGACCAGGCTGGTC
TTGATCTCCTGAGCTCAAGTGATCCACCCGCCTCAGGCTCCCAAAGTGCTGGGATTATAGGTGTGAGCCA
CCGCGCCCAGACAATATTGTTTCATCTCATGTAAGAAAACATTTTTTTCCAACAAATAATTTTTTATGT
TGGGGGTTGTAAAGGAAAGCAGAGTGTTTTATCAACTTTTTTGCTTGAGTGGCTTTAGAACAATTTAAAA
GTCAACTTTGGTGCCAGATAAAAAGAGGTCCATGAGGGAAATCCTCAGGTAAAACATGCAAAATAAAGTG
CAGCGATAGGCAGCTAAGTCAGTGGCATCCAATGCAAATGTCAGAAAGGTCGAGAGCAGTTTTCCCAAGC
AAATGGTTCTCCCCACCTTCCTCTCCTTCAGTCTCTGCCTCCTAGGGCCCAGGGGAGAAAACCTGAGAGG
GAGCAGTGTCCACAGGAGAAACTGGGTGGGGAAACACTTAACACAGACTGCAGGGAAAACTCCAGAAACA
CTAACCAAGGTAAAAACGAAGTCAAAGTGAGAGACAAAGGGTTAACCTTAGTTTAGGTAAATTTAATGAC
TGTAAAAGCTGTTCACATAGCAGCTTTAAAGAGACACGTTTTCCACTGACATAAAGTTGCTTCGCCCCTT
GCAGCTTATCTCCACCTTCATGACCTGTTTCCTCAGTGGCAGGCAATGTCTCCCCTTCCTGTTGGGGAGG
ATTGCCCAAGTCAGCTCTGAGGCCATCCTCTCAGGTCAGCAATATGCAGAAGAGTCCCTCAGAGTGGTCC
TGCAGAGAACATGTCCCCTAAGTGTCTGAGAACTGGCTGAGGTGATCTGAAAGAAAACCAGGCAGAAGAA
GGCAAAATAACTAGGACTGTAGCACTGGGACTTCATGTGGAGCCTCTAGAGGAGAAGCCCCCAAAAGGAA
TCTGATGGAGGCGACCGGCTGGCAGAGACCACATGGCTCCTGTGTGCCCCGATCCTGGCAGGAAGCGAG
GTCTCATGGAATGGCAATGGATATAATTTAAGAAGTCAAAGCAGGTCAGTCCCAGCCACTTCTCCCTTTT
CTCTTGGAAGATGGCTCCTCCTCAGCTCTAACCATAAAATTCAGGTGAAACTGCCCATCACAGGCCCTGC
CCTCCTAACTCCAAGGCTGATCCAGTCAAATCCTTCCTTAGGATATTTACAGCCAACATTTGGTGAGAAA
TGTTCTCTCTCCTCCAATTGAGAGCTAAAAGAATGTGACCCCAAAGTTATCTGTGGTCACATGTCTTATC
ATAAGAGCAAGTCAGTCCATTAGTAAATCCTTACTAAGTACATATTTTGTACCCGGAATTGCCCTAGGTG
CTAGAAGATAAACAAAGATAAACAAACAGAAACAAACAGGCATTTTCCCTGCCCTTAAAGGAACTTCTG
TGGATGCTCTAGGGCATCAGTCTGTGTCCTGCCAGCTTCTGGTTCTGAGGCGAAGCAGATATGAGAACAA
GACAGGGAAGGTGGCAGTAGCAGAACTGGGCAGTGTGAGAAGAGAAGGCAGAAGAAAGGAAGAAATGGAA
GGAGACAATAAGAGAAGCATATCGCCAGTGAAAGGGAGAAAGAAAGAGAGAAAGAAAGGGAGAGAAATC
CCACAGCCATATAGCTGATCTGTGAGTCCAGGGAAGAGACCCAAGAAACTCGAGCACATGTAAGTTAAAG
AGGCCTGAGCCGTCAGAGATCACAAAGAAAATGTTGATCTCCAACAGGGAACACTCTCTACTCACTCGAA
ATCACTCCACCTCCTGGCCTCTCTGCAGCGAGAAACTACATGCCACTGCATACTCCAAACTCACCAAATT
CCCACAAAGAACGCTTCCAGGGCAGGAGAATAGGTAAGAAGAATAAGAAGGCATTAGTAAGGAGCAGTCT
AAAATCCAATCCAAAGTGCCCTTCCATTGTACTGGTTGAGAGGGGATTTTATTTTACTAAAATGTGTCT
CTAGGAAAAAACTTTATTACCACAAATATCCAAACCAACACTCATTTCACAGTGCAAGCCAAAAGCCCAA
AAGGACTCCTCACCTTCACCAGCACATAGTCCCCAGGCTGGGCTCTGACCCTGAGCCCAGGGTTATTGAC
ATCCTCCATCTCTGCATCAGGGAAGATCACCTTAAGGTTTCATCATTCCTGCCACACAGGTCAGTGGCA
```

FIGURE 20 cont'd

GAGCGTTTACTGAGCTGCAGAAAGAAGAGAGAAGAGTTCGTGGATTTGTCACAGTTGTAAGTTCTTGGAG
GGTAGAAACTGTGCCTTCTCTGTCTCGGATCCCCAAGAGTCTGACCCACAGAGCATTCCTTAACCAAGGA
ATCACTGAAGACTCAGTGTTTGCTGCTGCTTCACCAGCAAGGGCAGTGTATGGCCCACAACAGAAACACT
GTAAAGTTTTGCTAACTATATTATAATGAATCAATTAATCAATAAGTCTGTGCAGAACTGCCTTCTGCAG
GAATGGACCTCCAACAGGCCTAAAGCCAGAGACTTATGAGCGATGCATTTGGAAAACCAACTTTCACTTC
ACCCAGTCTCATACTAGTCACTTATGAATGAATGTTCTGGGATTGTTTGGCCTGCATTACTTGCCCTCAC
TGAATAGACAGACTGAAAGGCAGAATCTCCAACACAACACACAGAAGACAGAGCCAGGAAGATACTAACA
TCACTATGATGGGATTAACTTCTAGAGTCTACGGAAACCCTTCTCTTCCAGCCATGGTAAAGAGACAGAA
ACAAGTTTACCCTTCAGCCTTATAAATAATAACCAGCAAATTGGGTAAAATATATGAAACAACTGTTTTC
GGATACTGGACAAGAGATCATACAAGACTGTGAGCTGTGAGAGAAGGAAAACAAAGTGAGCCCCCCAATC
ACCCCTGCTTTCTGCCAGAAGGTACATGCCAGACGGGAGCCTGTGAAGCAGGAGGGGAGAGCTCAAGCAC
AGCACAGTGGTCCTCCCCTGCACTGAAGAGAGAGGGATCAATGTTCAGGGAGACTGAAATAGTTAGAAAC
TGTGAAGCAAATTCTAGAGAGAAGGGAGCAAAGCGGAAAAAGAATTTCAGAAATATGCAGGGGGTCCTTA
TGAGTCTTCACTGAACACTAACACTTGCATGTGTAGCATAAAACTCCATGAAGTCAGGCAAAGAGAGTAA
CCTGGGAACTGTCCACTGAACAGTTCCCAGAACTCACATGTGGCCTGGAATCCACTACCAAATAGAAGAG
TTTATGGATTTGTCACAGTCATAAGTTCTTGGAGGGTGGAAATTGTGCTCATCGGTTCCTTGGGATATAT
TCACTAGCAATTCTGACAGAAGGCCACATCTTAGTAGTGAAACTAAACTATCCAGAGAATAAAAAAGTT
TTTCTGGCCAGGCGCAGTGGCTCACGCCTGTTAATTCCAGCACTTTGGGAGGCTGAGGCGAGTGAATTAC
CTGAGGTCAGGAGTTTGAGACCAACCTGGACAACATGGCGAAACCCCGTCTCTACTGAAAACACAAAAT
TAGCCGGGTGTGGTGGCGCACATCTGTAGTCCCAGTGACTCGGGAGACTGAGGCAGGAGAATCGCTTAAA
CCTGGGAGGCAGAGGTTGCAGTGAGCCGAGATCACGCCACTGCACTCCAGTGTGGGCAACAGAGTGAGCC
TCAGTCTCAAAAAAAAAAAAAAAAAAAGGAAGGAAGGGAGAGAGGGAGGGAACAATCTCTGTGACCTCT
GGGACAATATCAAGTGGTGGGACATATGTGTAATTCAAGTACGGAAGTGGTGGAGGTGGGTGGAAGAGGA
AGCGGAGCAAAAAAATCTGAAGAGTAACAGGTGAAATTTTTCCAGATTTGATGAAACTATAACCCCAGA
AACTAAAAAGCCTCAAAAAAATCCCAAAGAAAACACAAAGGGGTAAACACAAAGAAAACCACCCCCAGCC
ACATCAAATTCCTAAAAACAGTGATAAAGCAAATCTTAAAAGCAGCCAAAGAAAATGGCATAGAGTAAA
GAAGAATGACCACAAACCTGTCAGAATCACGTATGTCAGAAGTCAACAGAATGATATCTCCAAAATGTCA
ACCTAAAAGTCAACACTCGGTGAAAATATATTTTTAAAAGGAAGGTGAAATAAAGATCTTTTCAGACAAA
CAGAAGCTGAGCAGCATCACTGCCAAAAGACCTGCATTACAAGCAATGTTAAAGGAAGCCTTTCAAGCAC
AAACAAAACGATGCCCAGTGGAAACGTGAACGTACACAAGGGATGAAGAATGCCAGAAATAGTAAATCAG
TGGGTAAATACAGACTTTCTCTCATTTTTTAAAGTTCCTTTAAAAGATAATTGTTTAAAGCAAAAATAAC
AATGATTTAGGGATACAAAAGTAAAACTCTGTAAAAATAGTACAAAAGGAGGAGGAAGGGACAGAAGTAT
ATCATTACAAGAATCTTACATTATATACACTGAGTGAGTGGTACCCAGTTTGGGGTTAAAATAATGGGCC
AAAGAGAATCCAAAGGGCACATAATCTGCCATTAGAAAATCAAGCTCTGACAACATGCTATATTCTTAAG
TAATCAAAGACACAGAAAGGAGTTCAGTCTTTAAATGAATACCACTTTAGGGAAACAACCTTCAGCTGAG
ATTTAGAGGCTCTACTATTCCCTACAAAATACTTACTAGTTACAAAAGGAAAAAGAGTAACTTTACAGTC
AAGAAGGCTGGCAGACAGTATCTTCCATGTTTTCAAAGTTAGCATCATCAGTAATGAGACAAATCAAAAT
TGTATGCCACCTCACAGGATATGATTAGAATACAACATCATCTCTCTGGTATTCCTGCCAAAGAATGCAT
AACCTGAATCTTATCATGAAAATACATCAAATTATGGACATTCTACAAAATAACTGGCCTGTAATCTTTA
AGTGTCAAGGTCATGGAAGTCAAAGAAATAATGACGAACCATCCTAGACTAAAGGAGACTAGAGAGACAT
GACAGTTAAATGCAACATATGATACTAAACCAAATCCTTTTCCTATAAAGGACAGTTCGAAGACAACTGG
AGGAAACTTACATGGGGTCTCAGGATTAGATGGTAGTAATCTAACAAGGTTAATTTCCTGATTTTCATAG
TTGTACTACAGTTATCTAGGAGAATGTCCCTGTTTGTACAAGATACACATTACAGTATTTGGGGGTTTGG
GGACATCAGGGCAGCAACTTACTCTGAAATGATTCAAGGGGAAAAAAGTTCTTTATAATACACTTGGAA
CTTCTCTATGGGTTTGCAGTTGTTTTACAGTAATTTTTTTTTAAAAAAAGAGAGTTCAGGCCACTGCAG
TGGCTCATGCCTGTAATCCCAGAACTTTGGGAGGCTGAGGTAGGAGGATTGCATGAGGCAAGGAGTCTGA
GACCAACCTGGGCAACAGAGCAAAACCCCATCTCTACAAAAAATTTGAAACATTAGCCAGGCGTGGTTGT
ACACATTATAGTACCAGCTACTCCGGAGGCTGAAGCAGGAGGGTCGCGTGAGCCCAAGGAGTTCAAGGTT
ACAGTGAGCTATCATTACACCACCACACTCCAGCCAGGGAGACAGAACGAGAGACTTTGTCTCAAAAAAT
ATAAAAATAAATAATAAAATCAATTAAATTGAGATTTCAGGTTCCATGATTTGAAAAAAACCAAGTGTA
AAAGAACATTCATGAGACAAACAGGGAAATTAGAACACTGAGCAAATATTTGGTAATATTAAGAAAATTA
GAAGTGCTTTGGAAATCTAAAAGAATATTAAGACATTTTTGTCAATTATTGTCAGGTATGATAATAGCA
TTTTGTTTATAATTTTTTAAAGTCCTTATCTTCTAGACATATATACTGAAATATTTACTGAAGAAATAG
CTTTTTTTTTTTTTTTTGAGATGGAGTCTCGCTGTGTGACCCAGGCTGGAGTGCAGTGGCGCAATCTT
GGCTCACTGCAACCTCTGCCTCCCAGGTTCAAGCAATTCTCTGCCTCAGCCTCCCAAAGTCACTGGGATT
ACAGGTGCCTGCCACCACACTTGGCTAATTTTGTATTTTTAGTAGAGACGGGGTTTCACCATCTTGGCC
AGGCTGGTCCTGAACTCCTGACCTCATGATCCACCTGCCTCAGCCTCCCAAAGTGATGGGATTACAGACG
TGAGCCACCGCGCCTGGCCCGAAGAAGTATCTTATACTTGCTTTAAAATCACCCACCAGGAGCAGTGGAA
ATGAAACAAGATTAGTCAAGTATTGACAACTATTTTTGGCTTTTTTTTGTTTGAGACGGAGTTTCACT
TTTGTTGCCCAGGCTAGAGTACAATGGCGCGATCTCGGCTCACCATAACCTCCGCCTCCCAGGTTCAAGC
CATTCTCTTGCCTCAGCCTCCCGAGTAACTGGGATTACAGGCATGTGCCACCAAGCCCAGCTAATTTTGT

FIGURE 20 cont'd

```
ATTTTTAGTAGAGACGGGGTTTCTCCATGTTGGTCAGGCTGGTCTCCAACTCCCGACCTCAGGTGATCCA
CCCGCCTCGGCCTTCCAAAGTGGTGGGATTCCAGGCATGAGCCACCGTGACCAGCCTCTTTTTTTTTTT
TTTGATACAGACTCTAGCTGTGTATTTTTTTGATACAGACTCCAGGCTGGAGTAAGGTGGCACAATCTC
ATCTTACTGCACCCTCGACCTCCTGGATTCAAGCAATCTTCTCACATCAGCTTCCCAAGTAGCTGTGACT
ACAGGTGTGCACCACCACACCTGACTAATTTTTATTTTTATTTAATTTGTAGAGATTAGGTTTCACCAT
GTTGCCTAAGCTGGTTTTGAACTCCTGGGCTCACGCAATCCTCCAGCCTTGGCCTTCCAAAGTGCTAGGA
TCACAGGCTTGAGCCACCATGCCCAGCAGTATTGACATTTGTTGAGGCTGGTTAATAGGTATGCCAGCAT
TCATTATACTATTCTCTATATGTTTTTTGTTGTTGTTTATTTGGGTTTTTTTGAAACAGAGTCTCACTCT
GTTGCCCAGGCTGGAGTGCAATGGCCCGATCTCAGCTCACTGCAACCTCCGCCTCCCAGGTTCAAGCAAT
TCTCCCACCTCAGCCTCCTGAGTAGCTGGGACTACAGGTGTGCACCACCATACCCAACTAATTTTTGTAT
TTTTAGTAGAGACGGTGATTCACCATGTTGGCCAGACTGGTCTCGAACTCCTGACCTCAAGTGATCTACC
CGCCTCGGCCCCCAAAGTGCTGGGATTACAGGCACAAGCCACTGCGCCCAGCCTCTATGTTTAAAATTC
TCTATAATGTAAAAAAAAAAAAAAAAAAAAAAAAAGGGCAGGGTGATTACAGACTCTGGAGAGAGAGC
TGTATCTAATTCTGACTCTGCCACACACTAGCTGTGTAACCTTAGGGAAGTTATGCTCTGTCTCTGAGCT
CAGTACCCTCATGCACAAAAGGGAGCTAGTAACAGCACCTTTCTCCAAGGACAGTGGTGGCACTCTGTGC
TGATGGCCATAAAGTGCGCAGTTCCTGGCAGACGGTAAATGCTGAGGGATGTGAGCCATTATCATCTTTT
CTGCCACTCTGGACATAGCAACTTGGTGTTTTAAACTGGCCATGTCTGGAGGAAAGAAAGTCTCCTCTAA
GAGAAAGCAATGACTCCAACTGCTAGCCTTGAAAAACCCATTTATTCTCTAGCCCCAAGTAAGTAATGGC
TATGTTGGATGAATAAGAAAGAGCTTTGTGGTCGAGAGCTGTGGCTCACACCTGTAATCCCAGCTCTTTG
GGAGGCCAAGGTGGGTGGAACACCTGAGGTCAGGAGTTTGAGACCAGCCTGGACAACATGGTGAAATCCT
GTCTCTACTAAAAATACAAAAATTAGCTGGGTGTGGTAGTGGGTGCCTGCAATCCCAGCTACTCTGGAGG
CTGAGGCAGGAGAATTGCTTGAGCCTGGGAGACAGAGGTTGCAGTAAGCCAAGATCATGCCACTGCACTC
CAGCCTAAGTGAAAGAGTGAGACTCCATCTCAAAAAAAAAAAAAAAAAAAAAAAGGCCGGGCACGGTGGCTC
ATGCCCGTAATCCTAGCACTTTGGGAGGCTGAGGTGGGTGGATAACTTTGAGACCAGCCTGGCCAACATG
ATGAAACCCCGTCTCTACTAAAAAAAATACAAAAATTAGCCAGGCATGGTGACACACACCTGTAATCCCA
GCTACTCGGGAGGCAGAGGCAAGAGAATCGCTTGAACCTGGGAAGCAGAGGTTGCAGTGGGCCGAGACTG
TGCCACTGCACTCCAGCCTGGTCAAAAGAGCGAGACTCCGTCTCAAAAAAAGAAAAGAAATACTTAGGTG
TAAATCTAACAAAACATGGACAAAATCTGTATACTGAAAACTACAAAAACTTTGATTTAAAACATCAGCC
TGTAGTCCCACCTACTTGGGAGGCTGAGGCAGGAGAATCACTTGAGCCCAGCAGTTTGAGTCCAGCCTAG
GCAACATAATGAGGAAAAAAATCAAAGATCTAATGTTCTGAAACATAAAAAACAACATAACACACACACA
TATGGCCTCACCCCTTCCACTAGCACCAACTGGGTACAGCCCACAGAGGTCTGATTGGCTTTTGTTGCTT
CTTCTCGGAAGATAGTGATGAGTTCCTCCAAACGCCTTAATTTTACCTCTTCCGGGACATCATCCTTCAG
CCTATGATATGCCCGTGTCTTCTATTAAAAAAAAAAAAAAGAGAGAAGATGGAGGTCACCAAGGACTTGT
AGAATCTATTCTTAATGCACAGAGGGCGACCATGTTCATTCTACCTACAAGTAACAGACACATGTACAGA
AACCCAAGCCAGAGGCAAGAGGTTTCTCTGGCTCTGGGAGCATTCCAAGATAAAAAGGTAGTGGAGTCAT
ATTTTTGCAAGGGTTAAATTCTAAATTTAGCACATGAAAATCATAGACTCAAAATTACTCTTGATATTTA
TCCTAACGTTACACTTGTACATATACCAAATGACTCACATATACTAGGTTACTCAGCAGTACTATTTATG
AAGACATAAGATGCAATGCAGCCTAAATATTTCAATAGGCAAGTAGTCACAGAAATTATGGTTTATCTAT
ACAATGGAATATTGTGCGGCTGTTAAACAGAATGATAGTTCTATATGTACTAATGTGGATTGTTCTCCAA
AATCTACTGTTACTTGAAATAAGCAAAGTGCAGATCAACACATGTAACTTTAGTGTAGACAGAATACATA
CAGGCATGCTTATAAACACACGAAATATGCCCAGAAAGTTACAAAAGAAATTGCTAAGTGGTTGCCTTCA
GGGAAGGAACTAAAAAAACTAGGCAACCTGGGAAGAAGGAAGAACCACTCATGTACAGCACTTAACCTTT
TGAATTTTATTCAAGCATGTATTACCTAGTCCAAAAGAAAAAAGGGAATTTATCCTTAAAACACCTTTAA
ATCATCCAAAACCACAGTGTGTATTATATCTTTATGACATGAGCTCATGCTCAGTACAGCTGGAGAACCA
CTGAGCTAGACAAAAATATGGAATAAAAGGAATATCTATATACCAAAGTTTGGACATTCAAACCAATCTA
CCTTGAAGAGAAGTATCCACGGAGGAAAACGGAGAATCCTAAAAATATTGCAGAGTTTACTCCATTCTGT
CTTACTACTAACAACAATAACTTACCTCTGTTGTGCATTTACTATGCATGAAACACAATTATAACTGCTT
TAAACATATTATCTTACTTAATCCCCAGAACAACCCTATGAGGTTGGTACCAATGTTGGAAACCAAGACA
TTTGCCCAATGTCACGTAGTTATTAAGCAGCAGAGGCACAATTTGAGTGCTTGCTCTCATCCACTAGGTT
CTTGATTAAGTTCCTATAACCTTAACCCTTAGGAATTAGGTCCCAAAGTGAACATTCATATTCACTGACC
ATAAGATGCTTCTGCCACAAGCTGAAAACCCATTTCCCATCCCTAGGATTTTTTTTCTTTTTTGAGACA
GGGTCTCATTCTGTTGCCAAACCGGAGTGCAGTGGCACAATCTTGGATCACCACAGTTTCAACCTCCCAG
GCTCAAGTGATCCTCCGACTTCAGCCTCCCAAATAGCTGGGATCACAGGCATGTGCCACCACTCTCGGCT
AATTTTTTTTTTTTTTTTTTTTTTTTGGTAGAGAAGGGTCTCCCTATGTTACCCAGGTTGGTCTC
AAACTCCTGGGCTTAAGTGGTCCTCCCACCTCTACCAATCCTAGTATTAAAAGAATTTCTCAGGCCGGG
CACAGTGGCTCATGCCTGTAATCCCAGCACTTTGGGAGGCCAAGGTGGTGGATCACCTGAGGTCAGGAGT
TTGAGACCCACCTGACCAACATGGAGAAACCCCATCTCTACTAAAAATACAAAATTAGCCAGGCGTGGTG
GCACATGCCTATAATCCCAGCTACTCGGGAGGCTGAGGCAGGAGAAAACTTGAACCCGGAAGGTGGAGG
TTGTGGTGAGCTGAGATCGTGCCATTGCACTTCAGCCTGGGCAACAAGAGCGAGACTCCGTCTCAAAAAA
TAAAAAAAAAGAATTTCTCTTGGGAGGCTGAGGTGGGTGGATCACAAGGTCGAGAGATCAAGACCATCCT
GGCCAACATGGTAAAACCCTGTCTCTACTAAAAATACAAAAATTAGCCAGGTGTGGTGGCACGCACCAG
```

FIGURE 20 cont'd

```
TAATCCCAGCTACTCGGGAGGCTGAGGCAGGAGGATTGCTTGAACCTGGAAGGTGGAGGTTGCTGTGAGC
CAAGATCATGCCACTGCCCTCCAGCCTGGTGACAGAGCGAGACTCTGTCTCAAAAAAAAAAAGAATTTCT
CTGGCATATTTGTGATGTCCATGGAAAAGAAGCAAAATAGAAGGGGCCAGGCACAGTGGCTCACACCTGT
AATCCCAGCACTTTGGGAGGCCGAGGCGGGCAGATCACGAGGTCAGGAGATTGAGACCATCCTGGCTAAT
GCGGTGAAACCCCGTCTCTACTAAAAATACAAAAAATTAGCCGGGCATGGTGGCGGGTGCCTGTAGTCCC
AGCTACTCGGGAGGCTGAGGCAGGAGAATGGCATGAACCCGGGAGGCAGAGCTTGCAGTGAGTCGAGATT
GCGCAACTGCACTCCAGCCTGGGCAACAGAGCGAGACTGAGACTCCGCCTCAAAAAAAAAAAGAAGCAAA
ACAGAAACTAACAGCTCCTCTGAAGCTTCATCTCTCCAAAACACTAAAAGATACATGAATATGATACATA
CATTGGCACAGTTACGCTGCCCACAGAACACTACGCAGTGGCTTTAAAATGAATTAGTTGAGGTGTCATG
ACTCACGCCTGTCATCTCAGCACTTTGAGAGAGCGTGGTGAAAGGACTGCCTGAGCCAGGAGTTTGAGAC
CAACCTGGACAGCATAGAAAGATACTGCCTCTTAAAAAAACAAAAAATTAGTTTGGTTGATGGCAGCTC
AGTAACAATGACAATAAAGTCATGGGTTCAGTCGTTTGTCAGCCAGCTTTTCTGAGCCCCTGGCCACAG
GGGGCCTTCAACCTCCTGCCCAAACACAAGCACATTGCCACAAAGGTGACTGAGGGAATGAGGAGTGAAC
CGTGCAAATCCATGCCTACAATCAAGAAATGACAGCCAACCAGGACTATCCTTCTCTTCAGGAAAGTG
CACTAATCTCTCCTTCTTTCCTAATCTCCTTCTGCTTTGCCTGGGAATCTGCTTTGTTTCCTGGGAAGCC
TCCAAGTGAGTTCACTTGCCTAGGAAAACAGAAGTTAGGAATCACTGAGGATGGCTGGGAAGATGACCAG
GGGCCCCGGTAAAATAAATCACATCTGCAGACCAAAAGGAGTTCTGCATGTTAAGAAACAATTTTAGGT
TTCTCGTAAAGAAAAGGTTTTCTCCTTCCATATTCAAATTGCAAACAATCTAAACATAATTTTAAATAT
TTTAATGAGGAATACTGGCACAGTAATCATGTATCATCAAATTGCTGAACCGTTTCAGAGTAGACAGAGT
GTACTAGAAAATGAACGGAAGTGAATCGTAAGAGCCTGTGGTTTCTCAAGGACTGCCTTGCCGCCACTC
TCTTTTCTGCCCTGTTCTCTACAGTCACCACCCCCAAACTGGTCAGGAATGATGTCAGTCCTCCCCAACC
CCAGGGCTCACCTGTCTCATGCTGTAGGCAAAGAGGAAGCCCATGTTGTACTGAACTTCCCGGAGCAAAG
AGACTGTCTGGACGTGATCTTCCTCCGTCTCACCACAAAAGCCAGCAATGAAATCGCTGCTGAGGCTCAC
ACCTGTGATACACAGCAAAGGATGACAGGTGACTGCCTGCTGTTTACCTTCAAGGGAGGCCTTCAGCATA
TGTGGATTACAAGGGAGGGATAGCAACTGTAAGGTCCTCCCTAGGACTATTCATAAGTAAAACAAAATAG
TACAGAGTAAGGCGGGATAGGCCTGTTCACCCACAGCATTCCATGACAGAGATCAGCTTCTTGGCCTACA
TTTCCCCTAAGCACTAGAAAAGGTATTTCCACTTCCAATGCTGCATTTAGGGACACAGTAGGGAGTCCAC
ATTTTCATATCAGTCCTCTTACCAGTGAAAACCTTGTGGTGCTTCATACAAAAATATATTTCTGAATTTG
GTTTGATACAATGGTCATCTAAGACAGTAGCAGCCGTTGCATGCGGTAGCTCACCCCTGTAATCCCAGCA
CTTTGAGAGGCCAAGGTGGGCGGATCACTTGAGGTCAGGAGTTCGAGACCAGCCTGGCCAATAGGCAAAA
TCCCATCTCTACAAAAAATACAAAAATTGACCAGGCAGGGTGGTATTCAAGTGTAGTCCCAGCTACTCAG
GAGGCTGAGGTGGGAGGATCACCTGAGCCCAGGGAGGTCAAGGCTGCAGTGAACTGTGTTCATGCCACTG
CATTCCAGCCTGGGCGACAGAATGATAACCTATCCCCCACCAAAAAAATTATTCCAGTGACCCAGTGAGG
TGAGTACTATTAACTCCATTTTACAGATGAGAAAGCTGCATCCCACAGAAATGAAGTCTCTTATCTGCTA
TCACACAGCCTGTAACAGTGGAGCTTGACCCATAGCCACATACCTAGCCTCTGCATTACCCTGCCCTATC
AAAACGAAAGTATTTGTCCATAAAAGTTAAAATAATTAGGCCAGGTGCAGTGGCTCATGCCTGTAATCCC
ACCACTTTGGCAGGCTGAGGCGGCAGATCACTTGAGGTCAGGAGTTCGGGACCAGCCTGGACAACATGG
TGAAACCCTATCTCTACCAAAAAATACAAAAATTAGCTGGGCATGGTGGCCCTGTAGTCCTGGCTACTTGG
GAGGCTGAGGCACAAGAATCGCTTGAACCTGGCAGGCAGAAGCTGCAGTGAGCCGAGATTGCGCCACTGC
ACTCTATCCTGGGCAATAGAGCAAGATTCTGTCTCAAAAAAAAAGTTGTAATAATTAGAAATTTGAGGAA
AAATGTATACACCCTCAACCAAATCTAAACTAAATGACTACAGAGTATTTTATTAGGAGGAAGGGGACAG
TGAAGGGGAATATGGAATAAGATAATACGAAAGGAATTATCTCTAAAATTTACAGTAATAAGTTGCCATA
AAGCTAGTTAGAAAAGTACACATTTTACTGCTGATCTGTACAATCATCTTTATACCTACATTTCCTCAT
TTCATCAAGACTTCTCTGAAGCATATCTGAAAATAAACAACACTGTAACTGCTTTCTTTTCCCACCTAAC
CTGGAAGTTCCCCAAAGGCATAATCTAAGTGTTATTCTCTCCATATTATGCTTAAAGTATTCTAACTCAA
AAGTGATTTTAAAATGTATCTGTAAAATCGGCCTCAAAAAGAAAGTCAAATGTGGTATAAAATATAGAAA
ATGAAGATGAATAAATAAGAATAGTAAGTTCTTATTTCTAAAAAAAAAAAAAAAGATATCAATTGTTCT
CAAATCAGAACTAATTTAGACATAACTTTGTCACCTTACAAGATAAGATAAGGTCTTTCCTCTATGTCCA
GATACAAAGACCATAGAAAGGAATCTCTATAGCCTTGAGGCCACAAGGTGATCCACACCTAAGTACTTC
CAGCAGGACTAAGACAACAAAAATCAGAAAGACATAAAGAAAGAATACGAGGAGAGAGAAAGAGAAAG
AAGAAGAGCACAAAAGTTATGAAACTGTGTCACAAGGAAATGCCAAAGGTGTTGACTGTATCTAACCACA
AGGCTGGTCACTGGTAGAGTAACATGCTCAGCAGAATGAGTTTCTTAAATGTACCTGGAATAGATTCTCT
AATATGGTGAACTAACTCCACATAAGCTTCTCTTGAATATCTGCAATAAGAACAAAAGGAAAAGGCCTA
CATAAATCCAACCTTTTAAATGAATGCTATAAAAAGATAACACTATGAATTTCCACATGTAATCACTTC
TCATCCACATGGCAGGGCACACGAGTAAATTAAAGTATCCAAAAGAGCCCTTTTGATCTAAGCTGTATCT
TCTAATCTAATCTAGAGCCTATGAATTTTTATTTAAGGACATAAACTTTTTTTTTTTTTTTTGAGACAG
AGTCTCGCTCTGTCTCTCAGGCTGGAGTGCAATGGCACAATCTCGGTTCACTGCAACTCAAATTCCTGGG
CTCAAGTGATCCTTCCACCTCAGCCTCTTGAGTAGCTGGGACCACAGATGTGCGCCACCACACCCAGCTA
GTGTGTGTGTGTGTCTGTGTGTCTGTATGTGTGTGTATGTGTGTAGAGACTGGGTTTCGCCATGTTGC
CCGTGTGTGTGTGTGTGTGTGTGTGTCTGTGTGTAGGGACTGGGTTTCACCATGTTGCCCAGGTGT
GTGCATGTGTGTGTGTGTGTGTGTAGGGACTGGGTTTCACCATGTTGCCCAGGTGTGTGTTTGTGTGT
```

FIGURE 20 cont'd

```
GTAGAGACTGGGTTTCGCCATGTTGCCCAGGTGTGTGTGTGTGTAAAGACTGGGTTTCCCCATGTTGCAC
AAGCTGGTCTATTCTCAAACTACTGAGCTCAGGCAATCTGCCCACCACAGTCTCCCAAAGTGCTTGGATT
ACAGGCAGAAGCCACAGTGCCTGGCCAGCATAAACTATTCTAAATAGCTTTTTTTATTTAACTAATAAAT
CTAGACAGATTAAACATTTTAGAGGACCTCTAAAATACTATGCCCTGTGGAAAACAAGACAAAGCACTAA
TTCCATACAGCTTGCCTTGGGACAGATTCTCCCTTCAGTCTCATCTGTGTAATACTTATTATTCTCAAAG
AAAGTGAACACATAGAGCGACATTTAAATTCCAAGATGTAACAAAACCTTAATGTTAACATTAAAAAATT
AAAATCTCAGAGTGTGCCACACCATAGGTGCTTAATTAAAAAAAAACATACTAAACAGTGAAAATGGATG
ACCCAGTCCTTAGCCTATGTTATGGAGTTAGCGAAGCAAGCTCCAGTGCCCTGTGGCTTAGTCATACAAT
AAATACTTACTGTCACACAGTGGCTGCTCAGTAAATATTTATGCTTTTAAACTAAACAGTGAAAATGGG
TGACCAGTCCTTAGCCTTTGCTTATGAAGTGAGCAGAAGCAAACTCCAGTGCCCAGTGGCTTAGTCATAC
AATAAATATTTACTGAGCAGCTACTTTGTGCCACACACTATGCTAGGTTCTTGGCAACAAGGACACTGTT
TGGTCATTAAGGAAACATGGAAAGTGAGGGATGCCCCCTCTCCAAGCAAGCCTGACCCCCTCCGCATGG
CCTCCAACACACGGCTGCTTCCACTCTGGGCTGGCAGGTGGATCTGTTTACAGATGTTATCTCTCTCATG
AATCAGCTGCAGAACCTGATGAAACAGAACACATTATAGGTAATCACAATCTCACCAAAGAACCTTACAG
AAAGCAATACCGCTCTTACTATGTATCCTCCAAGGTCAATTTTCACATAATTAAGAGGCTAATTAAACCA
GACACACAAAATCACCTATTCCCTAACTTTTGTTCAAGCCCCATTCTATTTGTCTCAGACACTTCACCTG
ATGGCATCTCTGCTTTCAAAGAGTAGAGAAGAAAGTAAGCAGAGGTCAGATTAAAGCCATGGAGCTG
AATACAGGTAGTGCTGACACTAGGGTCAGCAGGCAAAGCAGGAAAAAAATGGCACTTCTTTCAGCTAGCT
TACAAAGCAGTCACTTTCTATTTTTTTTTTTTGAGACAGAGTATCACTCCATTGCCCAGGCTGGAGTA
CAGTGGTGCCATCTCCACTCACTGCAACCTCTGTCTCCTGGGTTCAAGCGATTCTCCTGCCTCAGCCTCC
CCAGTAGCAGGGATTACAGGCACAAACCACCACACCTGGCTAACTTTTGTATTTTAGTAGAGATGATGT
TGCCCAGGCTGGACTAGAAATACTGACCTCAAGTGATCCGCCTGCCTCAGCCTCCCAAAGTGCTGGGATT
ACAGGCGTGAGCCACCACGCCCAGCCCAAACTAGTCATTTTTAAAGATACCATCAGGTCAGGTGTCATGG
CTCACCTCTGTAATCCCAGCACTTTGGGAGGCCAAGGCAGGAGGATTGCTTGAGGCCAAGACTTCAAGAC
CAGCCTGGACAACATAGTGAGACCTTGGGTCTATTTTTTTAATTTTAAAAGAAGAAAAAAGAAAAAAA
AAGATACCATCAAAAAACTGATACTAGGGGAAAATATTTGAAAACATATTGACAAAGGATTTGAACCAAG
AATACATAAAGAGGCTGGGCGCAGTGGCTCATGCTTGTAATCCCAGCACTTTGGGAGGCTGAGGTGGGCA
AATCATTTGAGGTCAGCAGTTCGAGACCAGCTTGGCCAACATGGTAAAACCCCGTCTCTACTAAAAATAC
AAAAATTAGCTGGACATGGTGGTGTGCACCTGTAATCCCAGCTACTCAGGAGGTTGAGGCAGGAGAATCA
CTTGAACCCGGGAGGCAGAGGTTGCAGTGAGGCCAGATCACACCACTGCGCTCTAGCCTGGGTGACAGAG
CGAGACTCCATCTCAAAAAAAAAAAAAAAGAAAAAGAAAAGAAAAGAAAACATAAAGAGAACACATTCC
AGTCTCTCCTCCATTGCAAGAAAGGCTCCTTTGCAGTGGTCAAAAAAATAAAGGATATGTAAAGAACT
TTTACAACTCAATAAGAAGACAATCCAGAGGAAAAAAGATGAAAGTCGGGGCCAAAAGAAAGACTTTTCA
CTGAAACAAAAAACCTCCAAAAAAAGGTTTCAGATGTGGGCTACCTACTCCATGCCAGGCACTGTGCTAA
GTACCTTTGACACAATATAGGCATACCTCAGAGATATCACAGGTTTGGTTCCAGATCACCACAATGAAGA
GAATATTGCAATAAAGTGAGTGACACAAATTTTTTGGTTTCCCAGTGCAAATAAAAGTTATATTTACTCT
ATACTGCAGTCTATTAAGTGAAAGCAATGTACATACCTTAATTTCATTATATTTATATTTTTAAATATA
TCGAGATAGGGTTTCACTCTATCACCCTCGCTAGAGTGCAATGAAACTGGTCTCACCCCAACCTTGAAC
TGCTAGGCCAAGCGATCCTCCTGTTCCAGCGTCCCAAGTAACTACGACTACAGGCATGTGCCACCATGCC
CAGCTAATTTTTTTATTTAAAAATTATAGGGCCGGGCACAGTGGCTCACGCCTGTAATCCCAGCACTTTA
GGAGGCCAAGATGGGTGGATCATGAAGTCAAGAGTTCGAGACCAGCCTGGCCAACATCTCTACTAAGTCT
CTGCTAAGAATACAAAAATTAGCCAGGCATGGTGGTGCATGCCTGTAGTCCCAGCTACTTGGGAGGCAAG
GCAGGAGAACTGCTTGAACCTGGGAGGCAGAGGTTGCAGTGAGCTGAGATCGCACCACCGCACTCCAGCC
TGGGTGACAGAGCAAGACTCAGTCTCGAAAAAAAATAAAATAAAAATAAAAATAAAAACTATAAAGTT
GTTATGCTGCCTGGGCTGGTGTCCAACTTGTAGGCTCAAGTGATTCTCCTGCCTCAACCTCCCAAAGTGT
TGGGATTACAGGGATGAGCCACCACTGAATATTTTAAGCTCACTGTTGAGACCTACTGCTTAGGAAAAAA
GATTCCTTTCTAAATATGACTGCTCATTGACAACGCACCTGGTCATCCCAGAGCTCTGAAAGAGATGTAC
AAGGAGATTATTAGTGTCGTTTTATGCCTGCTAACACAATATCCATTTTGCAGCCCATGGATCAAGGAG
TAATTTCAACTTTCAAGCCCTATTATTTTAATTTTAGTTTATATAAGATCAATTCTTATTATTTAAGAA
ATATATTTCATAAAGCTATAGCTGTCGTAGATAGTGACTTTTGTGATGGATCTGGGCAGAGTAAACTGAA
AACATTCCGGAAAGAATTCATCATTCTAGATACCATTAAGAACATTAATGATTCATGGGAAGAGGTCGAA
ATGTCAACATTAATAGGAGTTTGGAAGATACTGATTTCAACATTCATGGATGATTTTGAGGGGCTCACGA
CTTCAGTGGAGGAAGTAACATCCTCTTTAGCATCATTCTTAAGGGCCCTAGGATTTTCAGAATGGCAAAT
CAACACTGGCTTCAACTTAAAGTCACCAGCTGCCTTGGCCCCTAACAAGAGAGTCTGGCTGGGCACAGTA
GCTCCCGCCTGTGATCCCAGCACTTTGAGAGGCCTAGGTGGGAGAACTGCTTGAGGTCAGGTGTTCAAGA
CCAGCCTGGGCAATACGGCAAGACCCCACCTCTAATTTTTTAAAAGGAAACAAGAGACAGAGTCAGCCT
GTCCTTTGAAGCTTTGAAGAATGGCACTGATTTCTCTTCTAGCTATGAAAGTCCCAGATGACATCTTC
TTCCAACAGAAGACTGTTCATTTACACTGCAAATCTGTTGTTTAGTAGAACCACCTTCAGCATTGATCTT
AGCTAGATCTTCTGGATAACTTGCACAGCTTCTACATCAGCACTATGGCTTCCCCTTGCACTTTGATGTT
AGAGAGATGGCTTCTTTCCTCAAACCTTGTAAGTCAACCTCTGCTAGCTTCAAACTTTTCTTCTTCAGCT
TCCTCACCTCTCTTGGGCTTCAGAGAACTGAAGAGGGGCCTTGCTCTGGATTAGGCTTTGGCTTAAGGAA
```

FIGURE 20 cont'd

GTGCTGCGGCTTCTTTGATCTTCTCTCCAGATCACTAAAGCTTTCTCCATATCAGCAAAAAGGCTGGGTT
TTGTTGTTAGTGGTTTTTTTGGGTTTTCTTGTTTTTCTTTTTGAGATGGAGTCTCACTCTATTGCCCAGG
CTGGAATGCAGTGGCACAATCTCAGCTCACTGCAACCTCTGCCTCCCGGGTTCAAGCAATTCTCCTGCCT
CAGCCTCCCAAGCAGCTAGGATTACAGGTCTGCACAACCAAACCCAGCTAATTTTTCTATTTTTAGTAGA
GACAGAGTTTTGCCATGTTGGCCAGGCTGATCTAGAACTCCTGACCTCAGGTGATCCACCCACCTTGGCC
TCCCAAAATGCTGGGATTAAAGGTGTGAGTCACTGCGCCCAGCCTGTGAGCCATCACACCCGGCCAAAGA
GGTTGTGTTGTTTTCTTATCATTCATGTGTTCAGTGGAGTAGTACTTTTAATTTCCTTCATGAACTTTTC
CTTTGCATTTACAACTTGGCTGGTTGACATAAGAGGCCTAGCTTTCAGCCTAGCTCGGCTTTCAACATGA
TTTCCTCAGTAAGCTTAAACATTTCTGGCTTTTGATTTCAAGTGAGAGCCCTGCGACCCTTCCCTTCACT
TGAGCACTTTAGAGGCCATTGTAGGGTGATTAAATGGCCCAATTTCAATATTGTTGTGTCTCAGAGAATA
GGGAGGCCTGAGGAAAGGGAGAGAGATGGGGAATGGCCGTCTGTGGAACAGTCAGAACACACACATCAT
TTACCAATTTAGGTCACTTTCTTATGTGGGTGTGGCTCATGGTGTTCCGAAACAATTTTAAGAATAACAT
TAAATAGCACTGATCACAGATCACCATAACAGATGTAATAATAATGAAGTTTGAAATATTGTGAAAATTA
CCAAAATATGACACAGAGACATGAAGTAAGCACATGCTGTTGGAAAAATGGTGCTGACAGACTTATTCAG
AGTTGCCACAAACCTTCCATTTGTTAAAAATAACTCCATAATATCTGCAGAGTGCAATAAAACAAGGTAT
GCCTTTGTATCTATTTCACAACAACCCAAAGCAGGAGGTAATTGTTAACCCCTTATTAACCCCATTTTAC
AGATAAAGATGAAAAGTTGAAAACATCACATGCTCGCTGGTAAAACAGTGGAAAAGCTGAGATTTGAACC
CGGGTCTGAGGCGAAAGTCTGGGCTGTTTCCAGAGCACCACATCACCTCCTTCCTGTCCACCCCACACC
ACCATTACCGCCCCACCACCATTATTACCACTCAGCTGCCCACTTTGTAACAAATCCTCTCTGTACAGCC
CTCACGGTCCCGCAGGTGGTCTTAACCTCCCGCTGAATATCAGTCCTACCTCCACTCCCACCTTGGCAGA
CTTTTTTTTCGAGACAGGGTCTCGCTATCTCACCCAGGATGGAGTGCAGTGGTGCGATCTCGGCTCACTG
CAGCCTCGACTTCCTGGGCTCATGTGATTCTCCCACCTCAGTCTCCCAAGTAGCTGGAACTACAGTCGTA
TGCCACCTCAGTCTCCCAAGTAGCCAGAACTACAGTCGTATCCCACCCCACCCAGCTAATTTTTTGTATT
TGCAGTAGAGACGGGGTTTCGCCATGTTGCCCAGGCTGGTTTCCAACTCCTGAGCTCAAGTAATCCACCT
GCCTCAGCGTCTCCAAGTGTTGAGATTATTGGTGTAAGCCCGTGCCCAGCCACTGGTGGACTTCAAATC
TTCAAAGGACCAGCAGATCTGGAGGGTGATGCAGCAATACCCCACAGGATCCCTAAGCAGGACTCCAGGT
CTCTGCTGCATCCCTACTGGGTCCAGCCTTTGGCATGCTCAAGAATACTAATATCAGTTTGTCACAGCTA
ACCTGACGCTCACCTCATCAGGAAAATCCTTGGGGTGGGAGAGGTAAAACGGATCCTCATTTCAGGATC
TACTCTGGAGACCTGATCCAGAAGATGAGCAAAACGAAGTCCTCCTTGCTTGGTTTTATAGTTGGTGGTA
AAGCCACGACTGAGATTGGTAGGCACTGCACTGTTGAACTGGACCTCCGAATTGTCCCGAAAACTATTAA
CATTCTGACCAAGAAGTGTCACTTCTTTCAGCCCCTAAACATGGGAAAATATATTGGAATTTTAAAACTT
TTGGGTAGCTTCATAAAAAAACACTAATTAAAAATTAGCTGAAATTAACATATCTTTTGTTTTAAACAAA
AGAAAAATCGAACCTACCAAGAGTCACCTATAAGTGTGTTGTGTCTATAACCGAATAATTTCAAGCTTAG
ACATCTTACCTAAAGAGCTAAACCTAATAAAGCCTTATATAAAAATTAATCTTCAAAACATTATTTAGAA
TCAAAACTGGAAACAAACTCAATAATCCACAATAATGGTTAATTTATGATAGATCTGTCATTTGAATGTT
ATACACCATGACTATATAAAGTATTCTCACCAGAAATATTTAACCTGAACTAATCAAGCTTTTACACCTA
ACTTCCAGTTACTAGAATTCACAGAGATATATTAAATGACAACATGAGGAAAAAATCAGACAAAGGAGAC
TCATGTCTGATCTCTTCAAAAAGTTAATGCATCATTTAAAGAAAACAACAACAACAAAAAATAAAAGAGC
TGTTTTAGATTTTTTTCTTCTTCTTCTTGAGACAGGGTCTCCCTCTGTTGCCCAGGCTGGAGTGCAGCAG
CACGATCATAGCTCACTGTAGCCTCAACCTCCCAGGCTTAAGCAGTCCTCCTGCCTCAGCCTCCCAAGTA
GCTGGGACTACCTTTTTTTACTTTTGTAGAGATGGGATTTCACCATGTTGCACAGACTGGTTTTAAACTC
CTAAACTCAAGCAATCCTCCCACCTCAGCCTCCCAAAGTGTCTGGCTTAAATAACTATTGATTTTCATAC
ATATGATAATGATATCATGGTTATGAAGAGAAAATTGTTACTCATAGAAGATACATACTGAAGTATCTA
GGGGCAAGTGTCCTGAGGTCTACAAATTACTTCAAATGGTTCAGAAAAAATACATTTATGGGTGCATGGA
GATAGGTGTATGACAAAATGTTAACAATCACGTTTTTCTATTATACTAGTCTTTCTATTTGTCTGTTTGA
AAATTTATATTATAGGCCAGGTGCAGTGGCTCCTCCTGAAATCCCAGTACTTTGGGAGGCCAAGGTGGG
CGGATCACACGGTCAGGAGTTCAGACCAGCCTGGCTAACATGGTGAAATCCCTTCTCTACTAAAAATACA
AAAAATTAGCTGGGCGTGGTGGCAGGCACCTAATCCCAGCTACTAAGGAGGGTGAGGCAGGAGAATCGCT
TGAACCCAGGAGGCAGAGGCTGCAGTGAGCCGAGACCATGCCACTGCACTCCAGCCTGGGCAACAGAGCG
AGACTCCATCTCAAAAAATAGAAATGTTATATTATAAAGTTTCACAAATAATGGTTGCTAAAAAAGACTT
GTTTTGTAACTTTGACATAATTTACAGACAAACTGCAATATTAAAAGAATTCCCATATACTCTTTGCCCA
AATTCATCAAATGTTAACACTGCACCCCATTTGTTTATCATTCACATTCAGACACTCATATACACTCTCT
CTCAACACACATATGACTACATTTTTTTAAGCCTTCTGAGAAAAGTCACAGATATCATACTCTTTTAC
TTCCAAATATTTTAGTATATATTTCTTAAAAACAAGGGCATTCTCCTATATAATTTCAGGACAATTATCA
AAATCAGAAATATTGATACAACACTATTATCTACTTTCCATAAATCAAATGTTACCAATAGTCCAAATAA
TGTTTGTTGTTGTTGTTGTTATTGTTGTTTTTGAGACAGAGTCTCACTCTGTTGCCCAGGCTGGA
GTGCACTAGCGTGATCTTGGCTCACTGCAATCTCCGCCTCCCAGGTTCAAGCGATTCTCCTGCCTCAGCC
TCCTGAGTAGCTGGGACTACAGGCGTGTGTCACCACGCAGGCTAACTTTTTGTATTTTTAGTAGAGAC
GGGGTTTTGCCAAGTTGCCCAGGCTAGTCTCAAATCCCGGAGCTCAGACAATCTGCACACCATGGTCTCCC
AAAATGCTAGGATTACAGGTGTGAGCCACCACGCCCAGCCCAAATAATGTTCTTTATAACATTTTTTTCC
CTGATCAGAATCCCAATCGAGGACCGTGCGATGCATTTAGTTGTCATAACTCCAGTCTCCATAAAGGCTA

FIGURE 20 cont'd

```
TTTATTTGTGTAAGTTGTGACATACTGTTAATCTAAAAAGCAGGATATACTAAATGCAATGTGGATCCTA
GATTGGATCCTGGAAACGAAGTAAGACATTAGTGGAGAAACTGGCAAAATCCAAATAAAGTCTGAAGAGA
GTTAATAGTAACATACCAATATTAATCTCTTAGTTTTTGCTTTGTTTGTTTTGTAATAGAGACAGCAGCT
CCCAGTGTTGCCCAGGCTGGTCTTGAACTCCTACGCTCAAGGCACCCTCCTGCCTTGGCCTCCCAAAGTG
CTGGGATTACAGCACCAAAAAATGTACCAAAGAAAGATGGCAATGCTCGAGGAAACTCTCTTTGCAACTT
TCCTGTAAATGTAAAGTCATTCCAAAACAAAAAGTTTATTAAAAAGTAGGATATAAAACTAAGTAAAATA
CACACACATATATAAAAAGACATACAAACCAAATGCAGAATGACTTAAGGAACAATTGGGGAACTCCGAA
TAAGGATGAACTGGAATGAGACAGTATTTAGCAATTTTTGTTAATCTTACTGGAAGAACTAATGGTATTA
AAAATATTCTTGGCCAGACACGGTGGCTCATGCCTGTAATCCTAGCACTTTAGGAGGCCAAGGCGGGTAG
ATCACCTGAGGTCAGGAGTTCGAGACCAGCCTGCCCAACATGGTGAAACCCCGTCTCTACTAAAAATACA
AAAATGAGCTAAGTATGGTGGCGCATGCCTGTAGTCCCATTTACTCAGGAGGCTGAAGCAGGAGAATCAC
ATGAACCCAGGAGGTGGAGGTTGCAGTGAGCTGAGATCGTGCCATTGCACTCCAGCATGGGCAAAAAGAG
CAAAATTCCGTCTCTAAATAAATAAATAAAATAAAATAAAAATATTCTTTAGCAGCACATGGTGGTACGT
GCCTATAATCCCAGCTACTCAGGAGGCTGAGGCAGGAGGATCACTTGAGTCCCGGGGGCAGAGGTTGCAG
TGAGCCAAGATCATAACACTGCACTCCAGCCTGGGCAACAGAACAAGACTCTGTCTCAAAATAAATAAAT
AAATAAGTAAATAAATAAATAGGCCAGGCACAGTGGCTCACACCTGTAATCCTAGCCCTTTGGGAGGCTG
AGCCGGGTGAATCACCTGAGGTCAGGAGTTTGAGACTAAGCCTGGCCAACATGGTGAAACCCCATCTCTA
CTAAAAATACAAAATTAGCTGGGTGTAGTGGTGCACACCTGTAATTCCAGCTACTTGGGAGGCTGAGGCA
GGAGAATCACTTGAACCTGGGAGGCGGAGGTTGCGGTGAGCCAAGATTGTGCCATTGCACTCCAGCCTGG
GCAAAAAGAGCGAAACTCCATCTCAAAAATAAATAAATAAATAATAAAAAGATTTTTAAATGTTTA
AAAAAGAAAATATCCTTATTTTTTAGAGATGCATACTGAAGGATGAAACAACATGCTCTACTTTGAAATA
CGTTTTCAATAAGAAAAAAATAAATGAGGCCAGGCGTAGTGGGCTCACACCTGTAATCCCAGCACTTTGG
GAGGCCGAGGCGGGTGGATCACTTGAGATCAGGAGTTTGAGACCAGCCTAACATGGTGAAACCCCGTCTC
TATTAAAAATACAAAAATTAAGCCAGGCACAGTGGCTCTTACCTGTAATCCCAACACTTTGGGAGGCCGA
GGTGGGAGGAACACCTGAGGTCGGGAGATCGAGACCAGCCTGAACAACATGGAGAAACCCCGTCTCTACT
TAAAAAATACAAAATTAGCCAGGCGTGGTGGCGCATGCCTATAATCCCAGCTACTCGGGAGGCTGAGGCA
GGAGAATCGTTTGAACCCGGGAGGCGGAGGTTGTGGTGAGCCGAGATCACACCATTGCACTCCAGCCTGG
GTAATAAGAGCAAAACTCTGTCTCAAAAAAAAAAAAAAAAAAAATCAGCCAGGTGTGGTGCCAGGCACC
TGTAATCCCAGCTACTCAGGAGGATAAGGCAGGAGAATCGCTTGAATCTGGGAGGTGGAGGCTGCAGTGA
GCCGAGATCATACCACTACACTCCAGCCAAAAAAAAATAAAAATAAAGTAAATGAAACAAATATGGCA
AAATGCAACAATTGTTAAATTTAGGTGATTGTTAGCTGGGGCAGAGGGGTCATTATACTATTCCCTCTTT
TCAGTATATTTAAGTATTTTTCATATAAAAGATTAAAAAGACTTTTTATAAAAGTTGCTTATTTAGAAG
ACTTCCAATAGATAACCATTGTTTGAATGAATAAACGGACATTCTGTTAAAGGTACAATATTCTATACTC
TTTGCAACTGTAGTCTAAAAAATCTAAATGAAAGAAAAAAAATCTTTAAAAATTACTAAACAAGCAAAT
TATTAAGTGACTAACAGATACTTTAAAATACAAGTAAAATCTTAATTTTCCACAAGTCTATGGCCTTGAA
TTCACTAAGATTCACTTTAATGTTATTAAGTTCCTTCTTTTATAGGCAAATGGCCTAGAAAGGTTGGGGA
GTTTTGTCACCATCTCAGTCTATTTAAACAGAATGTCTCTATCCTGAAGGAGTGAGTTTTGGTACTGAGG
GAGAGCTGGAAGGGGAGAGGAAGGAGACAACTTTAGACCAGGAAGCACTTGGAGAGGTGGGGTATGGAAA
ATGCCTCACAGAGCAGGGGAGCAGCTAGGGGCCAAATCAAGGAACTGATTATCTGGGGGTAGGGCAAGAG
AAGACAGCACTGCCAGAATGTGAGGATGATAGCAAACTGGTGACTTAGAACTAGAGCAGGGAGGCCAGGC
ACAGTGGCTCATGACTGTAATCCCAGCACTTTGGGAGGCCAAGACAGTAGGATTACTTGATCCCAGGAGT
TCTAGACCAGCCTGGGCAGCATAGTGAGACCCTCATCTCTACAAATAATTAAAAAATTCACTGGGCGTGGT
GGCACCTACCTGTAGTCCCAGCTACTTGGGAGGCTGAAGTGGGAGAATTGCTTGAGTCCAGGCAGGTGAT
GCTGCAGTGAGCTCTGACCACACCACTGTACTCCAGCTTGGGTGACAGAGTGAAAGCCCGTCTCAAAAAT
AAAAAATAAAAAAGAACTGGGGCAGGGGCTACCCTGGCCCTCTCCCATGATTCCTGAGCCAAACAAGTA
AGGAAGCAGGGAGACACCACTGTTAGGAAAAGCCACCATATTCCCACCTATTGTCCTCTTCTGCAGGGGT
AGCAGATTCAGGCCCGGGGCTAAGGAAAAGACCTCCTCAAAAGCTGAGGACCAGCTCCCAGTGGGAGAAA
GAAGAGCAGATCTCCCCTGTGGCTTCTGATCCACCTTACTCCCCTCATCTATTCTGTCCCTCAACTAGTG
AGCTGGCTCAGTGATAAAATGAACAATAAATCTGGGAGTTTTTCCTGGAAGAGACAAATTCATAATTTCT
CAAAAACTTAGCTATGTGCCAGGTAATTTAAAAACTTTTCCTCCAATCCTTCTAATAACCCTGCAAGCAA
GGTATTATTTTATTCTCTTTTCACAGATGAGGAAACTGCATTACGACGACAGTTAAATTGACATGCCTAG
GAACCAAGCCAGAATTCACACTCCATCACCTGACTGTAATCTCATGCCCTCTCCATCCACCATGCTGCCT
CCATAGTGGAGCTCTGTAATTTGTGGGCAATAAACCAATGATGTACACAAAAGTAGTTCTTTCTGGCCAG
GCATGGTCCTAAACTTTAATAAGTCAGAGACAGCATAGGCTCAAAACTACAAAGGTTATCCTCATCCTCC
CCCAAACATGTTCACAGCAAGAAAGCCTGGAGAACTCTTCACCTGCTCAGAAAGCTTCTTCACTTCCTCT
AGAATGGAGGCAATAGGCCGACTCCTCTCCCTGCCCCGGGTGAAAGGAACAATGCAGTAGCTACACATGT
TGTCACAGCCTCGCATGATTGACCTGGAGAAGAAAGTACCAGAACTTAGTAACAGTAGCAGGGTGTGCTG
GTATGACCCAAGGAGCAGGACTCAGCTTCAATAGCATTATTCTTTGGCTCTGAATCCTCTTGCCACAATG
CTCACACTGGACCAATCTGAGATCTAAGCACTAAAGTAGACCTTTTTATCTTTAAAAATTGGTATCTAA
TCACAAAATATAAACCAAACTATAACCAGTGGGACAATGACCTAGCCTGAGGAAGCACAGCGGTGAGGAGC
TAGAATATACACTTACCACACTTGGACTTTCTACTGTTTTTTTGTTTTGTTTTGTTTGAGACGGAGTCTC
```

FIGURE 20 cont'd

```
ACTCTGTCACCAGGCTGGAGTGCAGTTGCAATCTCGGCTCACTGCAACCTCCACCTCCCAGGTTCAAGTG
ATTCTCCTGCCTCAGCCTCCTGAGTAGCTGGGACTACAGGCGCCTGCCACCACGCCCGGCTAATTTTTGT
ATTTTTAGTAGAGATGGGATTTCTCCATGTTGGCCACGATGGTCTCGATCTTTTGACTTCATGATCCACC
CACCTCAGCCTCCCAAAGTGCTGGGATTACAGGCGTGAGCCACTGCACCTGGCCCCTCTACTGTTTTTAA
ATTCTTTTTTTCCAGACAGCCTGAATATGTTTGTACCTACTGTTTTTATGAGTATATTATCTGAACTTTTT
ACATCCAGACCAGAAAAAAATAAATATTATAAAGTGTGTGTATATGTGTGTATATAGGGCAAGGAGACCC
TGGATTTAAAACACAGAATTCTACATTTCTCACGCCTTCCTGATCCAACTGTTAGGTATCGAAGTTAAAT
CGCTCTCTTTAATTCACATCCTGTATGTGAAAGCCTCAATCTATCTGAAGGAAATAATTACGGCTATGTA
TCAAAGACGTTCACTGAAGAATTATGTAATAAATGTTAGCTATTATTCTTACTAAGCATTCCAACAAGAG
AATATTATATAGCCATTAAAATAAACAGAGGTTGACAAACTTTTCTGTAAAAAAAAAAAAAAAACCCTAT
AGTAAATATTTGAGACTTAGCAGGCTATAGTCTCTGTCCCAAGTATTTAACCTTGCTTTAGTGGCAAAAG
CAGCCAGAGGCAATATGTGAATAAATGGGCATGCTTGTATTCCAATAAAACCTTATTTACAAAAAGAGGT
AGTAAGCTATTTGGCAACCTCTGTTACAGAAAATTTAATGCCATGGCCAGGCGCAGTGGCTCACCCTTAT
AATCCCAGGATTTTGGAAGGCTGAGGTGGGAGGATCACCCAAGCTCAGGAGTTTGAGACCAGCCTGGGCA
ATATAGTGAGACCCTATCTCTGTAAAAATTCAAAAAAAAATTAGCCAGGTGTGGGGTGCACACCTGTAG
TCCCAGCTACTCAGGGGACTAAAGCAAGAGCCAGGAGGTCAAGGCTGCAGTGAGCCCTGATCATGACAC
TGCACTCCAGCCTGGATGACAAGAGTGAGACCCTGTCTCAAAAAAAAAAAAAAAAGTGTGAAGGAGGAA
GAGGCTTATTCCCTATCTCTTAGGCAGTGACTCACACAAAGGCAGACGTGGCACTGGCGCTTGTCTGGAC
TGGCATGACATCAGCATAGGTCTCGTCCAGAGAGAGCAGCACGTTGGCAGCTTGCTGGCCCGACTCAGCA
ACAGCCAGCAGCCGGGAAGGTCCCGGTAGGCATCAGGACCAGCCAAAATATCTACCATTTTCTCTCTGT
TGAGAATCTCCTCCTTCAACCTCTCAGCCATGCAGCCTGGAAGGGAAAAAGAAACAAGCACCTTTCCCCA
AATCCACCTGGTGTTTAATGGCTTCTTCTTATTCCACTTTATCTGTAGCTGGGATTAGAGACCAGGGCAC
AGAAAACTTCTCTAAGAATTGAGTATCATCCTTCAAATTTAACCAACACTCCCATCGCACTGGAGCCTGT
ATCTTCCTATATAAGAAAACCAGAAAAGGGTTCCAGAGCAATTCAATTAAATGCCCAGAAAAAAATTA
AACCACCAGCCAGGTGCGGTGGCTCATGGCTGTAATCCCCACACTTTGGGGGGCCGAGGCAGGCGGATCA
CCTGAGGTTGAGAGTTCAAGCCCAGCCTGACCAACATAGAGAAACCCTGTCTCTACTAAAAATACAAAAG
TACCCAGGCATGGTGGCACATGCCTGTAATCCCAGCAACTTGGGAGGCTGAGGGACAGGAGAATCGCTTG
AACCCAGGAGGCAGAGGTTGCGGTGGGCCAAGATCGCACCATTGTACTCCAGCCTGGGCAACAAGGGTGA
AACTCCGTCTCAAAAAAAAAAAAAAAATTAAACCACCACCCACAAACCTTTCAAGACATGAACCATGTCT
TCTTTCAACTGAAAATTACTTAGTGCTGAAATAAAAAGTATTCTGTGTCTGGAACTTACTTACCCACAAC
TACACTTGAACCCTTTCCCTCTCTTCTAGCCTATAATACTTGCTAAAACCTGTAAGAAATGAGTAAGCCA
TTTATGCTGTTATCTTCCATATCCTTAAAAAAATTATGTTATTAAAGTTATAATATCTTAAAGTCCACTT
TATTACAAATACCCTTTGAAAACACTTAACAGCTATTCTTGTTTGTATGCCCATGTTCATAGCACTATTA
TCCACAATAGCCAAAAGGTGCAAGCAACCCAAGTGTCTATTAATGAATGAAGAGATATTTGCATCTACGC
AAAGCCAGTTAAATAAATAATTTTTCAGCTCCCTCTCCCTCTCCCTCTCCCTCTCCCCTCTCCCTCTCC
CCCTCTCCCTCTCCCTCTCCCTCTCCCCCTCTCCCTCTCTCCTTCTCCCTCTCCCCACAGTCTCCGTCTC
CCTCTCTTTCCACTGTCTCCCTCTCCCTCTCTTTCCACGGTCTCCCTCTGATGCCCAGCCAAAGCTGGAC
TGTGCTGCCGCCATCTCTGCTCACTGCAACCTCCCTGCCTGATTCTCCTGCCTCAACCTGCCGAGTGCCT
GCGATTGCAGGCGCGCGCCGCCACGCCTGACTGGTTTTCGTATTTTTTGGTGGAGACTGGGTTTCGCTG
TGTTGGCCGGGCTGGTCTCCAGCTCCTAACCGGGAGTGATCTGCCAGCCTCGGCCTCCTGAGGTGCCGGG
ATTGCAGATGGAGTCTCGTTCACTCAGTGCTCAATGTTGCCAGGCTGGAGTGCAGTGGCGTGACCTCCGC
TCGCTACAACCTCCACCTCCCAGCCGCCTGCCTTGGCCTCCCAAAGTGCCGAGATTGCAGCCTCTGCCCG
GCCGCCACCCCGTCTGGGAAGTGAGGAGCATCTCTGCCTGGCCGCCCATCGTCTGGGATGTGAGGAGCCC
CTCTGCCCGGCTGCCCAGTCTGGGAACTGAGGAGCGCCTCTTCCCGGCCGCCATCCCGTCTAGGAAGTGA
GCAGCGTCTCTGCCCGGCCGCACCCATCGTCTGAGATGTGGGGAGTGCCTCTGCCCCGCTGCCCCCTCTGGG
ATGTGAGGAGCGCCTCTGCCCGGCCGCGACCCCGTCTGGGAGGTGAGGAGCGTCTCTGCCCGGCCGCCCC
GTCTGAGAAGTGAGGAGCCCCTCCGCGCGGCAGCCGCCCCGTCTGAGAAGTGAGGAGCCCCTCCGCGCGG
CAGCCGCCCCGTCTGAGAAGTGAGGAGCCCCTCCGCCCGGCAGCTGCCCCGACTGGGAAGTGAGGAGCGT
CTCCGCCCAGCAGCCGCCCCGTCCGGGAGGGAGGTGGGGGTCAGCCCCGCCCGGCCAGCCGACCCGTCA
GGGAGGGAGGTGGGGGGGTCAGCCCCGCCCGGCCAGCCGCCCCGTCCGGGAGGGAGTAGGGGCAGCCC
CCGCCCGGCCAGCCGCCCCGTCCAGGAGGTGGGGGCGCCTCTGCCCGGCCACCCCTTCTGGGAAGTGAG
GAGCCCTTCTGCCCGGCCGCCACCCCGTCTGGAGGTGTACACAACAGCTCATTGAGAACAGACCATGAT
GACGATGGCGGTTTTGTTGAATAGAAAGGGGGAAATGTGGGGAAAAGATAGAGAAATCAGATTGTTGCT
GTGTCTGTGTAGAAAGAAGTAGACATAGGAGACTCCATTTTGTTCTGTACTAAGAAAAATTCTTCTGCCT
TGGGAAAAAAAATAATTTTTCAATGAACAAACAAATGTACTACATATACACAATGGAATTTTTTTTTT
TTTTTACAACGGAGTATTACTCAGCCTTATAAAGGAAGGAAATTCTGGCCAGGTGCTATGGGTCACACC
TGTAATCTCAGCACTTTGGGAGGCCAAGGAGGGTGGATCACTTGAGCCCAGGAGTTCAGGATCAGCCCTG
GCAACATAGTGAGACCCACATCTCTACAAAAAATAAAAAATTAGTCCTCGTGGAACGTGCCTGCAGTCC
CAGCTACTCAGGAGGCTGAGGCAGGAGGATTGCTTGAGCCTGGGAGGTTGAGGCTGCAGTGAGCCATGAT
CACGCCACTGCACTCCAGCCTGGGCGACAAACTGAGACCCTGTCACCAAAAAAAAAAAAAAGAAGGAAATT
CTGACACAGGCTACAACAGGTAACCTCATGAACCCTGAGGACATTATGATAAGCCAAATAAGACAGTCAC
```

FIGURE 20 cont'd

AAAAAAGACAAAATTGTATGGTTCCACTTACATGAGGTATCTAGAGTAGTCAGATTCATAAACAGAAAGT
AGAATGGTGATTGCCAGGGGCTGAGGGAAGGAGGAATGGGGAGCGTGTGTTCAATGGATATGTAGTCTCA
GTTTGGGAAGAGAAAAAGTCCTGCAGATGGATGGTGGTGATGGGTGCAAAACAATGTGAATATACTTAG
TGCCACAGAAATATACTATTAAAAGGATTAAAATGGTAATTTCATATATATTTTACTACAGTTTTTTAA
ATTATTCTTGGGATTTCTGAAATTCTTATTAGATATACACCCTGAGGCTTCTACAGTGAAGGAACTGAAA
TGGAACAGAACATTTCAGCTGACCCTTCCATCCTCCTGCGTCAATTACTACATGGATCTGATAACTAAAT
ATGCTCCATCTGTGTGTGGACCCATCGTTAGGAGAGATTAATTTAACTATTCCACAATGGAGATAGTCTG
TTTTTCCATAATGTTAAATACATTAACTAAATTCTGAGACAGAAAAGGGTAGAGAAATGTCTCCAGTCAT
ATAGATCAGAACTGCCCAACATAACTTTCTAATAAGATGATAGGCCTGGTGCAGTGGCTCACACCTATAA
TCCCAGCAATCTGGGAGATTGAGGCAAGAGGATCACACTTCAGCCCAGAAGTTCTAGACCAGCCTGGGCA
ATATAGCAAGACCCTGTTTCTACAAAAGGTCAAAAAATTAGCTAAGTGTGGTGGTACACACCTGTAGACC
TAGCTACCCAGGAGGCTGAGGTGAGAGGATCATTTGAGCCCAGGAGTTGGAGGCTGCAGTGAGCCATGAT
CATGCCACTCCAGTCTGGGCAACAGTGTGAGACTCTGTTTTTAAAAAAAAAAAAAAAAAAAAAAAGGATG
ACAGAGTGTGCTGGATGGAAAAATAATTGCGCTGTACAAACTGGTAGCCCCTAGTCATGTGGTCATGTGT
GGCTACTGAGAAGTTGAAATGTGGCTAATGGAACTAAAGAAGTGAATTTTAAATTTTATTTAATTATAGG
TAAATTTAAATAGCCACATGTGGCTAGTGGTTACCATATTGGTGAGGCAGACCTAAATCTTCACTTGAGC
TTGCTTCAGGAGTCAGAATGAAAGGTACCCACATTAGAAATTTGTGCTGTCAGGCCAGGCACGGTGGCTC
ATGCCTATAATCCCAACACTTTGGGAGGCTGAGGCAGGCGGATCACCCGAGGTCAGGAGTTCGAGACCAG
CCTGACCAACATGGGGAAACCCGTCTCTACTAAAAATACAAAATTAGCCAGGCATGGTGGTGCAAGCCTG
TAATCCCAGCTACTCGGGAGGCTGAGGCAGGAGAATCACTTGCACCCAGGAGGCAGAAGTTGCGGTGAGC
CAAGATCTCGCCATTGCACTCCAGCCTGGACAACAAGAGTGAAACTCCATCTCAAAGAAAAAAAAAAAG
AAATTCAAGCTGTCCCTTCAGACTCCAACTCTACCCATAACTCTGTGCTACCATGAGCCGCATTAGACTC
TAGGCAGGATATACCACTTTCTGAGCACCTATTACTTCAAGGAACTACGGAAAGCCCTTTCATGAACTTT
ATCTCATTTAATCCTGTCACCTCTGGCAGTAAGTACAAGAATTGCATGGGATATATAAGATTTCTTCAGA
CACTGGGAATCCAGCCTCTAAAGGAAACACTAGCAAATAAAGCCACATAAAGTCCAAGTTTCAAAGCTGA
CAAAATGTGCAAATTACCAGATACCTAGAATTCCAATCCTCAGAGGAACCCGGGAGCGGGGCCGCCTTGT
CTTCAAGGCTTTAAGCTGATGTAAACGGTTCCAGATGGTCTGCTCAGCCTTCTCCCTAGAGAGATCAAAG
GAGGCAAGACTGAACCAAAAATAAACCACAGAGGTATCTAAGAGAGTAGGTCAGTGGGAAGAAAATAAAA
ACCACCTTCAACCCTTTAAATCAAGCTTTTCCAACCTGCAGCCCACGGGCCACATGCAGCCAGGATGGCT
TTGAATGCAGCCCAACACAAATTCATAAACTTTTGTAAAACATTAGGAGATTTTTTGGGGGGATTTT
TTTTTTTTTTTTTTTAGCTCATCAGCTATTATTAGTGTTAGTGTATCTTATGTGTGGCCCAAGACAAT
TCTTCTTCTTCCAATGTGGCCCAGGGAAGTCAAAAGATTGGACAGCCCTGCCTTAAATGTGTATCTG
CCATTCAGACTTACGGAAGGTAGGTAGGGGCCACCTGAAGAAGCAACACTTGCTATAATTTACCTTTCC
TAAAATGACATCCTTCCTACACATCTTCAAATCCTGAAAAGCCTTTAAGCCAAACTCAAAAACAATCTAC
TTCACAAGGCCTTCCAGTTCTCCTCTGTTGGACAGTTTGTCCTCCCTTTAACTGCCCTTCAACTTTTTT
TTTTATGATTCCAGATCCTAATGCCCTTCTACTTTAACTAGATTTTTCCCTATACTTAGCAATTTCTCCT
TTTTTTTTTTTGAGATGGAGTCTCGCTTTGTCACCAGGCTGGAGTGCAACAGCGCGATCTCGGCTCACTG
CAACCTCCAACTCCCTGGTTCAAGCAATTATCCTGCCTCAGCCTCCTGAGTAGCTGGGATTACAGGCGTG
CACCACCACGCCTGGCTAATTTTGTATTTTTAGTAGAGATGGGGTTTCACTATGTTGGCCAGACTGGTC
TTGAACTCCTGACCTCATGATATGCCCACTCTGGCCTCCCAAAGCGCTGGGATTACAGGTGTGAGCAACC
GTGCCTGGCCAGCAATTTATCTTTTATTTTTCTTTGTAGATACAGGGCTTTACTTTGTGCCCAGGCTGGT
CTTGAATAGTTCACTGTAGCCTTGAACTCCTGGACTCAAGTGATCCTCCCACCTCGGACTCCAAGAGTGC
TGGGATTATAGGTGTGACCTACTACACCCAGCCTCATTGTTTGATTTTTTTGAACTAGCATTTTTTGCC
AGATGTTGGAGCTATTTGTTCATCTATCTTAGTTCCCATATCAGACTAGGCTCCTTAAAGCCAGGCCATG
GAAGAAGGGTTCATTTCGGAATCACCCAAAGCACATAGTTCAGTGTCAAGCAGCAGAGGCCTACAGAACA
AAAATGTCAGATGAATTAATTGACAGTATAGCCGGATAGGGAAACATTAACACTAGCATGTCTTGAACAC
AGAAACAAAGTGAGAAGGAGGTACGTTCACCTCTGATGGGAGTCACCCATCTCTACTCAAAACTCCCCA
AGCCTATGACTACATCCTACCCCGGGCAGCTATATTATAAACATATGCCATTAGTTACAAAACAAAGCTC
AGGAAGAGCTGAGTGGCTCGGCACATTCTTGGTGTCCTCATCTATAACAGCACCAACCACACAGGGTTGT
TGTGATCATTAAATTTGTTAATGCATTATGTTACTCACTCAGAACCTGACACCACGGTACATGCCCAGCC
AATGTCAGCCAGTTGTATAAAGACTATCTCCACTGTGGGAAAACTGCAAGTCCTACTGCCATGGGCCAC
TGGCTCATCTCCATAGACAGCCAGGCCAGGCACTGTTAGCTCTGGCATTATTACATAAAATACATTCACT
CCTAGGAAAAGAACAAATTCGCACCTGATAGAGCATGTGACAAGGAGAATCACATCTGCCTGAATGGAAA
GAAAGGAAACAAGGAAAATTACATAATATCTTGGATATTAGCCTTGTACAATTCCTGCCCTACAGCTCT
TTATTATTTTTTTTCCTTTTTTTTTTTTGAGACAGAGTCTCACTCTGTTTCCCAGGCTGGAGTGCAGT
GGGGCAATCTCAGCTCACTGCAACCTCCACCTCCCGAGCGGTTCAAGCAATTCTCCTGCCTCAGCCTGGG
ATTACAGGTGCCCACCACCACGCCCAGTTAATTTTTGTATTTTTAGTAGAGATGGGGTTTTACCATGTTA
GCCAAGCTGGTCTCGAACTCCTGACCTCAAGTGATTCACCTGCCTTGGTCTCCCAAAATGCTAGGATTAC
AGGCATGAGCCACTACACCCGGCCTATTATTTTCTTTAACTATTTTTTCCTTTTTTTTTTTTTAAT
AGAGAAAGGAGTCTCGCTCACTTGCCCAGGCTGAAGAGCAATAGCATAACCATAGCTCACTGCAGCCTCA
AACTCCTGTCTTCAAGCAATCCTCCTGCCTTGGCCTCCCAAAGTCCTGGGATTACAGGCATGGTGACCCA

FIGURE 20 cont'd

CACCTGGACATTTTAACCATTTTTAAGGGTACAGTCCTGTGGCATTAAGAACATCTGCAATTTCATAACT
ACGCATTTTCCATAACTTTTTCATCTTCTGCAACTAAAACCCTGTACTCGTTAAACAGTAACTCTCCAAC
TTCCCTCTCCACAGCCAATTCTTAACTTAGCTCCTTGTCTGAAGGCGCACATCACCATAAAAGTTTCAAA
AACAGCTGGAACAAAAGTACAACTCAGTCCCATGGTGAACACTTCACCCAAGGGAACTCTCTCTCACCAG
GGGGCACCCTGCTCCTGAAACTACACCTAAGAACTGGCACAAATGCAGAATCTTGCCCAGGTCCAGGAAA
CAAAGGAAATAGGAAATGCATGTACCTCTTGGAGGTTACTGGTCCGCAGGTAGCCACTCTTCTGTAAGAT
GGACCAGGCTATCTCTGTGTCATTCACATTCATCTGGCAGCCATAGGTCTCGAGGTAGACTGCAGTGAGA
GGTTGGGGGGAATCCATGGTAGACAGACAACAAGGGGTCTCGTGTCTCAAAAGGTCTCCTTCCCAAATGC
TCTAGAAATATCTGAGGCATCTGGTTATCCACTAAGTCCCCTATTGCTTCAATCTTAAGATAACATAAAT
TGCCAGATGTACCCCCAAGTTAATGATAGACCTTCAGAACAAAAGAAATACCATATTAGGCTGGGCACAG
TGGTTCATGCCTATAATCCCAGTACTTTGGGAGACTGAGACAGGAGGATTACTTAAGCCCAGGAGTTTGA
GACCAGCCAGGGCAACATAGGGAGACCCTGTCTCTACAAAAAATTTAAAAATTAGGCAAGTGATACATGC
CTGTGGTCCCAGCTACTCAGGAGGCTGAGGTAGAACTGCTCGAGCCCAGGAGACTGAGGCTGCCGTGAGC
CATGATCACACCACTGCACTCAGCCTGGGCAATAGAGTGAGAACCTGTCTCAAACAAACAAAAAAATATA
CCACATTATATATCCACACCAATTACAAGCCATGTTATCTTTTAAATGGGGAAAACATGTACCTGAGAAT
CAAGGAAATATAGTTATAAAAACAATTAGAAAAGGAAGGACTAGGCCGAGGGTGGTGGCTCACGCCTGTA
ATCCCAGCACTTTGGGAGGCCAAGGCGGGCAGATCACTTGAGGTCAGGAGTTCGAGACCAGCCTAGCCAA
AATGGTGAAACCCAGGTCTCCACTAAAAATACAAAAATCAGCCAGGTGTGGTGGCGTGCACCTGTAATCC
CAGCTACTCAGGAGGCTGAGGCAGGAGAATCACTTGAAGCCAGGAGGCAGAGGTTGCAGTGAGCTGAGAT
CGCACCATTGTGCTCCAGCCTGGGCGACAGAGCGAGACTCAAAAAAAAACAAAAAGAAAAGAAAAGGAA
GGGCTAACTGATAGTGTTCATCAGCCTGAAGGGAAAATAAGTTTAAATCCACATGTTACACTCCTCCTCA
AAATAAAGAGGTTTTCCAGCCTCTGGAAGTAGCAGCAGTGGCCAGAGGGTACATAAAGTCACAAAATTAA
AATGAGGCATCTTCTTACAGTAACTTCATCTTAAATGAAAGCAAGGCTATATTATGAAGTAAAACTAATT
TTGTACACAGTTGTAAGAATATGAATTTCACATTCTGGCAGCTTCAAACTATATTCCAAGATCAACCCCC
GTCCCCACCAGCAGGTCTTATTTCCAGACTCCAATAAATTCCAACTAAAAGTTAAGAGCTGAATGATAAT
CAGCTTTTGATCAAATGATTCTCCCACCTCAGCCTCCTGAGTAGCTAGGACTACAGGTGCACACTATCAT
ACCTGGCTAATTTTTTATTTTTTGTAGAGACAGTGTTTCACCATGTTACCCAGACTGTTCTTGAACTCCT
GGGCTCAAGCAATCCACCCATCTTGGCCTCCCAAAGTGCTGGGATTACAGGCATGAGCCACCGTGACCAG
TCGAGTTTCTTGATATTAATATTACTTGGTGGAGTCTAATGATTCCCACAGCCTTCCCACACTGTTAACC
TTCCAAGCCAGTTCTGTAATAAAAGAATCATGCCAGGAATGACAGAGAGGAGCAAGGCAGGAAGCCCAAA
GGGATAAGCGAAGTAAAACCAACCTTTTCTCTGCCTTCCAAGAAGTTCATCCATCATGAGATAGGGAGGT
GGGTCTTCCACTTCTGAAGACAGCTTCTCCTGAGGAGCTGAGGCACTTTTTAAAAAATGTTGAAAAGTCG
GTCCAGCAGCCAGCCTGGAGCTGAAATCCTTCCGAGCTCCATCCTCCTGCCTCTCTGGACTGGGACACAT
GGTACTAGAGAGACTGCTGTGTGCCCTGCACATCCTCAGCGACAGCCAAGACACAGAGGCCAATGGTCCC
CACCCCAGAGACCTCTGCACTTGGAGGACACACTGTAAAGGGTGCATGGCACTAAACAGCCCACAGTCTG
CAAAAGAATGACAGACATCACCAGCATTTATTGAACACTATGGACAGGACACTGCTGTGAGCACTTCAAG
TGTATACATCTATTTACCCCTCACAAAAGCCCATGAAGAAGGTACTCCTAATAATATGACCTCTGTTTTA
CAGTTGAAAAAAACTGAGGCAACTTGCCCAAGACCCACACAAAGGAGTGCCAGAGATGAGATGCAAATCCA
GGCAGTCTTTTCAAAACAAGGGGTGGTAGAGATGAGATGGAAAGCCCTGACAAAATGACAAAATAGCACC
TTGTGCCAAGACCAGTTCCCAAGGCTTTAAGTGTATTAACTCATTAAATCTTTACAGCAATCCTAGGAAG
CAGATACTATTATTGTTCCTATTCCGAAAGACATAGGTTGAGGAACTCACCTAAGCTCCTACAGCCAGTA
AGCAGTCAAACAAGGACTCAGATAAAAATCTGTATGGATGCAAAGCCCGTGCCACTACCCATCTTGCTAC
ACTGCCTCTTAATAAAGTGAAAACCACTCACTGTCTGAGGGCATCTTCCTTTGAGTTCCTTCAGAAGGAA
AGCAACTAATGTGAGGCATTGTATGCCCGATCAGTGACTCCTTCTACCCTTCAAGAGTCTTGGCTGGAT
GCAGCCGCTCATGCCTGTAATCCCAGGACTTTGGGAGGCCGAGGCAGGAGGATCACTTGAGGTCAGGAGT
TCAAGACCAGCCTGACCAACATGGCAAAACCCCATTTCTACTAAAAATACAAAAGTTAGCCAGATGTGGT
AGCAAGTGCCTATAGTCCCAACTACTCAGGAGGCTGAGACAGGAGAATCACTGGAACCCAGGAAGCAGAA
GTTGCTATGAACCGAGATCGCACCACTGCACTACAGTTTGGACAACAGAGCGAAACTCCATCTCAAAACA
AAAAAAAAAGAGTTTCAAACTACTACCTTCAAACTTTCCACCCAGACCCTCTCACACTTGGCTTAGCAAA
TAACACAACCTTTATAGAGAACAATTTGCCACTTTCCATCAAAATTACAAGTGTGCAAACCATCTGACAA
AGCATTTCCACTCATAATTATCCTGCAGATAAATCTATACACATACAAAATGACCTATGTATAAAGACAT
TCAGTCTAGGCACAGTGGCTCATGCCTGTAATCCCAGCACTTTGGGACGCTGAGGCTGGTGGATCACTTC
AGGCCAGGAGTTCGAGACCAGCCTGGCCAACACAGTGAAACCTCATCTCTACTAAAAATACAAAAATTA
GCTGGATGTGGTGGCACACACCTGTATTCTAAGATACCCGGGAGACTGAGGCATGAGAATCTCTTGAGCT
CAGGAGGAGAAGGTTGCAGTGAGCCAAGATCACGCCACTGCACTCAGCCTGGGCAACAGAGTGAGACTG
TCTCAAAAAATAAAAATAAAAGATATTCAATGCAACAGTGTTTCTAATAGCAAAGGAAAGGGAAAGATCT
AAATGTTATCAATAAAGGACTAGTTAAGTAAGTTCTGGTGCATCCATACAATGAAACAAGATACAACTGT
TAGAAACCAAGGCTGGTGGCGGGTGCAGTGGCTCATGCCTATAATCCCAGCATTTTGGGAAGCTGAGAC
AGAAACATCACTTGAGCCAGGAATTCGAGACCAGCCTGGGCAACATAGTGAGACCTCATCTCTATAAAAA
TAACAAAAAATAGCCGAGCACAGTGATGCACACCTGTAGTCCCAGCTACTCAGGAGGTTGAGATGAAGG
ATTGCTTGAGCCCAGGAGATCAATGCTGCAGTAAGCCATAATCGCACCACTGCACTCCAGCCTGGGTGAC

FIGURE 20 cont'd

```
AGAGTAAGACCCTATCTCAAAAAAATAAAAATAAAAATAAATGAGGCTGAACCTATACATGACAAAGGCA
AGGAAGCAATATGCTCCATGCTACCTACATTATACTACTGTTGAATCTGTGGGGAAAGAGGGTGGGAATA
TTGAGGTACCTATTTGCAGGTACATACAATATCTCTAGAATGCATAAGAAACAATAGTTGCCTCCCAGGA
AGACTTAGGTGACTAAGGTATAGGAGATGAAGCCATACTATTTACTTTTTTTTTTTTAATTTTCTGACT
AAGGAAGAATTCTAGGATCACCATATATTTTACTGGACCCCACATCTATGGCCTACTACACTCCAGCCA
TGCCACACTTCTTTGTATTAATCTTCACTAGCTTATAGGATTTTACACATGCTGTTCTCTGGCTGGTATT
TATCTTCTCTCTAGTGGCCTATGGTACTTTCAGCTTTCTTCCTCTGGGAAGCCTGCTCTGGCCATCACCC
CCGAAGTCTAGGTGGGGTCCTCCTCTGGGTTCCCAAAGCTCTATTCTATCTCTCCATCACAAGACTCATC
ACACTTTGCTGTTAATTATTACTGACACTTCTGCCAGCCCTAGTAAACTGGCAGGTTCCTGCAAGCAGGG
AACAAGTATCATTCATTTCTACACCTTCACCATCTCCCATTGTGGTAGCTGCCTCACGGCAGGTGCTAAA
CATCAGTGGTTCCCAACCTTTTTGGTACTAGGAATTGGTTTCATGGAAGACAATTTTTCCACAGACATGG
AAGCAGGGGTGTGTTGAAACTGTTCCACCTCAGGCATTTAGATTCTTACAAGGAGCATGCAATCTTGAGC
CAGTGCGGTGGCTGACATCTATAATCCCAGCACTTTGGGAGGCCGAGGCAGGCGGATTGTTTGAGCTCAG
GAGTTCGAGACCAGCCTGGGCAACATGGCAAGACCATGTTTATTTGTTGTCTCTACAACAAATTAAAAAA
TAAAAAATTAGCCAGCCATTGTGGTATGTGCCTGTAATCCCAGCAACTTGGGAAGCTGAGGTAGGAGGAT
CACTTGAGCCAGGGAGGCAGAGATTGCAGTGAGCTGAGATTGCGCCACCACACTCCAGCCTGGGCAACAG
AGAGAGAGAGAACTTGTCTCAAAAAAAAGGAAATGGAATGCACAAACTAGATGCCTTGCATATACGCAGT
TCACAATAGGGTTTGTGTTCCTGAGAAACTAATTCCGTGGCCAATCTGACGGGAGGCAGAGCTCAGGCAG
TAATGCCAGCTTTGCTGCTCACCTCCTGCTGTGCAACCCGGTTCCTCACAGGCCACAGACAGGTACCATT
CTACCACCTAGGGTTAGGGGAACCCTGCTATACACGTGTAAAGAGCAGATGTGGCCCATTACCTTTCCAA
TGAGATGACCTGCCACATCTGCTACTAGCACTTAGGAGCAATGCCAACCCAGTTTCAAGAGTCAGAGAAG
AACAGCCTTAAAGTGTGAACTTTAAAATCGCCCCTTTCTACTCCATAATTGCTGTGTGACCTTTGGCAAG
ACAAATTTCTGTCTCTGAGCCGCCAATTCCACATGTGTAAAATAAGGATAAAAGCAGCACCTACCACCCC
ATAAGTGTTATTAAGAATAAGATATTAAAAACCCAACTTGAGATACAGTAAGCGTTCACTAACTGCACAT
TTACAGCCCACACCCCCTTTCACAGAGAGTATTAGAGCATCCTGGTTAAGAGTATGAACTCCACTAAAAA
TACAAAACTTAGCCGGGTGTGGTGGTATGCGCCTGTAATCCTAGCTACCCAGGAGGCTGAGGCAGGAGAA
TCGCTGGAACTCGCGGGGCAGGGGCTACAGTGAGCCGAGATCGCGTCACTGCACTCCAGCCTGGGCGACA
GAGCAAGACTCCCGTCTCAAGAAAAAAAAGTATGGACCCTGGAGTCAGAATCTGACCCCACTGCTGCCA
AGCCAGCTAAACCTTAGGCACCTGTCTTAAACTCTGGGAGCCTCTAGATGGGGATAATAGCACCTATCTC
CATAAGCCTACCGTAGGATCAAATGCAATAATACAAGCAAAATGCTTTGCATAACGCAATGTAGAAGCCT
CTCTGGAGGCTCGAAATTAATTCTGACAGTCGGCAATGAGGCTGGAACAACAGCGTACAACATCCCAAAC
ATTTTATTGGCTGGTTACAATGCGTTAGGCATGGTGCAAAGCATTTTCCGCGAATTATTACCTATAACCC
TCATAGCAACCCTGTGAGGCAGGCTGTACTGTCAACCCCACTTCACGGGTGGCGAAGCGAAGCCTTGAAA
GAAGTGGAGGTGACCTGTCCAAGGTCACACGGGGTTAGGCGGCGGGGTTAGGGTACGAACCCCTACAGCC
TGACGCCAGGCCCCACGCCATAACCACCGTGCCATCCTCCCTCTTGAACACCGTGCGCTTCCCGGGATCC
GCGGCCCCTCCTGCCCCAGGCGCCAGTCAAAAGCGGGTGCGCAGCCCACCCCGGCGGCCGCGCTGCTCAC
CTCCCGCAGCAGCAACAGTGCCCGGGGTCCCGCAGCGTAAGTTCTGCCGGCAAGTCGGATCCCCTCACAG
GTCCGCCGCTGCGTTCATACACAAGCGACTTCCGTTCCGCCGCTACTTCAGGCCGGGTCATGCTAACGGA
AGTGCTTCCTTTTTACAGTCCGGGTGGACCCAAAGCTCCGTGGCGGTGCTGAACTTTAGGGCAGCCACTA
GCCACGGACTTAAGCGGCAATTGAGCTCCTCAAAGTGGGTGAGTGCAAATCAAATGTGCGCTAAATGTCA
GATACATGGATGTGGAAGAAGAAATGTCAAATAGTGTCAAATAGTTCATATATATAATGTTTATATTGA
TTATGTGCTGCAATAATTGTTGGGATATATTGGATTAAATAAGTACATTTGTTGAATTAGTTTTTTTAT
TTGTAGCTATGGTGGTAGAAATATTTGAATTAAGTTCACCTGTTGTTTCTTTTTACTTTTTCAATGTGGC
TAGCAGGGGGAAAAATAATATGGTGTGATCATGGCTCACTGCAGCTTCCGCCTCCCATGCTAAAGCAATC
CTCCCACCTCACACTCCCAAGTGGCTGGGACTACAGGCAGGCGCCACCACGCCCAGCTAAAATTTTTTA
ATTTTTTTGTAGAGACCGGTCTCCCCATGTTGCCCAGGCTGGTCTCAAACTCCTACCTAGGCGCAAGCCA
TCCTCCCACCTTGGCCTCCCAAAGTGCTGGGATTGTAGGCATGAGCCACCGTGTCCGGTCCTTACTGGGA
AATTTTAAGTCACCTAAGAGGTTCACGCTCTATTTCTATTGGAGGGTGCTGCCCTGTAGGTTAATGACTT
CCTGATTCACATCTCCAGCTGGACCCTCCCTGCAGTACCAGAGCCATAGCTCAGCTGCCTACTTGACACC
CCTTCTTGAGTGTCTGATGACCATCTCTAACTTATACAGAACTCTTCATTTCCACACATGCACCTTCACC
AAAAACCTGTACCTGTCATTCTGGCCCATCTCAGTAAATGGCCCAACCATCCTTCCAGGTGCACTAGGAG
GAACTGAATGGTCATTTTCTTCACCTCCCTGGATCCCCACATTCTATCTGTCAGTAAGCCCTGTCAACTC
TAACTCCAAAATGTCAAATCTGTCTACTCGGTAGCTACAACTACCCAGGCCACCATTGTCTCATCAGAAA
CAATCACAGTAGCCTGCTAATGGTCACCTTGTCTCCTGAGAACAGTTTCCCACACATAGCCTAAGGGAAT
TTGTGTTTGTTTTATTAAATCAAATTATATCACCCCTCTCCTGAAAACTCTCCGTGGCAGGCCGGGCGTG
GTGGCTCACATCTGTAATCCCAGCACTTTGGGAGGCCAAGATGGGCAGATTGCTTGAGCCCAGGAGTTCT
AGACTAGCCTGAGCAACATGATAAAACCCCATCTCTACAAAAAACACAAAAATTACCCCGGCATGGTGGT
GGGTACCTGTGGTCCCAGCTACTCAGAAGGCTGAGGCAGGGAGGATTGCTTGAGCCAGGGAAGTTGAGGC
GGCAGTGAACCATGACCTCAACACTGCACTCCAGCCTGGGTACCAGAATGAGACCATGTCTTGAAAAGA
AAAAAACAAAAACAGCCGGGCACGGTGGCTTATGCCTGTAATCCCAGCACTTTGGGAGGCTGAGGTGGGT
GGATCATGAGGTCAGGAATTCGAGACCAGCCTGGCCAATATGGTAAAACCCCGTCTCTACTAAAAATAAA
```

FIGURE 20 cont'd

```
AAATAAAAAATAGCTGGGCATGGTGCCGCGTGCCTGTAGTCCCAGCTACTCGGGAGGCTGAGGCAGGACA
ATTGCTTGAACCCAGGAAGCGGAGATTGCAGTGAGCCAAGATCGAGCCACTGCACTCCAGCCTGGGCGAC
AGAGCAAGACTCCATCTCAAAAAAAAAAAAAAAAGAAAAGAAAAGAAAAAAACAAAAACAAAAAGCTTA
AGAGCTTTCCATTGCCCGTGCAATAAAATCCAGATTTCCTACTGTATCCTAGGGGCCTGCATGATGTGGC
CCCTGCTTTTTTTTTTGAGACGACGTCTCACTCACTCTGTCGCCCAGGCTGGAGTGCAGTAGTGCAATC
TCGGCTCACTGCAACATCCGCCTCCCAGGTTAAAGCGACTCTCCTGCCTCAGCCTCCCGAGTAGCTGGGA
TTACAGGCGTGCACCACCACGTCAAACTAATTTTTGTATTTTTAGTAGAGCAGGGTTTCACCATGTTGGC
CAGATTGGTCTCAAACTCCTGGCCTCAAGTGATCCGCCCACCTCGACCTCCTAAAGTGCTAGGATTAGAG
GCGAGCACCACCACGCCCGGCTGATTTTTGTTTTTACTAGAGATGGGTTTTCGCCATGTTGGCCAGGCTG
GTCTCAAACTCCTGGCCTCAAGTGATCCTCCCACCTCAGCCTGCCAAAGTGCTGGAATTACAAGCATGAG
CCACCATGTCTGGCCCCCTGCTTACTTTTACTTCTCCAACCCATGTACTTCTTACCACTTACTTCTCCTA
CTGTGTTCTTTCTAGTTGACTATACTTCAACTACATAATTTTATCTTGCTCCTTCAATAACCCAAGCAAA
TGTTTATTTCAGACCCTCTGTCCTTTTTTTTTTTCTTTTCTTTTTTGAGACGGAGTCTTGCTCTGTTAC
CCAGGCTGGAGTGCAATGGCGTGATGTTGGCTCACTACAACCTCCACCTCTCGGGTTCAAGCAATTATCC
TGCCACAGCCTCCCAAGTAGCTAGGATTACAGGCACGCAACACCATGCCCACAGAGCTTCTCTTCTTACT
ATTATCTTTCTGGAATGCTCTTCTCCAAAATTGTTTCGTGGCTGGCCCCTTCTCATCCTTTAGGTCTCAG
CATAAATATCAGCTCTTCAGAGAGACCCTCTCTGACCACTTCATATAAACTACTCTATCACTTCTCTTAT
TATTTTCTTCACCATATTTGTCACTATTCAAAATGTTGGCATTACTTATTTTCTTATCATTGCCTATTCC
CTGGACTATCAGCTAGGGAGGGACACGTCGTGTCTTGTTCATGGCTTTATCCCCATGATCTACACAGGGT
CTGACTCATAGAAGGGCTTAATGAAAATTTGTTGAATGAATAAATGACTGCTTTCTGTCTTAGTTTGGGC
TCCCCAGAAGCAGACCTGAGACAAGTATTTTTTTTTTTTTAGACCAAGTCTCACTCTGTTACACAGGCTG
GAGTGTAGTGGCCCAATCTTGGCTCACTGCAACCTCCACCACCCGGGTTCAAGCGATTCTCCTGCCTCAG
CCTCCTGAGTAACTGGGATTACAGGCAAGCGCCACCACACCCGGCTAATTTTTGTATTTTTAGTAGAAAC
AGGGTTTCACCATATTGGCCAGACTGGTCTCTAACTCCCCACCTGCGGTGATCCACCCACCTTGGCCTCC
CAAAGTGCTGGGATTACAGGCATGAGCTACTGTGCCCGGCTACTGAGACAAGTATTTGAGTGCAGGTAGT
TGATTTGCAAAGTAATCTCAGGAAACACTGGTAGGGTAGTAGGGGAGTGAAACAGGGAGGGGAGACAGCC
AATAAACATTGTTAACAAGCAACTTTCTTGCAGGCATCTAGGTCTTAATCCTGCTGGAGAACACTGGGAA
ATAATGCAGAACACTGTGCTGGTTAATTATTTGTGTCAACTTGACTGGGCCACAGGTTGCCCAGATATCT
AGTTAAACGTTATTTCTGGGTGTTTCTTGAGGAAGAGATTAGCTTTGGTGGACTGAGTAGAGTAGACTAC
CCTCCACAATCTGGATGGACATCATCTAACCCCTTGGGGACCCAAATAGGACAGGAAGACAGAGCAAGGT
TGAATTCTCTGTCTGCCTGACTGCTTAAGCTGAGACATTGGTCTTCTCCTGCCCTTGGACTGGGACTTAA
ACACCATTGGCACTCCTGATTCTCAGTCTTTTAGATTCAAACTGGAATTTACACCACCACCTTTCCTCGG
TGTGCAGCTTGCAGATGGCAAATTGTAGGACTTCTCAGCCTCTATAATCACTTGATCCAATTCCTTATGA
TAAATCTCATTCTAGATGTAGAAATATACATATAGTGGCCAGGCACAGTGGCTCATATCTGTAATCCCAG
CACTTTGGGAGGCCAAGGTGGGAAGATCACTGGAGGTCAGGAGTTCGAGACCAGCCTGGCCAACATGGTG
AAACCACATCTCTAATAAAAATGCAAAAATTATGGCCAGGCGCAGTGGCTCACACCTGTAATCCCAGCAC
TTTAGGAAGCCGAGGCAGGCGGATCACCTGAGGTCAGGAGTTCAAGACCAGCCTGGCCAACATGGTGAAA
CCCCCGTCTCTACTAAAAATACAAAAAAATTAGCCGGGCATGGTGGCGAGCGCCTGTAATCCCAGCTGCT
CAGGAGGCTGAGGCAAGAGAATTGCTTGAGGCCAAGACAGGAGGATTGCTTGAGTTCAGGAGTGTGAGAC
CAGCCTGAGTAACATGGCAAGACCCCATCTCTACAACAAATTAAAAAATAAAAAATTAGCCAGCCATGGT
GGCACAGTCCTATAGTCTTAGCAACTTGGGAGGCTGAGGTAGGAGGATCACTTGAGCCTGGGAGGCCGAG
ACTGCAGTAAGCTGGGATCCCGCAACTGCACTCCAGCCTGGGCAACAAAGCGAGACCCCACCTCCAAAAC
AAAAAATAGGGCGGAGGGTGGTGTTCCAAGTGAAGGCACCAGACTGCTGATGGCCAGAAGGAAAAGGAGT
GAGTCTTTGGTGGTTTGGGATGTTGCTGAAAATTTAGTGGATAAGCTGAGAAAATTTCATTTTCACAAAG
AAACAATGCTACCATTGTAAGTAAGCTAAAAGTGATTGCCTCAAAGTTAAGTTACCTGGTCTCTCTTTTT
TTTTTTTTGAGACAGAGTCACGCTCTGGGCCCAGGCCGGAGTGCAGTAGCGCAATCTCTGCTCGCTGC
AAACTCCACCTCCAGGGTTCAAATGATTCTCCTGTCTCAGCCTCCCGAGTAGCTGAGATTACAAGTGCAC
ACCACCATATCTGGCTAATTTGTTGTTGTTGTTTGTTTTGTTTTTTGAGACCGAGTCTCACT
CTGTTACCCAGGCTGGAGTGCAGTGGCCGCGATCTCAGCTCACCGCAACCTTCACCTCCCAGGTTCAAGC
AATTCTCCTGCCTCAGCCTCCTGAGTAGCTGGGATTACAGGCAGGTGCCACCATGCCCGGCTAATTTTTG
TATTTTTAGTAGCAACAGGGTTTCACCATGTTGGCCAGGCTGGTCTTGAACTCCTGACCTCAGGTGATCC
GCCCACCTCAGCCTCCCAGAGTGCTGGGATTACAGGCATGAGCCATCACACCAGGCACATCATCTTTGTT
TTATCTTGTCGCTACATTAAAGAAACTGAACCTTTCAAAAGTTTAAAAAAAAAAAGTTCTGGGCTTGGC
ACGGTGTCCTAGCACTTTGGGAAGCTGATGCAGGAGGATCACTTGAGGTCAGGAGTTTAAAACCAGCCTG
GCCAACATGGTGAAACCCTATCTCTACTAAAAATACAAAACATTAGTGGGGCATGGTGGTGGGCGCCTGT
AATCCCAGCTACTCAGGAGGCTGAGGCAGGAGAATCGCTTGAACCGGGAGGTGGATGTTGCAGTGAGATG
AGACCCTGCCTGGGTGACAGAGCAAGACTCCGTCTCAAAAAAAAAAAAGTTCTCCATCATTGCCATTGTC
ATTGTGATTTTAGGTAGGGAGTCATAACCACTGCCCACTCACATCCAGCCAGCACATCGCAGTTTCCGAA
GTACCAAACACATTCCACTCCACCTCCCTTCTGCAGGAAAGGGTCCTGAAGCTCTCTAAGATGGCTTTGA
CATGGGTCCACAAATTCTTTGACATTCCTTTCTTCAAGAGGTGGAGCCTAATTCCCCTCCCTTTGAGTGT
GGACTGAACTTAGTGACTCATTTCTAATGAATAGAACAAAGCAGAAGCAACAGTGTAAGGCTTCCAAGAC
```

FIGURE 20 cont'd

```
CGGGTCATAAGAGGCACTGTTTGTGGCTTCCTCCTTGCCCTCTCTTCTGTCTCACTGTGGGGAAAGCCAA
CTGCCATATCATGAGAAAACTCAAGCAGCAGCTCTAGGGTTAGCCCTACATGGTGAGGAACTGAGACCTC
CTACCCACAGCCATGTGCATGAGCAGTATTGGAATGGATCCTCCAGCCCCAGTCAAGCCTTCAGATGACT
GCAGCCCTAGCCGACAACTTGACTGCAACCTCATGAGCGACCCTGAGACAAGAACAGCCCAGCTTAGCCC
CTCTCAAATTTCTGACCCACAGAACCTAAGAGATAATGAATATTTGTCATTTTAAGCTGCAAATTTTGGA
TAATTTGTCACACAACAATAGATAACCAATACACTGTCTTTGGCCCATGTAGTAAAGGTCTGTTCTTCTC
CAGGGAAAGGTGCCCTAGTCCTTGGTCTGGTCCATCTTGGGACTGCAGGGGCCACCCCAGGACCCAAAGG
CCAAGGCACAGACCACATACACTGGGCCGGGCTGCCTGTGTGCTCACAGGCTGTTTATTTATCCAAGAGT
AAGGAGGAGAGAGACAGGATGAAGAGAAAAACCAGACTCCCCACGGTGGCAGGGCTGAGGGAAAAACAA
ACAGAAAATCTCCTCTTCTTTCTCTTGCTGCTGACCCCAGGGTACTCCAGCTTCAGATGGGACCTCTGGG
GGTGGCTTAGGGGCCTCGAGGAGGCCCGGCAGCTCAGCTGTTGGCTGGGGTCAGGATCCGCACAGGGGCA
GGTCCCAGACTCGGAATGGCTTCTGTGTACACAAAATATCTCTCTGCAAAAGGCACTGGTGGAGGGGGGC
AGCAGGAAGGCCACCCCATCACAGGCAGAGTCCACTCTGTCCTGCGTCTGGGTCCTGGGCCCCAAGACCA
ATCCAGTCTCCCTCAGGGTTGGGGTTTCGGAGGCCCTTGTTCCTCTCCTCTCCCTTCCCTCAGCCCAGGG
GTGAGCAGGCAGTCGGTGGAGGCCCAGCTCAGGCCATGTCATGGACACCCCTCTTCAGGGCTAGTGCATC
CGGCGACTTCTAGGCCAACAGCCCGAGGCGGGTGACTTTGGCCGACAGGAAGGAGTGGATGATGAAGACT
ATGGTTTTGGGACACGAGTGCAGGTCCAGCTGCTGGAGGGTGGATGGAGAGAAGAGTCAGGGCCCTGGCC
AGCCTGGCCTCCGAGAGTGCACACCCCCTCCTCCCCAGGGTGCAGAGGCAGCCCCTCACTCACGATCTCG
CCTTCAGCACCTCCAAAATCCAGGAAAAGGAGACTGGCACCGTCATCTGAAGACATCTGCAGCTTCTCGA
AGGGCTGTCGCAGGAGCACAGCTCGGGCTGCACCTGGCTCAGCCGCCCACAGTGTGAAGCCCTTGTCGAT
GTGCACAGACAGGCTGCAGGGACGCCCATTCCACGTGCAGGCTGCAGGGAGGGCACATAGGTACAGGCAC
AGCTGGCACCTCAGAGACTACACCCCAACCTCCAACCCCCACCGCAGCCAGCTTACAAAGTGGGGCCTGAATGC
CTCCAGGGATGGGAGGCTCACTGTTTGTCGTGGCACCAGTACACCCACCCTGCAGAGAGTCATCACCCCC
ACCCTCAGAGGACCTACACCCACTTCCAGTCCCACTTCCAGCAGCACAAGTAGAAAGGGGGAGCTTAAAA
TGTGCCATGGACAGGAGGCTCACTGCTGATAAAGGCATCATCAGATCTACCAAGCACCGCCCTTGGAGAC
CTGCAGAGTTACCCGGCTAAATTTAAATTTCAGATAAACAATGACTAATTTGGGCATACTTCTGTGAAAA
AAGTATTCATTGTTAACCTGAAATTCAAATGAGGCTGGGTGTCCTGTATTTATTTCCTCTGGCAACCCTA
CCCCAAGTGCCATCTCTCACATCCTCACCAGCAGATTGACAAAACTGGGGCAAGAAAACCCCAGGGAGAA
GAGTCTCTGCCTGCTAGGGCACCTGCACATCCAAAACAGAGGGCCCAAACCCAACTTCCTTTTTTTTTTG
GAGAAACAGTCTCACTCTGTTACCCAGGCTGGAGTGCAGTGGGCGCAATCTCGGCTCACCACAACCTCCA
TCTCCCGGGTTCAAGTGATTCTCGTGCCTCAGCTTCCTGCGTAGCTGGGACTACAGGCACCTAGTACCAT
GCCCGGCTAATTTTTGTATTATTATTTTTTTTTTGAGACAGTCTTGCTCTGTCGCCCAGGCTGGAGTG
CAGTGGCACAATCTGGGCCCACTACAACCTCCACCTCCCAGATTCAAACAATTCTGCCTCAGCCTCCCGA
GTAGCTAGGACTACAGGCGCCCACCACCATGCCCGGCTAATTTTTGTATTTTAGTAGAGACAGGGTTTC
ACCATTTTGGCCAGGCTGGTCTCAAACTGCTGACCTCAAGTGATCCACCCGCCTCAGCCTCCCAAAGTGC
TGCGATTACAGGCGTGAGCCACCGCACCTGGCCAATTTTTGTATTATTAGTAGAGACAGGGTTTTGCCAT
GTTTGCCAGACTGGTCTCAAACTTCTGACCTCAGGTGATCCACCCACCTTGACCTCCAAACCCCATTTTC
TATCCCCTCCTGAAGTGCCCTAAAGAAGGAAGCTTGAATGCCCCTGGGGATAAGAGGCTTATTACCAGAG
GGACACTCCCAGATCCTCCCAGCACACCTGTAGACACCTCCTGCACACCCTCGGCGGCCCGGTGACAGCC
ATCCACAAGCTGGCGGGTCCAGGCAGCCAGCTCCTGCGGTGACTCCACGCTGAACAGGTGAGTGTCCACA
CCGTGACGCGTGCCCGTGCGCAGGGCAAAAGAGCTCTGCATCGTAGGGCACTGAGCCCTTGGAGGGGC
CTGAGTGCACCAGTCTGGGGGTTGGGGGCAGAGGGCTGAGCATGAGGCCTCAGGCCGGAGGCAAATAGTT
CTGGGCAAAGGGCCAGTGACCTGGGAAGAAACCCTGTAAATCCTTTACCACCTAACAGGACAGGACTTG
CCAGGGGGCACTGATTGACTCAGCAGGAGACATCTCCTGCCACCCTCCCCGTCACTCCCTTGGCTCTGGC
TATACTGGTGTCATCACACACACCTAGCACATGCCTGCCTCAGCACCTTTGCATATGCTCTTCCCTCTGC
CTATACATGCTTCCCTGATTATCTGCACGGCTCACTCCCTCACTTCCTTCAGATGTTAGTTTAAATGTCA
CCTCCTCTGAGAAGCCTTCCCTGACCTCCCAGTCCAAAATAGCACCCTTGTCACTCACTAGCCTTACTTT
TTAATCATGGTACCAGAAATTATACTTTTTATTATTTGTTTTCGTTGGTTTTGACTGTCTTTTTCACTA
GAATGTCAACTAGGTTAGAAATTTTGATCTTGTGTTCACCACTGTATTCCCAGTAACTAAAACCATGCCT
GCCCACAGTAGGTGCTCAGTAAACTTTTGTTGCCTAACTTGAATCACTTGATTAGGCAGACAGTCCAGGA
CCTAGTTATCCCTAGTAGCCAGCAGGCTCCTGACACACGGGCCAGAGCCAGCCTGAGGTAAGGAGACATG
GGGGACAAGGACTTCAGACCCCTGCAGCTTGACTCTCACTTGCTGTGTGGCCTTGGTAAGCCAACTGCCC
CTCTCTGGGGCAGAAAGTTCTGCCCCATATCCCTCTTTGTTCCTCCCTCCACCCACTCTTTCTCCTATAG
CTCAGTTCCCCCCGCCACAGACTGCTGCTGACACCCGCCTTCGACTTTCCAGCCCTGAGCTGCAGACCCT
CGAGTCCCAGGCTTCCTATCCAAGCTCCCTCTCATCCCACACACACTCTGGACTTAACTCAGCATCTT
GCTCCAGCCTCCTCCCTTTCCACCCCCACCCCCAGTCCCACGCTCACCCAGACACAAGCTCCAAACCTCC
TGTTCATTCCGGACCCCTCCTTCACCCGCCCCATCTGGCAAGCACGGAGCCCTGTTAATTTTACACCCAT
GTGGTTTCCAATGCCAATGCTGCCTTTCTTCCCCATCTGCTCCTGCCACCCACCTCCACCTCCCCCAGCC
ACCATCATCTCCTGCATGACTGCAGCACCTCCCCACTTCCATCCTGCACTCTCCGCTGCATTCTCCAC
GTGGCAGCCACAGGGATTCTCTTAAAGCAACCAGAGCACCTCGCTCCCCAGCTTAAACCCTTCAACACTA
CCAAACTCTTAAGCTAAAGCTAACATTCCTTAATCAGGCAATAGAAGCTCTTCAAGATCAGGCCCTGCCA
```

FIGURE 20 cont'd

ACTCCCTTCTCTCCATTTCCTGCATGAATTCTGGTTATCACAAACTCATAGCTCCATGAACATGCTATAG
CCCTTCATGCCTCTGTACTTTTGACCATGATGTTCTCTCTGCATGGGATGCTCTTTCACCCTTTCTTAAA
CAGAAAACTTCTACTCATCCATCAAAGTCCAGCTCAAATGTCACCTCCTCCCTGAAGCCTTCCTCTACTA
CCCCAACAGAGTTAAGTGGCTCCTACAAACCCTGCACTGTAATGGCTGTTCCTGGGTCTGTCTCCCCAGC
CAGACAAGGTTCTCTCTGGAGGCAGAAACTGTTGGGGTCAGCTCTGTGCCCTCTGAACCATGCAGCACAA
GGCATAAGTGTCAGCGAATGAGTGGCTAATGGGGACCTTATATCCTTTTGTTCCAAGCACCCATTTTACA
GATGAGGAAACTGAGGCCCAGACAGGGCAGAGACTTGCTTCAGGTCACCTGGGGAATAGCTGAGGGTGGA
CAGGGCTGGAGTTCCCAGCTTCTGGGGCCCTGCTGGAGCATCTCCTGGCAAGTTCTGGGGGAGACATACT
GCCCCTGCCTGTGGGTACCTGGTGGCGATGAGTGGGGCAGTACGGGCTGGCCGGCTCAGGGCCTCGCGGG
TCTCGGGGAGAGACAAGTAGAGGAGCAGTTCCTTTTCAGTTAGCAGGGCCAGGGTGGGGCTGTGCCCCC
ACTGGGCAGCTGCAGAGAACAAAACAGCAGTGAGGATGGGTGGGGAAGAGAGGGCAGAGGGCCAGGGCA
GGGTGAGGTGGCCAGGGGCACTGGGAACAGGGCCAGCTCCAAAGGAGCGGAAGAGAGAGAGGGATAGGTC
CCAGGCCCAGCAGGTACCTGCTCAGTTAGCCAGCCAATCTGCTTGATGTCCTGGCTCCCAGCTGTGCTGG
TGGCTGCCAACAGTGCCTGCAGCTCATCCTTGACCCGCGGCGTCAGAGTATTGACCTGGGCTTGGATGGC
AGTCGCCCACGACCTCGCACTAGCCTCATCCTTGGCCCTCAGGAAGAGGGTGTCTTGACCATCTGCCGAG
CAGATCTCCAGATACCTGCAGGCACAAATGGGTGGAGACAAGGACCTGACCATTAGGCTGCAGCTGCCCA
ACCCTGGCCCAAGAAACCCCACCCACCACCAAACCAGGAGAAACCAGGGGGATGTCCGTGAGAGAATCAG
GAGCAACCCTCACTGCTGGGCTCCAGCCACAGTTGCTGGGGCTTCATGGGGCATAGGAACAAGCGAGTGT
GACATATACACACGTGTTCATATATTTTGTGGGGTTTTTGTTGTTTTTGAAACAGAGCCTCGCTCTG
TCACCCAGGCTGCACTGCAATGGCCCAACCTCTGCCTCCCAGGTTCAAGTGATTCTCCTGCCTCAGCCTC
CCAAGTAGCTGGGATTACAGGCACACGCCACCACACCCATATAATTTTTGTATTTTTAATAGAGATGGGG
TTTCACCATGTTGGCCAGGATGGTCTCGATCTCCTGACCCCGTGATCCGCCTGCCTCAGCCTCCCAAAGT
GCTGGGATTACAGGCATGAGCCACCATGCCTGGCCTTATTTTTTATTTTTAGTAGAGATGGGGTTTCAC
CAAGTTGGCCAGGCTGGTCTCGAACTCCTGACCTCAAATGATCACCCCGCCTTCGCCCTCCAAAGTGCTG
GGATTACAGGCATGAGCCACCGTGCCCAGCCTACACGTATGCAGATACACACAAATATACACACACTG
AAACATGCATGATGGTGTAATAGGGCCTAAATTATTGCTGTGTGGCTATTCCTAATCTTGCCCCTTTCTC
CTGGTTTCTAAGGAACATCCTCTTCTGGGCCAGCTCCCAGGTTCTCCTTGTTGCACAGAACCAAACTAAT
TCACTAATAAGAGCAGGGGAAAAAAAAAAAAAAAAACTAAGCTGGACATGGTGGCTCACGCCTGTAATCCC
AGAACTTCGGGAGACTGAGCCAGGACGATGGCTTGAGCCCAGGAGTTCGAGACCAGCCTGGACAACAAAG
TGAGACACTCATCTCTAAAAAAGAAAAAAAAATTTTTTTTTAATTAGCCAGGCATGGTGACACGTGCCT
ATAGTCCCAGCTACTTAGAGGCTGAGGCAGGAGAACCACTTGAGCCCAGGAGTTTGAGGCTGCAGTAAGC
TATAAGGGTGCCAGTGCACTCCAGCCTAGATGACAGCACAAGACCTCATCTTAAAAAAACAGAAAAACAG
ACAGGGTGTGATGGCTCACGCCTGTAATCCCAGCACTTTGGGAAGCCAAAGCGGGTGGATCACCTGAGGT
AGGGAGTTCAAGACCAGCCTGATCAACATGGAGAAACCCCATCTCTACTAAAAATACAAAATTAGCTGGG
TGTGGTGGCACATGCCTGTAATCCCAGCTACTAGGGAGGCTGAGGCAGGAGAATCGCTTGAACCCAGAAA
GTGGAGGTTGTAGTGAGCTGAGATCGTGCCATTGCACTCCAGCCTGGGCAACAAAAGCGAAACTCCGTCT
CAAAAACCAAAAAAAAAAAAAAAAAAAAAAAAACAAAAACAACAACAAAACTAAAGAGGCT
TGAGGCCAGGCATGGTGGCTCACACCTGTAATCCCAGCACTTTGGGAAGCTGAGCCGGGCAGATCACTTG
AGGCCAGGAGTTCAAAACCAACCTAGCCAACAGGGCAAAACCCCATCTCCTCTAAAAACACAAAAAATTA
GCCAGACGTCATGGCGGGCACCTGTGGTCCCAGCTACTTGGGAGGCTGAGGCACCAGAATCACTTGAACC
TGGGAAGCAGAGGTTGCAGTGAGCTGAGATCACACCACTGCACTCCAGCCTGGGTGACAGAGCGAGATCC
CCCATCTCAAAAAGAAATAATAAATTATTGTTTTCTAAACCACTAAATTTTAGGGTTGGTTTGTGATACA
GCAACAGATAGCCAAAATACTAGCAGAAAAGACTCTTTGGCTTTTGTCTTATTTCTGCCTGGAATATGAA
CACAATTCTTGGGATGCAGCCACCATCCTGCCTCCACGAAGAAGAAACCGCCCATAATTAAAATGGTAG
AGCAGGAAGCTAGAAGCCTAGTTCCTTGATGGCATCCTTGAGCATCTACAGCAGCCTGAATAGCTGACCC
CTGGACTTCTTTTTAAACATGTGGGAAATTAACCCCTTTTATTTAAGTCATTGCTTGTTGGAGTTTCTG
TACTTGCAGCCCAGTGCAATCCTAACACTGAGTAAAAGTTTGAAGCAGTTTTCATTATATTTTGGTTGCC
AGGCTGTATCCCTATGACTGGGATACTGCACTGACAGTGGGCCATATGGAACCCCAGTTATATTGAGGTT
ACCTATGTAGGTACTCAGGCATCTACATGTTAAAACACACATGCACACACATATGTGCATACACATACAA
ATAACATATAAACAAACACACATGTACAAATCTATACTCATACATGCAAATGCTCTCATATATACATACA
AGCACTTGCATTTACATGTCATCTACACGTGCGCACACTTAGAAACATATACACACGTTTCAGGTAATGT
CTGGGATCAGGCTGGGAATCTAAGGTTCTATGAGTCTCTAGAAGGACTAATACTACTTCACCTTCACACT
CACAGAAGGCCCTTCCGGGCCGGGCATGGTGGCTCACCCCTGTAATCCCAGCACTTTGGGAGCCCAAGGT
GGGTGGATCTTGAGGTCAGGAGTTTGAGATCAGCCTGGCCAATGTGGTGAAACCCTGTCTCTAGTAAAAA
TACAGCCGGGCGCGGTGGCTCATGCCTGTAATCCTAGCACTTTGGGAGGCCGAGGCAGGCAGAATGCCTG
AGCTCAAGAGTTCAAGACCAGCCTGGGCAACAATGGTGAACCCCGTCTCTGCTAAAATACAAAAAAAAAA
AAAATTAGTCAGGCATGGCGGCGCTGCACCTGTAGTCCCAGCTACTCAGGAGGCTGAGGCAGGAGAATTGC
CTGAACCTAGGAGGCGGAGGTTGCAGTGAGCTGAGATTGTACCACTGCACTCCATCCAGCCTGGCAACAG
AGAAGACTCTGTCCCAAAAAAAAAAAAAAATACAAAAATTAGTCTATTAAAAATACAGGCGATGGCTCATG
CCTGTAATCCTAGCACTTCAGGAGGCCAAGGTGGGCGGATCACCTGAGGTCAGGAGTTCCAAACCAGCCT
GACCAACATGGTGAAACCCCATCTCTAATAAAAATACAAAATTAGCTGGGCATGTTGGCAGGTGCCTGTA

FIGURE 20 cont'd

```
ATCCCAGCTACTCAGAAGTCTGAGGCAGGAGAATCGCTTGAACCCGGGAGAAGGGGACCGCAGTGAGCCA
AGATTACACCACTGCACTCCAGCCTGGGCAACAGAGCGATACTCCGTCTCAAAAACAAAAACAAAGGCTC
TTTTTTAGAGCATCGGCAAGTGACCTGTGAATCACCAGTTTTTGCCTCATGGGGGCAGGCAAGAGGTGTG
GCATCGAGTGAGACCAAGAGATTTGGATGCTGGACGTTAACCAGCCCTCCCAGCCAATGTTGGGCATTTG
CTTGGCATTGAACCTAGGCTGTCACTAGGACCCACAGCCCAAGCTTGTAATGCATATAGCAGTTAAGCAT
CACCTCCAACAATGCATATCCCACTTGACCAAATATGCTCCATTTAGCCACCACCATCACTCAGGTATCT
TGCACCTTCCAAAGCAGAAAGGACTACCAGGATTGAGGCAAGTGCCACCCTTTCTGGTTGTGTGATCTCA
AGTAGGTTACTTCCCCTCTCTGTCCTCATCTATAAATGGAGGTGAGCCGGGAACGATGGCTCATGCCTG
TAATCCCAGCACTTTGGGAGGCCGAGGCAGGCAGATCACCTGAGGTCAGCAGTGCGAAACCAGCGTGGCC
AACATGGTGGAACCCCATCTCTACAAAAAATACAAAAGTTAGGCAGGGCACAGTTGCTTACACCTATAAT
CCCAGCACTTTGGGAGGCTGAGGCGGGGGAATCACCTCGAGGTCAGGAGTTCGTGACCAGCCTGACCAACA
TGGAGAATCCCGTCTCTACTAAAAATACAAATAATTAGCCAGGCATGGTGGCAGGCGCCCGTAATCCCAG
CTACTTGGGAGGCTGAGGGAGGAGAATTGCTTGAACCTGGAAGGCAGAGGTTTCAGTGAGCCAAGATCAT
GCCATTGCACTCCAACCTGGGCAACAGAGTGAGACTCTGTCAAAAAAAAAAAAAAAAAAAAAAAGTTAG
CCAGGTGTGGTGGTGGGCGCCTGTAGTCCCAGCTACTTAGGAGGCTAAGGCAGGAGAATCACTTGAACCC
AGGAGGCAGAAATTGCAGTGAGCCAAGATCTTTGCACCACTGCACTCCAGCCTGGGCGACAGAGCAAAAC
TCTGGCTCAAAAATAATAATAAAATAAAATAAAATGGAGGTGAAATAATAGGACTTTGCCCATTGGGCCT
CTGTGAGAGCTAAATAATATTGCACAGGGAAAGCACTCAACACAGTGCTGGGTACACAGTAAACACTCAG
TAAATGTTAGGTGGTTTCAGTATTATCAATGAACTGTTAAAGGCTGCTCAGATGTGAAGGATGTAACCTT
CCATGGCCCTGATAAAAAGGTTACCAGACATCTCAGAGCTCCAGCAGAGTGGGAAGAGACGAGAGGATCA
GTGAGTCCAACAACCTCATCTCACAATGGAGAATCTAAAGGTCAGTGAGGAAAAGGGCCTAGTTCAAAGA
GGACCAGGACTGGAACGCAGGGTTCTTCCTCAGACCAAGTTCATCCCCAGATGTGAGCTGCCCAGAGGAA
GAAGTGAGAAGCAAAGCACACCATCATCTCCATGGCTTCACTCAGGCTTCCAGTCAATCTATTTTTAAG
CACCTACTATGTCCTGGCATTGTGCTGGTCATTCGTACAACACAGAGGTGTCTTTCCATTGGTCCCACCA
CCTGACGCCAGGGCATCTGTCCATCTGAGTTGCTCCCAACCCCAGCCTTACCTGGGCTCCGGGTCATTGG
GGGTGCACCTCTTCGAGACATATGCCATCTTCAAGGACATGTGTTTGGCCTCGCTGAAGTTCCGGGGTGT
GGGGCCAGGGGAGGAAGGCTGCCGCTGAAGGGTGAGGCAGGAGGTGAGTCCCAGCCGACCGAGGTCCCA
CCAGTAGAGTTCTTGAAATACGGTGAGACGTCCTTCATATACTTGACTGATTGGGAGAGACATCAGCAGT
CACCACTGTGACATGGGCTCCCAGCACATATCACAATTGTCACTAATTTATTAAGAGTTTAATTTACGTG
TCACTATTAGACCCTTAGTAAGCAAGAGTCCAGTAGTGATATTAACAAATTCTTCTAAGTTAAAGTCTCT
GACAGGGCAGTGGAGCAGAAAATACTGTATCCCTTCTCTCTATCCCTATATAGAGATAGGGCCCGCCTAT
ATCCCTTCTCTCATTTTCCCCATGGTTAATAGACATACAGCCACCTGGAAGAAAGACTCTATTTCCCAGC
CTCCTTTGCAGTGAGGTGTGGCCATGTGACTTTTTTTTTTTTTTTGAGACAGTTTCTCTCTGTCACC
CAGACTAGAGTGCCATGGTGTGATCACAGCTCGCTACAGCCTCAATCTCCCAGATCAATAATCCTCCCA
CCTCAGCTCCCCAAGTAGCTGGGTCTACAGGTACGCACTACCACACCCAGCTATTAATTTTTTGTAGAGA
TGGGGTCACGCCATGTTGCTGGTCTTGAACTCCTAGACAGTGTATACAAGAAGGTGGTTACAAGACTTTC
CCAGGCTGGGCATGTTGGCTCATGCCTGTAATCCTAGCACTTTGGGAGGCCAAGGCGGGCAGATCATTTG
AGGTCAAAAGTTTGAAACCAGCCTGACCAACATGGTGAAACCCCGTCTCTACTGAAAATACAAAAGCTAG
CCGGGCGTGGTGGCTCGCACCTGTAATCCCAGCTACTGGGGAGGCTGAGGCAGGAGAATCACTTGAACCC
GGGAGGAGGAGGTTGCAGTGAGCCAAGATTGTGCCACTGTACTCCAGCCTGGGTGACATAACAAGACTCT
GTCTCAAAAAAAAAAAAAAAAAAAAAAAAAAAGACTCCCAGGCTGGGCATGGTGGCTCATGCCTGTA
ATTCCAGCACTTTGGGAGGCCAAGGCAGTGTGGATCACTTGATGTCAGGAGTTCAAGACCACCCTGGCCA
ACAAGGTGAAACCCTGTCTCTACTAATAATACAAAGGTTAGCTGGGCAGGTGGTGCATGCCTGTAATCC
CAGCTACTCGAGAGGCTGAGGCATGAGAATCACTTGAACATGGGAAGCAAAGGTTGCAATGAGCCAAGAT
TGCGCACTCCAGCCTGGACGATGAAGTGCGACTGCCTCAAAAAAAAAAAATGATGACTTTCCCAAGACC
TTGTCTCTCTTCTCCCAACAAGGATATACCCTCTGTGGGTGCCTGATGCCTGCTAGCCCGTGGGCAGCCT
CTCTTCCTCTGCTCTCAACCACACCTGCTCCCAGGGCCATCTGGCTTGCTAGCTATCTGACGTCTGCAGT
CAAAGCCCAGCCAACGTGCCCTGTGAGTGGACAGCCCAGGAAGGAGTTAGGAAGTAATTCTTGGCCCACC
TCCCTGGAAGAACCAGATAAGAAGCTATTTCTGTCGCAGGAGATGCCTCTGAGGCTCAGATAGGATTCAA
AGCAAATGGAGGCAAATAAGAGGGAGTTACAAACCCTATTGGGGTTGGGATAGAAGCAATGTTGAAAGAA
ACCAGGGTCAGGTTTTTTGGGAGAAGCAAGCCTGGGTCTGACTTTTGGGGACTAGGACTCAAATGACTT
ATCATCACTGTAGCAACGACTTACCCCAGGACTGACTATTGGATTATGTCTCAAAGGGCAGCAGAAGTGG
GACATATCACAGCCTACTTGACAGCCAAAAACCATCTCCCCTCTTTTTCCTTTGCTAAGAGAACCCTGAG
CCCTAGAGGCTCAGCTTCTCCCCAGCTTAGAGGGAGAATCTTGATTGGTCAAATCAAATCATGATCATTC
CATCCTTTTTGCTTGTGATTGGTTTAGAAAGGGGCAAATGATACAGTTCTGGCCAATGAGATGTGAGGAA
AAAAACACTGCCTTCCTTTTCTCCTCCTTTAGCCTTTCAAAGTTGCTGGGAGGGAGCTTGTTCCTAGTGC
AACGACAGCCACTTTTTTTTCTTTCTTTTTTTGTGACAGAGTCTCACTCTGTCGCCCAGGCTGGAGTG
CAATGGTGCAGTATTGGCTCACTGCCAACCTCTGCCTCCCGGGTTCAAGCGAATCTCCTGCCTCAGCCTCC
CAAGTAGCTGGGATTACAGGTGCGTACCACCACACCCAGCTAATTTTGTATTTTTAGTAGAGATGGGGT
TTCGCCATGTTGGCCAGGCTGATCTTGAATTCCTGACCTCAGGTGCTCCGCCGGCCTCAGCCTCCAAAAG
TGCTGGGATTACAGGCATGAACCACTGTGCCCAGCCTACTTTTTGACCACAAAGTTTGGGATCCACACAT
```

FIGURE 20 cont'd

```
TGAGGATGGTGAAGCAGAAAGATGGAGAGACCTGAGTTTTCGATGATACCATGAGCCCCTAAATTAATCT
TCCCTGGAGCCATGCTGTCTCAAGATGTTCGGGAGGATAACACATTTTCTTTGATGTTTAAACCTCATTG
AATTGGATTCCTGTTACTTGCAGTCAAAAGCATCCTGACAAATACAGCCCCCAATGGTGCAACTGCTACA
TCTCCTTGCTACAAGTGGCCACGTCCTGCTCAAAGCCCTGCTCTGCCTCCCCTGCACCCTTTGCCTAACT
TCAATGCCCTCTAGGACATGGGCCCTGCCCACAGGTCCTGTCTTCCTCCCTGGCTTCACTTCTTGCCATA
TCCCTAATCTCACCCTCTGGTCCAATCACACTAACTACTCAGAGGCTGTATGAGCTTCCAAACTTCCACA
CTATTGAAAATGCAGTTCCCGGCCTTGTGCGGTGGCTCATGTCTGTAATCCCAGCACTTTGGTAGGCCAC
AGTGGGTGGATCGCTTGAGCTCAGGAGTTTGAGACGAGCCTGGCCAACATGGTGAAACCCTGTCTTTACT
AAAAATACAGAAAAAAATTAGCTGGGCGTGGTCGTGGGCACCTGTAATCCCAGCTACTTGGGAGGCTGAG
GCAGGAGAATTGCTTGAACCCGGGAGGCGGAGGTTCCAGTGAGCCAAGATTGCGCCACTGCACTCCAGCC
TGAGGGACAGAGCAAGACCCCGTCTCAAAAAAAAAAAAGAAAAAGAAAGTAAAATTTAAAAAAAAATTAG
CCAGGTGTGGTGACACATGCCTGTGATTCCAGCTAATCAAGAGGCTGAGGCAGGAGGATCGCTTGAACCC
AGCAAGCAGAGGCTGCAGCAAGCCATGATTACGCCATTGCACTCCAGTCTGGTAACAGAGTGATACCCTG
TCTCAAAAAAAAAAAAAGAGAAAGAAAGAAAATGCAATTCCCTCTGGAGTCAGATGCTCTTGGATTTGA
ATTCCAGCTCCAGCACTGTCTAACTGTGTAACCATGGACAAGGTCATTTACCTCTCTGGGCCTCAATCTG
CTAGTCAGTAAAAGATGAATAGGGCTGGGCACAGTGGCTCACGCCTGTAATCCCAGCACTTTGGGAGGCT
GAGGCGGGAGGATCACCTGAGGCTGGGAGTTCAAGACCACCTGGCCAACATGGCGAAACCCTGTCTCTAC
TAAAAATACAAAAATTAGCCAGGCCATGGTAGTGCACACCTGTAATCCCAGCTACTCAGGAGGCTGAGGC
AGGAGAATTGCTTGAACACAGGAGGCAAAGGCTGCAGTGAGCCAAGATTGTGCCATTGCACTCCAGCCTG
GGCAACAAGAGTGAAACTCCGTCTCAAAAAAATAATAATAAAATAAAAATAATAAAATAATAAAAATA
AAAGATTAATAACTACAGCCAGACATGGTGGCTCACGCCTGTAATCCCAGCACTTTGGGAGCCCGAGGCA
GGCAGACTGCTTGAGCCCAGGAGTTCAAGACCAGGTTGGCAACATAGCAAAACCTTGTCTCTACCAAAA
ACACAAAACATTAGCCAGGCATGGTAGTGTGCGCCTGTAGTCCCAGCTACTCGGGAGGCTGAGGTGGGAG
GATTGCTTGAGCCCAGGAGGCAGAGGTTGCAGTAAGCCAAGATTATGCCACTGCACTCCAGCCTGGGCGA
CAGAGCAAGACCCTGTCTCCAAAAAAAAAAAAAAAAAAAAAGTCTGCCTCAGAGAGATGTCAGGATT
AAATAAATGTTGTAAGGCATGTGGTGAGTATTAAGGACTCAAGAAGCAGGTGTTTCTCACTTATCAGCC
TTTCTTGCCCATACTTCCTAGGTCTCCGATTCTGTGTGTTAGGGTTGTCTCCTCCACAAAACTGGGAACT
CCTAAAAGAAATTGCCGGGCACAGTGCCTCACGCCTGTAATCCCAGCACTTGGGAGGCCGAGGCGGGTGG
ATCACGAGGTCAGGAGATCGAGACCATCTTGGCCAACGTGGTGAAACCTCGTCTCTACTAAAATTACAAA
AATTAGCCGGGCATGGTGGCGTGCACCTATAGTCCCAGCTACTCAGGAGGCTGAGGCAGGAGAATCGCTT
GAACCCAGGAGGTGGAAGTTGCAGTGAGCTGAGATCGTGCCATTGCACTCCAGCCTGGGCGACAGAGCAA
GACTCTGTCTCAAAAAAAAAAAGAAAAGAAAAGAAAGAAACTGGGCTTGCTCTTCAAACCCAGAGTT
GGCTGGGCAGTAGCTCACGCCTGTAGTCCCAGCACTTGGGAGGCTGAGGCAGGCAGATCGCTTGAGCCT
AGGAGTTTGAGAGCAGCCTGGGCAACATGGCAAAACCCTGTCTCTACCAAAAATACAAAAAACTAGCTGG
GCATGGTGGTGTGCATCTGTAGTCCTAGGTACTTGGGAGGGTGAGATGGGAGGCTAAGGTGGGAGGCTTG
CTTGAGCCCAGAAGGTTGAGGCTATAGTCAGCCTGGATAACAGAGCAAGACCCATTTCAAACAAACCAAC
CAACCCAGAATCAGTGTTCTGTGAATGGAAAATGAATGCCAGGGCAGGACAGGCTCATTTAGCAGGAGG
GAAGAGGTGCCATAGCCCAGGAGACAGGCCCAGCTCAGAGGTCACCTCAGAAGAGGTGATCAGATGCTCA
GTCTGGATCCATCACACCCATCACCTCCGCAGTCCCCTACGCCTCACTCCCCTGTGATTGTCTGTGTAGG
GTCTGTGTCCCAACTAGGCTGAGAGCACTTTGAGGGCAGGGACCTGGTCTGACTCTTCTCTGTGTCCCC
AGAATCCAGCAGAGATCTCATACGCTACATGCTCAGCAAATGAACATTTGTCAACTTTGAAGCCAGAGAA
ACTGCCAGATCCCCTGCTCGCCCAGCCATCCCAGATCTGGGTCCCCCTCCTTTCCCACAGGAACATGCTA
TAAATGGACAGCATACCAGCTGATGCCAGAATCAGGGCTTGCATTTCACAAACCAAGTGGCCTGTCCCAG
AGTGGGGGTGGGGTCCTGGGGCCCCGGAGTGTGGCCATAAATAGCCCAACTCTGAGGCCTCCTCCCCTC
TCTGATTTCTGCCTGAGTCACCCGACAAGGCAGGGTGGGCTGCCAAAGCCTATGGCCTAGAGAGCTGAG
GGCACGACCACAGCCCTGTGGCCAGCATTCTCGAGACTCCAAAGATAGGCCCGGCCAGTGCCCCCACCCT
CCCCAGCCAAGCCCCTGGCCTGGGAGCCTGATAAGCAGTGACACATGGGCCCTTCCTCCTCAGGGAAGCT
GAGGCACCTATAAACAGAGGCCCCAATTTCCAGGGAGCTCCAGCTCTGCCAAGGAGGGAAGCCAGGATCT
GGCTCTGGCCCCAAAGAGCCAGGAATAGATTCCACTGGAAACACATGGAAGAGAAACAGGGCAGGATCAC
TCATCAGGCCCAGTATAAGTGGACTGGGGGTCACATATGCGTTGCTGAGAGAAGGGAACACATCTGTTTG
GGCAACAGGATCTCCAGTACTTATCCCAGTGCTTAATAAATGTCTGTGACTGAATGTCCTGGCTGAAGGG
AAGCCTGTCCTCTAAGCTCAAGCTGTTCCTTGTCTGTTCAGTGGGTGGTCATTTACTTACCGCTGCTTGA
AATTAGATGATAGAGCCATTTGTTTACTAGCCATGGCCTTTCTCCCCTAACCAGAATGTCAGTTCCCGG
AGAGCAGGGGCTGCCCTGTTTTCCAGTTCACTAGGGTATCCTCACCATCAAGAATAGTACCTGACGGCCG
GGCGCGGTGGCTCACACCTGTATTCCCAACACTTTGGGAGGCCGAGGCGAGTGGATCACCTGAGGTCGGG
AGTTGGAGACCAGCCTGACCAACATGGTGAAACCCTGTCTCTACTAAAAATACAAAATTAGCTGGATGTG
GTTGCGCATGCCTGTAATCCCAACTACTTGGGAGGCTGAGGCAGGAGAGTGGCTTGAACGTGGGAGGCAG
AGGTTGCAGTGAGCCAAGATTGTACCATTGCACTCCAGCCTGGGCAACAAGAGTGAAACGCCATCTCAAA
AAAAAAAAGAAAGAAAGAAAAAAAAGAAAATAGTACTTGACATATACCAAGTAAGCAGTAAAAGAAA
TCTGGGCCAGGCACAGTGGCTCACACCTGTAATCCCAGGACTTTGGAAGCCTTAGGTGGGAGGATTGCTT
GAGCCCAGGAGTTTGAAACCAGCCTGGGTGACATAGGGAGACCCTGTCTTGAAAAAATTAAAAAAAAAAA
```

FIGURE 20 cont'd

AATTTTGAGACAGGGACTCACTCTCACCCAGGCTGGAGTGCGGTGGTATGATCACAGCTCACTGCAGTCT
TGACCTCCTAGGCTTAAGCGATCCTCCCACCTCAGCCTTCCGAGTAGCTGGGATCAGAGGCTCATGTTAT
TATGCCTGGCTAATTTTTTTATTTTTTGTAGAGATGGGGTTTTGTCTTGTTGCCCAGGTTAGTCTCAAAT
TCCTGGGCTCAAGCAACCCACCCATCTCAACCTCCAATGTGCTGGGATTACAGGTTTGAGCCACCGTGCC
TGGCCTACAAAAAATTTTTAAAAACTAGGCCGGGCACAGTGGCTCGTGCCTGTAATCCCAGCACTTTGGG
GGGCCGACGCGGGCAGATCACAAGGTCAAGAGATTAAGACCATCCTGACTAACACGGTGAAACCCCGTCT
CTACTAAAACTACAACAAATTAGCCAGAAGTGGTGGCACACGCCTGTAGTCCCAGCCACTCGGGAGGCTG
AGGCAGGAGAATCGCTTGAACCCAGGAAGCAGAGGTTGCAGTGAGCCGAGATCACGCCACTGCACTCCAC
CCTAGGTGACAGAGCGAGACTCCATCTCAAAAAAAAAAAATTAGCCGGGCATGGTAGAGCACACCTGTAG
CCCCAGCTACTCAGGAGGCTGAGATGGGAGGATCACTTGAGCCAGGGAGGTCAAGGCTGCTATGATCATG
CAACTACACTCCGGCCTGGGTGACAGAACAAGACCCTGTATCTATAAATAAGTACGTAAGTAAATAAAAG
AAAAAAATGTGTTAGATGAATAAACACTGAAAGCCCTGGGGCTTCTCAGTGTGGAGCAAAAACATTGAAA
GTGGGTCTGGGGCCGGGCATGGTGGCTCACACCTATAATTCCAGCACTGTGGGAGGCCGAGGCAGGGGGA
ATCTTTTGAGCCCAGGAGTTCAAGACCAGCTTGGGCAACATAGCGAAACCCCATCTCTACTAAATATACA
AAAAATTAGCCAGGTGTGGTAGTGTGCAGCTATAGTCCTACCTACTAGGGAGGCTGAGATGGGAGAATTA
CTTGAGCCTGGAAGGCAGAGGTTGCAGTGAGCCATGATTGTGCCACAGCACTCCAGCCTGGGCCACACAG
TGAGAACCTGTCTAAAACAAAAAGGAAAGAAAGAAAGTGGGCCCTGGAGTGAGGCAGGCTTGTAATAACG
TCCTTGCTCTGTGACCTTGAACAAGTGACTTGACCTCTGCGAGCCTCTGTTTCCTTATTTTAAAAATGGA
AGGGCCGGGCACACTGGCTCCCGCCTGTAATCCCAGTGCTTCGCGAGGTCGAGGCGGGCAGATCAACTGA
GGTCAGAAGTTCGAGACCAGCCTGGCCAACATGGTGAAACCCTATCTCCACTAAAATACAAAAAAAAAT
TAGCCAGGCATGGTGGTACATGCCTATAATCCCAGCTACTTGGGAGGCTGAGACAGGAGAATCGCTTGAA
TCAGGGAGACAGAGGTTGCAGTGAGCCAAGATCGTACCATGGCACTCCAGCCTGCGTGACAGAGCAAGAC
TCCGTCTCAATCAATCAATAAAACATTAAAAAAAAATAAAGTAAAATAGAAGTAAAATATATCT
ACTTTAAAGGGTATTAAAAGATTCAGCTGGGCCAGGCGCAGTGACTCACGCCTGTAATCCCAGCAGTTTG
GGAGGCTGAGGTGGGCAGATCACCTGAGGGCAGGAGTTCAAGACCAGCCTGGCCAACATGGTGAAACCCT
GTCTCTACTAAAATACAAAAAATTAGCCAGGTGTGGTGGCACACGCCTGTAATCCCAGCTACTTGGGA
GGCTGAGGCAGGAGAATCGCTTGAACTCAGGAGGCAGAGGTTGCAGTGAGCCAGGATCGCCCACTGCAC
TCCAGCCAGGGTGACAGAGCGAGACTCCTTCTCCAAAAAAAAAAAAAAAGATTCAGCTGCAGGTTGGGC
ACAGTGGCTCATGCCTGTAATCCCAGCACTTTGGGTGGCCGAGGCGGGCGGATCACTTGAGGTCAGGAGT
TCGAGACCAGCCTGGCCAACATGATGAAACCTCGTCTCTCCTAAAAATACAAAAATTAGTCAGGCATGGT
GGCAGACACCTGTAATCCCAACTACTTGGGAGGCTGAGGCAGGAGAATCACTTGAACCCGGGAGGCAGAG
GTTGCAGTGAGCCAAGATCGTGACATTGCACTCCAGCCTGGGTGACAGACATCTCAAACAAACAAACAAA
AACAAAAAAAAAGATTTGTCTGGGCTCAGTGGCTCACACCTGTGAGCACTTTGGGAGTTCAAGGCAGGAC
GATCGCTTGAGCCCAGGAGTTTAAGAGCAGCCTGGCCAACATGGCAAAACTCCGTCTCTACCAAAAATAC
ACAAAATTAGCCAGGTGTGGTGGTGCACACCTATAATCCCAGCTACTCAGGAGGCTGAGGTGGGAGGATC
ACTTGAGCCCAGGAGGTTGAGGCTAAAGTGAGCTGTGATTGTGCCACTGTACTCTAGCCTGGGTGACAGA
GAGAAACCCTGTCTCAAAAAAAAAAAAAAAAAAAGCCAATTTAAAAATAAATAAATAAGTGAAAGATTCAA
TACCTGTAAAGCACCTTCTCCTGCCTGGCATAGAACAGGGCTGTCTGGAGATAGCAGTGTGGTTATGATT
TCTGCTGCTGTTCCTAGTGTGACAGTATAAGGGGATAGGCATGTAATGTGGTGACAGGCAGACAAGGATT
TGAATCCAGGCCCCGTAATATCACTTGCATGAGGCAAGGTCTCTCTGAGCCTCAGTTTCTTTGCCTATAT
AATGGGCACTGATATGTCAACCCTCAACTTGAACTTGAGGATTCAAGTTCCAGCTGCCCACCCATCCACC
CAGGATGGTGTGAAGAGGACTTGGGATTCCAACAGGCCCTGGAAGGGATGACCTTTAAGGTCTTGCTGGT
CTAGCAAGGCTGAACTATAAATAGTCCCCAGACTCTGGCAGGCCCTATAACAGGGATGACCAGCAGAGCC
CAGGGGTTGCCACACTTTGGGGGATAAAATCTCACCTTACCACACCCTTGAGTAGTACAGGGGTTACAAC
CTATACAAAATCCCAAAAGCATGTGACCCTTTTGACCTAACAGCAACCCTTCCAGGAACCACCCTTCAGA
TGAGTGCTCACAGGTGCACAGAAGGCTTATAGCGCTATTGTCCATCCTGCAAGAGGCTAGGGACAACTTG
AATATTCATGAATAGGGCTGCTAAAAACAAGATGTGAACTCCCTGACTGGCAGACACTCACTACTCAGT
CTTGTTCATAGCTATATCCTTGGTGCCTGCATCTAGTCCTGGCACAGAGCAGGGGCTCAGTAAATATATG
TTACATGAATAAACAAATCCATGGGATTTTTTTTTTAATTTGTAGACATGGGGTCTTGCTATGTTGTCC
AAGCTGGAGTGCAGTGGCTGTTCACAGGTGCATCATAGTGCACTCCGGCCTCGAATTCCTGGCCTCAAAC
AATCCTCCAACCTCAGCTTCAGGAGTAAATAGGACTACAGATGTGTAGTCCTCCAGCCCAATAATGGGAC
ACCACATAACCATTAAAAAGAATGAGGGGCCGGGCACAGTGGCTCACACGTGTAATCCCAGCACTTTGGG
AGGCCGATGGTGGGCAGATCACCTGAGCTCAGTAGTTCAAGACCAGCCTGGGCAACATGGCGAAATCCCA
TCTCCACAAAAAGCACAAAAATTTAGCTGGGTGTGGTGGTGTGCACCTGTAGTCCCAGCTATTCAGGAGG
CTGAGATGGGAGGATCGCTTGAATCCAGGAGGTCGAGGCTGCAGTGAGCAATGATTATGCCACTGCACTC
CAACCTGGGCAACAGAGTGAGACACTGTCTCAAAAAATTATAAAATAAAAATATTAAAAAGATAAAAA
AGAATGAGACTTACATGTTCTCAACTTATTACGTGATAAAAGCAAATATGGAAACTTACTGGAAGAAAAT
GTGTGAAAGTATCAACACTGGTTATCTCTATAAGATGATCCCTTTACACTCTCGTTGGTAATTTTTTTT
TTTAAGAGACAGTGTCTTGCTTTGTTGCCCAGATTAGAGTACAGTGGCATAATCATAGTTTGGGTACAGC
CTTGAACTCCTGGGCTCAAGCAATCCTCCTACCCAGCCTCCTGAGTAGCTGGGATTACAGGTGCACAACA
CTATGCCCAGCTAATTTTTAAAAAATTTTTTGGCCAGGCACAGTGGCTCACGCCTGTAATTCCAGCAGTC

FIGURE 20 cont'd

```
TGGGAGGCCGAGGCAGGTGGATTGCTTGAGGTCAGGAGTTCAAAACCAGCCTGACCAAGATGGTGAAACC
CCATCCCTACTAAAAATACAAAAATTAGCCAGGTGTGGTGGCAGGCGCCTATAATCCCAGCTACTTGGGA
GGCTGAGGCAGGAAAACTGCTTGAACCTGAGAGGCAAAGGTTGCAGTGAGCCAAGATCGTACCACTGCAC
TGCAACCTGGGCAACAAAGCAAGACTCGGTCTCAAAAAAAACAAAAATTTTTTGTAGGCCAGGCACGGTG
GCTTATGCCTGTAATCCCAGGACTTTGGGAGGCCTTAGGCAGATCACTTGAGGTCAGGAGTTTGAGACTT
GGCCAACATGGTGAAACCCCACCTATACTATATACAGAAATTAGCCAGGCATGGTGGCACATGCCTGTGA
TCCCAGCTACTTGAGAAGGTGAGGTAGGAGAATTGCTTGAACCCAGGAGGTGGAGGTTTGATTGAGCCAA
GATAGTCCACTGCACTCCAGCCTGGGTAACACAGTAAGACTCCACCTAAAAAAAAAAAAAAAAAAAAAAA
AAAAAAAAATTGGGTCAGGCATAGTGGCTCATGCCTGTAATCCTAGCACTTTGGGAGTCCGAGGCAGGTG
GATCACCTGAGGCCAGGAGTGGCGAAACCCCATCTCTACTAAAAATACAAAAATTAGCCAGATGTGTTGG
TGCGCGCCTGTAATCCTAGCTACTCGGGAGGCTGAGGCACGAGAATCGCTTGAACCCAGGAGGCAGAGGT
TGCAGTGAGCCGAGATCATGCCATTGCACTCCAGCCTGGCCAACAAGAGAGAAACTCCATCTCAAAAAAA
CAAAAACAAAACAAAAAATTGTAGAGACGAGGCCTTGCCATGTTGCCTAGGCTAGTCTCGAACTCCTG
GTCTCAAGGAATCCTCCCACCTCAGCCTCTGAAAGTGCTGGAATTATAGGCATGAGCCACTTATTTTTTT
TTCGAGACAGGGTCTCACTCTGTCACCCAAGTTGGAGTGCAATGGCACAATCTCAGCTCACTCCATCCTC
CACATCCCAGGCTCAAATGATCCTTCAGCCTCAGCATCCCAAGTAGCTGGGACTACAGGAATGTGCCACC
ATGCCTGGCTAATTTTTGTAACTTTTTTTTTGGAGAGACAGGGTTTCGCTATGTTGCTCAGGCTAAGCTGG
ATATTTTTGAATGAGTATGTATTACTTTTTAAATTTTCTAAAAAATCTAGTTTATTTTTCAAAAATATAC
CACCACATACCAAGCCATACAAGCCATAGTTCAGAGATAATGCTCGTATCAACTCGGAAGCCTAGATTCA
GGGTTCTAGAATCTTAGTGATGGGAGAAAGCAGTACTTATTGAGCGCCTACTATATATTGGGGCCAAGCT
CAACTCTCTCGAACACACCTTCACCTTATTTCACCAATTTGATGAGATGAATTAATATCCTTATTTATGT
TCATTTTTATTACTTTTTTCTTTTTTTTTTTTTTTGAGACGGAGTCTCACTCTGTCGCCCAGGCTG
GAGTGCCGTGGCGTGATCTCAGCTCACTGCAACCTCCACCTCCTGGGCTCAAGCAATTCTCCTGCCTCAG
CCTCCTGAGTAGCTGGGACTACAGGCACGCGCTAAATTTTGTATTTTTAGTAGAGACGGGGTTTCACCAT
GTTTACCAGGCTAGTCTTGAACTCCTGACCTCAGGTGATCCACCCGCCTCAGCCTCCCAAAGTGCTGGGA
TAACAGGTGGGAGCCACCGCACCCAGCCATAGTATCTTTATTTAATGGGTGAGTAAACTGAGTCTCAGAG
AAGTGACATAACCTGTAGTGCAGATAAGTATTTAAGAAAATGAGTTTTCGCCGGGCGCAGTGGCTCACAC
CTGTAAATCCCAGCACTTTGGAAGGCAGAGGAGGCGGATCACATGAGGTCAGGAATTCGAGACCAGCCT
GGCTAACATGGTGAGATCTCATCTCTACTAAAAATACAAAAATTAGCCAGGTGTGGTGGCACATGCCTGT
AATCCCAGCTACTTTAGAGACTGAGGCAGAAGAATCACTTGAACTGGGGAGGCGCAGATTGCAGTGAGCC
GAGATCGTGCCACTGTACTCCAGCCTGGGCAACAGAGCGAGACTCCGTCTCAAAAAAAAAAAAGATTAT
GGGTTTTCAGCCAGGCACACTGGCTCACACCTGTAATCCCAGCACGTCAGGAGGCTGAGGCAGGAGAATC
ACTTGAGTCCAGGAGTTTGAGACCAGCCTGGACAATATAGTGAGACCCTGTCTCTACAAAAAATCAAAAC
AATAATAGCTGGGTATGGTGGCACATGCCTGTAGTCCCAGCTACTGGAGAGGCTGTGGTGGAGGATCAC
TTGAGCCCAGGAAGTCGAGGCTACAGTGAGCCGTGATCATGCAACTGCATTCCAGCCTGCATGACAGAGT
GAGACCCTGTCTCTTACAAAATTTTTGTTTTGATTAAAATATATATATATGAGTTTTGGCATCTGAAAG
ACTTGAGCTCATATTCCATCTCTGCCATACTGTGACCTTGGGCAAGTAATGTCACCTCTCTGAGCTTCAG
TGTTCTCATCTATACAATGAACAATGTACCTAATTCACAGGGATGACATTGAGGATTCAATTAAATAACA
TAGGGAAGGGCCGGGCACGGTGGCTCACACCTGTAATCCCAGCACTTTGGGAGGCCGAGGCGGGTGGATC
ACCTGAGGTCAGGAGTTCGAGACCAGCCTGGCCAACATGGTGAAACCCCATCTCTACTAAAAATACAAAA
AATTAGCCAGGCATGGTGGCACGCGCCTGTAGTCCCAGCTACTCGGGAGGCTGAAGTAGGAGAATCGCTT
GAACCAGGGAGGTGGAGGTTGCAGTGAGCCGAGATCGTGCCACTGTACTCCAGCCTGGGCAATGGAGCGA
GACTCCATCTCAAAGAAAAAAACAAGCATAGGGAAGGGACTTAGCACAGTAGGTGCTCATGGTGTTGAGC
ACAGTGTGGATGCTCAATAAGCAGCAGATGCTACCATCCTGATTATTATCACTATTATTTCCTCCACCAC
CAGCAGCAGCCAGGGTCACACAGCTCGTCAGGGCCAGAACCTGCCTACAGAGGCCCACAAGACATTTTAA
TCAAGGTCCGGGGAACAGGCCAGGGCTGGATTAAGCCAAGTTTTGTTTGTGGGGAGTCACATGGTCCAAA
GCTATGCGTGTGCACAGCCAAGTAAACTTTTCCTTGAGAACAATGGTCAGAACAACAGGTCTTTGCGGCC
ATGGGAGAACTGAACAGGAGTTCCATTCATGCCCTCTTCCTGGGACAGGGGTCCCTCCAGCATCTCTGGG
GCACAGCATGACTCAGCTAAGTTGAAACAGGGTGGCCCCAAATTAGCTACATCCAGAATGACATCCCGCT
TTTGACAGTGGTGATGCATCAAGCCAGATCAAAGGCAGGACACCTGGCAGTGGCCATCTTCCTGGGAAGA
GCCAGTAGGGAGCTGGCCTTAGAGTTCTGAGGACTCAGAACAGAAAAGCTCAAGAGTCAGTCAAGCTCAG
CATGATTCTCAAGTCCCATCTTAAACATTTAGGAAAGTCAACAGCAATTGAAAAGGTGAAAGGTAAAGTA
GAAAGGGTCCAAGATATACCCCACTGATCAGTCTCCAAACACTCACCAAGATCTAATGTATGTTGGGCTC
AGTGCCAGACCTGGGGGCTGAGAGACAAGCTACATGTGGTTCCTGCCCTCAAACAGCTTCCAGTTTACTA
AAGAAAACAATAACAGGATCAGGCGCAGTGGCTCATGCCTGTAACCCCAGCACTTTGGGAGGACTGCTAG
AGCCCAGGAGTTCAAGACTAGCCTGGACAACACAGGGAGACCCTGTTTCTATTAATTTTTTTAATTAGG
CAGGTGTGGTAGCACATGCCGTCGTCCCAGCTACTTGAGAGGCTGAGATAGGAGGATCGCTTGAGCCCAG
GAGTTGAGGCTGCAGTGAGCTGCAATCACACCTCTGTGCTATAGGCTGGGCAACAGAGTGAGATCCTAAA
TAAATAAATAAAAGCCTGATCTCTATGAGGGCTATACCTTCCTTACTTTATATAAAGCACTAAAATTCAC
TTTATTAATTTTTTTTTTTGAGATAGAGACTCACTCTGTCACCCAAGCTGGAATGCAGTGGTGCAATCT
TGGCTCACTGCGACATCCACCTCCTGGGTTCAAGTGATTCTCCTGTCTCAGCCTCCTGAGTAGCTGGGAT
```

FIGURE 20 cont'd

```
TACAGGTGCCTGCCACCACGCCCAGCTAATTTTTATATTTTTCGTAGAGATGGAGTTTCACCATTTTGGC
CAGGCTGGTCTCGAACTCCTGACCTCAGGTGGTCCACCCACCTCAGCCTCCCAAAGTGCTGGGATTACAG
GCGTGAGCCACCTTGCCTGGCCTTAGTATTATTTTTGTTTTTTGTCGGGTTTTTCTTTTTTCTTTTTTT
TTTGAGATGGAGTTTTGCTCTTGTTGCCCCAGGCTGGAGTACAATGGTTCGATCTTGGCTCACTGAAACC
TCTGCCTCCTGGGTTCAAGCAATTCTCCTACCTCAGCCTCCCGAGTAGCTGGGATTACAGGCGCGTGTCA
CCATGCTCAGCTAATTTTTGTATATTATTAGTAGAGACGGGGTTTCACCATGTTGCCCAGGCTAGTCTCG
AACCCCTGACCTCAGTTGATCTGCCTGCCTCAGCCTCCCAAAGTGCTAGGATTACAGGCATGAGTCACCG
CGCCCAGCCAGCATTATTTTAATGCATGACAGGCTCACTGTTGTCACAGTCCTGCCAGCCACACTGGAA
TGGGAGGAGGGAAGGGTGTTTTCCTTGAGGCTGTCCCTCCCTCTTCCCCCAGGCCTGGCCTTCAAGGGCC
CAGGCTGGCCCTGGCTTGAGGTCTGCACACACAACGGGCCTCTCGAAGCAGCGGACAGACACTTGTTGGC
TGCCAACTTGGGCCCAGACTGTGGTCACAAACACACCCCTCTGGCTGAGAACAGGATCAGGACATTTCTG
CAAACCCCTGACCTAGTAGAAGAAATGTTCTAGGAGGCAGGTTGGGGTTGCTGAGGCTCAGCTGAGCCCC
CAACTTAGGCCAGGGAAGTAAGGCTCTAGCTGACACCTGGAGTTTGCTGGTAATGCTTGTTCTCCCAGGA
CATCCTCAGGGGATTCACTATCCACTGAGCTGGAAAAATATCCAGTTGCCTTGCCAAGTTCACATCCAAA
GGACAGGCCATCCTTCCATGGCCCCTTGGAGGCGTCCTCAGTAATGGGATGTGAGTGGGGAAATGTTGAA
CAATGTGGTCAGTGATTCAACTCCGGGGAAACCTAGGCCCAGAGAGGGTCCCAGGAACCCTGGCTGCTCC
AGACTGGTGCAACTGCCAGGCCCAGACCTTCTCCACTCCCCAAAGTCTCAAGGACCAGCCACAGCCCAGC
ATCCTCCTATCCTTCAGACCTCTCTGATCACTCTTGCCATTCAGAGATTCCTGACTCCAGTGCCTTCCAC
CACTCCTCCTCCCCTCTTTGTGCTATCTTGAGTGGAATGACCTCCTTCCATGAGATCTTGGGCCAGGAGA
ATAGGTCGAAAAGACTTCAACTAAGGAAAAGTGGGGAAAAACATGAAGGCCACATTCTTCTTTCTCTTA
CCCAGGCCATAGGCAGGGTTCACCAAGGAATGATCTCGTCCTGTGAAACATCTCAGAGAATATAAGAGCA
GGGGCCCCTCAGTCCTGGGATGATACACATGTTACTTCTCTACTGCATCTGTAGTAGACATTGCTAATCA
ATTCCAGCTCCTTTCTGCTGAGCCCAGACAAAGCCTCCCAATCCTTCCAAATATGGAACTCACAGAACCA
CCAGTGGAGCTGACGCTTACACTCTTTTTTTTTTTTTTTCCTACAGAGATGAAATCTCACTGTGTTGCCCA
AGCTGGTCTCGAACTCCTGGGCTCAAGTGATCTGCCCACCTAAGCCTCCCAAAGTGTTGGGATTACAGGC
GTAAGCCACCACGCCTGCCTGGAGCTGCCACTCTAAATAAAAGCTATTGATCACCTCTGATCTAGCCTAA
CTTCAATAGGAAAACTGAGTCCCCTAGAAGGCAAGGGTCTTACCCAAGGCCAAACAGAGATTTATTGCAG
AGCAGACAGGATTTCAGGCACCAGCTTTTTTTTTTTTTTTTTTTTTTTTTGAGATGGATTCTTGCTCT
TGTCGCCCAGGCTGGAGTGCAGCGGCACAATCACGGCTCACTGCAACCTCCGCCTCCCGTGTTCAAGATT
TTCCTACCTCAGCCTCCTGAGTAGCTGGGATTACAGGCACGCGCCACCATGGCTCAGCTAATTTTTGTAT
TTTTAGTAGAGACGGGGTTTCGCCATGTTGGCCAGGCTGGTCTCAAACTCCTGGCCTCAGGTGATCCACC
CGCCTCAGCCTCCCAAAGTGCTGGGATTACAGGCGTGAGTCACAGCACCTAGCCACCGGCTTTTAAAGAG
TTTCTGTAGGCCAGGCATGGTGGCTCACGTCTGTAATCCCAGCACTTTGGGAGGCCCAGGCAGGCAGATC
ACTGAGGCCGGGAGTTCGAGACCAGCCTGGCCAACATGGCAAAACCCTGTCTCTACTAAAAATACAAAAA
TTAACCAGGCCGTGGTGGTGCACACCTGTAATTCCAGCTACAGAACTGAGGCAGAGAATCGCTTGAACCT
GGGAGAAGGAGGTTGCAGTAAGCTGAGATCGCACTACTGCACTCCAGCCTGGGCAACAGAGTGAGACCCT
GCCTCAAGAAAAAAACACAGTTTGTGTAGAGGAGATAGTGTTTATGTTTTGTCTACCCTACCACATGGTG
AGCTCCTTCAGGAGAGGCCCTGGGTGTAGTTTAGCTTCTGACCTTAATATACACGCAGGCACACAGTAG
ATGTCCATGAATGTCTCTTGGCTTAGTGAGGAGGAATGCATGACATGAGTTAGAGGGAAGGCTTGAGTAT
TCACTCCTAAAGTCAGAAGATGCTTCAAGGTCACACATTTACAGATACTACCTTCTCAAAACGACATACA
TGGGAACCCAGATAGATACATTTTTAATCTAAAGATGAGGAGGTGGGCCGGGCGCGGTGGCTCACGCGTG
TAATCCCAGCACTTTGGGAGGCCGGGGCGGGCAGATCACAAGGTCAGGAGATCGAGACCATCCTGGCTAA
CACGGTGAAACCACATCTCTACTAATAATACAAAAAATTAGCCAGGCGTGGTGGCGGGCACCTGTAGTCC
CAGCTACTTGGGAGGCTGAGCAGGAGAATGGCGTGAACCCGGGAGGCGGAGCTTGCAGTGAGCCGAGATC
CCGCCACTGCACTCCAACCTGGGTGACAGAGCAAGACTCTGTCTCAAAAATATAAATAAATAAAAATAAA
AAATAAAGATGAGGAGGTGAGGGGACCTCCGTGTGAATGTGGATTTGAATTGTGTCTATAGCAGAAATTT
TACCATAGACTAAACTTTCAAACAACAGAAGCTAAAAGAGCTTTCAAGTCAACTAAAATATGACATTTCG
ATGAATGTCAGTGGTTTCAAACCGCATTGCTGACTATAAATATCAAAGTAATGAGGCATGTGGGGAAAGT
CTCTTATATCCATATCATTTATGTGGCATTCTATTATTTAACTTTGCCATTAAAATATGATTGATACACT
TAAGCTTCTAAGGATCAACACTCTAGAGTCAGCTTTTTTAAGTATCAAAAAAATGCATCTAGACTGGGC
ACTGTGGCCTGCAATCCCAGCACTTTGGAGACTTAGGTGGGAGGATCCCTTAAGCCCAGGAGTTGGAGA
CCAGCCCAGGCAACATGGTGAAACCCTGTCTCTACAAAAAATTGGCTAGGTGTGGTGGCTCACGCCTGTA
ATCCCAGCACTTTGGGAGGCCGAGGCAGGCAGATCACGAGGTCAGGAGTTCGAGACCAGCCTGGCCAATA
TGGTGAAACCCTGTCTCTACTAAAAATACAAAAAAAAATTAGCCAGGCGTGGTAGTGCGCACCTGTAGT
CCCAGCTACTCGGAAGGCTAAGGCAGAAGAATCGCTTGAACCTGGAAGGCGGAGGATGCAGTGAGCCAAG
ATCGCGCCACTGCTCCAGCCTGGGCGACAGAGTAAGACTCCATCTCAAAAAAAAAAAAAAAAAAAGCTA
GGCGCAGGGGCTCACACCTGTAATCCCAGCACTTTTGGAGGCTGAGGCAGGTGGATCACAAGCTCAGGAG
TTTGAGACCAGCCTGGCCAATATGGTGAAACCTCATCTCTACTAAAAATAAAAAAATTAGCCGGGCATGG
TGGTGGGTGCCTGTAATCCCAGCTACTCAGGAGGCGGAGGCAGAAGAATTGCTTGAACCCGGGAGACGGA
GGTTGCAGTGAGCCGAGATCATGCCACTGCACTCCAGCCTGGGCAACAGAGTGAGACTCCATCTCAGAAA
AAAAAAAAATTAACCAGGTGTGGTGGCATGCATCTGTAGTCCCAGCCACTCAGGAGGTTGAGGTGGGAG
```

FIGURE 20 cont'd

```
GATTGTTTGAGCCCCGGGGGGTGGAGGGTGCATTGAGCCAAGATCATACTACTGTACTCCAGCCTGGGTG
ATAGAGCAAGACCCTGTCTCGAAAAAAAAAAAAACAAGAAAAAAAAATGCATCCATGGCATTTAAATAG
ATATACCTAAAATATAAAATAAAACTTTACATTTTATTTTCTTTATTTAAATTTTATTTTATTTTATATC
TGGGTCAACCAAGGACCGAGAACCTATTTGCTTCTGTGGCCTCTTGGACACTCCTTTAGGGAAACCAAGG
CAACCCACCAGGATTTGGGCCTGGGACTCAACTCAGCAGCTTCTCTGGCCGTGTTATTCTCCATCAGCCC
CCGCCACCTCCCTGTGCCTGTTCTGGGCCATAAGCCAGAGACACATTCCTCAGGCCCCACGGGCTTCC
AGAGCTGACAGAGTTTGAGGAAAGGGCTGAGCAAAGCAGAAACCTCTTGAGAGACATGGCACAAGATGGT
CATGGGACAACCTCAGCAGGAGGCGTGTAACAACTGATGGGGAAACCGAGGCCCACAGAGGGCAAGGGTC
CCACCCAAGACCACACTGTGAGGGAACAGTGGAGAAAGCCATTCAACCAAGGTTCCTCCACAAAACTCCT
CTCTGATCCTGGCTGGAAGGATTTGATGTCCTACTCTATAAAAGCCAAGGCCTCTGGGCGTGGTGGCTCA
TGCCTGTAATCTCAGCACTTTGGGAGACTGAGGTGGGTGGATCACCTAAGGCCAGGAGTTCAAGACTAGC
CTGGCCAACATGGCAAAACCCTGTCTCTACAAAAATATAAAAATTAGCTGGGCATGGTGACGCACACCTG
TAATCCCAGCTACTTGGGAGGCTGAGGCAGGAGGATCACTTGAACCCAGGAGGCAGAGGTTGCGATGAAC
CAAGATCATGCCACTGTATTCCAGCCTGGACAACAGAGCAAGATTCCATCTCAAAAAAAAAATAAAGTAA
AATAAAAGCCAAGGCTTCTCCCAAAGGAGGATGGGTCTTGGGGTTTTAAGGCCCAGGCACTAAAAGAACC
TGAAGTCAAGAGCTCTCCAGGCCCCACAGGAAAGAATCTGACCTGCCCCTTCCCCAGTCCGCACCCCTCT
CTCCCTGTGTCACTCAGGTGCTGGCACACTCTGCCATGTACATTTTTGCCCTAGTCGCAACAACCCAGAA
AGGCAGGAGCTACATCCCTGTTTTACAAATGAGGAAACTAAGGATCAGGGAAATGAAGTGACTTGTCCAG
GGCTACACAGCTAGTGACTGGAAGACAGAAATGCAAATCAGGTCTGCTTGGCTCTATGCCAACTCTCCC
TCCACCACCCCACACTGTCTTCAGGCAGGTCCCCAAATTCTGTTTCTGTTTTCAGTCCTGCCCACCTCCC
AGCCCCAGTGCTGGGATGGGGCCTTCTGAGGCCTGGGGGAGGTAGAGAAGCAGTGGAACACCTCCACCC
AGCCCCTCTGAACCCTGGAACGTCAGTGCTTACCCTCCAGCACCACCTCCTTGCCTGTCTTCTTGAGGAC
CTGCACCGCCTCATCATGGGTAGCAGAGGACAAGTCTTCCCCATTCACAGACAGGATGGCATCCCCCACA
AAAAGGGCCTCTGTCTGGTCAGCTGCCAATCCCTTGAAGATCTTGGAAATGAGAATAGGCATCTTGTTCT
CCCGGCCGCCTGCACAGGTACAGAAGGAGGACAAGACTTAGGCAGATACTCCAACACTTGGGAGTCACAT
CAAGACACAATTATTTCTGAAGGCTTCCCTTGGTGCCTAGCCCAGTGCTGGAAAAGGCAATGGGAGAATA
AAGGGAATCTGAGAAAAATCTTGGAAGTTTGGGACACTAGTAACACTAATAATAAATCATTTTTGATTAG
GTCCGGTGGCTCATGCCTGTAATCCCAGCACCTTAGAAGGCTGAGGTGGGCAGGTCACCTGAGGTCAGGA
GTTCAGGATCAGCCTGGGCAACATGGGAAAACCCCGCCTCTACTAAAAATACAAAAATTAGCCAGGCACC
TGTGGTCTCAGCTACTAGGGAAGCTGAAGTAGGAGGATCACTTGAGCCCAGGAGGTCGAGGCTGCAGTGA
GCTGAGATTGTGCCACTGCACTCCAGCTTGGGTGGCAGAAGGAGACCCTGTCTCAATAAATTAATTAATT
AAATAAATCATTTTCAAAATTCATAATGCTATAGTTTGATCCCTGGATCTTTTGATTAAGTGCTTTGGGT
GTTCACCAGTGTTTGTGCAACTTACAAAGTGCTTCAATCACTTTTTCTTAAATGTTTTCGATTTTCTCAT
GTAACCCATAAATATATATGCCTACTATGTACGCACAAAATTAAAAATGAAAATAACCGGACAAAGTGG
CTCACACCTGTAATCCCAACACTTTGGGAGGCCAAGGTGGTCGGATCACTTGAGACCAGTAGTTTGAGAC
CAGCCTGGCCAACATAGCGAAATCCTGCCTCTACTAAAAACACAAAAAAGGGCCAGGTGCGGTGGCTTAT
GCCTGTAATCCCAGCACTTTGGGAGGCCAAGGCTGCCAGGTGGATCACCTAAGGTCAGGAGTTCGAGACC
AGCCTGGCCAACATAGTGAAACCCTGTCCCTACCAAAAATACAAAAAATTAACTGGGCGTGGTAGCGGAT
GCCTGTAATCCCAGCTACTCGGGAGGCTGAGGCAGGAGAATCACTTGGACCCAGGAGGCGGAGGTTGCAG
TGAGCTGAGATCACGCCATTGCTCTCTAGCCTGGGCAACAAAGTGAAACTCTGCTCAAAAAAGTAAATA
AATACATAATAAAAAAATAAACAAATAAAAAAATATGGCTGGGCGTGGTGGCTCACGCCTGTAATCCCAG
CACTTTGGGAGGCCAAGATGGGCAGATCACCTGAGGTTAGGGGTTCAAGACCAGCCTGGCCAACATGGCA
AAACCCCATCTCTTCTAAAAGTACAAACATTAGCCGGGCATGGGGGCGCATGCCTGTAATCCCAGTTACT
CGGGAGGCTGAGTCAGGAGAATTGCTTGAACCGGGAGGCTGAGGTTGCAATGAGCCAAGATTGCACCATT
GCACTCCAGCCTGGGCAATAAGAGCGAAACTCCATCTCAAAAAATAAATAAATAAATAAATACAAA
CACAAAAAATTAGCTGGGCCTGGTGGCACATGCCTGTAGTCCCAGCTACTCAGGAGGCTGAGGCAGCAGA
ATTGCTTGAACCCAGGAGGTGGAGGTTGCAGTGAGCCAAGATCACACCACTGCACTCCAGCATGGGCGAC
AGAACAAGACTCCATCTCAAAATAAAACAAAATACAAAAATTAGCCAGGCATGGCGGTGTGTGCCTATA
ATTCCAGCTACTCAGGAGGCTGAGGCACGAGAACTGCTTGAACCCAGGAGGTGGAGATTGCAGTGAGCCG
AGATCGCACCACTGCACTCCACCCTGGGCAACAGAGCAAGACTGTCTCACACACACACAAAAAGGCAA
CAATGTGGGAACCCACTGATACCCCTCAAACCGGAATCAAGAGACAAGTCGGCTATTCCTATGGCCTCAA
AAGACTGCTTTAGCAATCATAATGTTTTACAATCCAAAGTCCAGGCTGGAAACCAAAGCCTTAGAGTCTA
GAGATTCTAAAAACCTGCCTGAATGGCATCTTGGATACAAAAGAAGCTAATACATTTTACTAAACATCTT
TATTACCAAACTCTTAAATGCCCTTTTAAAATAAGAAATAGTAATAAGAGTTCACCTTAGTTGCACTTAC
CAAATGCCAAGCACTGTGCTAAATGCTTTCAATGTTGATTCATTGCGTCTTTACAATACCCCATCACATA
GGTATGTTCAGTTTCCTATTAGGGAAACTGAAGTGTGGAGGGAAGCCCCTTGTCCAAGGTCACTCCACTA
GTAAGTAGCGAAGCCAGTATTTGCACCTAGGCCTCCAGGCTCCAGAACCAACACTATTAGCCCTACCACA
GACGACAAGTCAGGCCCTCAGATATCACACTCCTGGCTCATCCCCAGAATACTGAAGATGAAGAATTAGT
GGCCCAGAGTGGGAGGTCATTGTTCCAAGGTCACACAAGTCTGGTGGCGGAGCTGGGACTGGAACACCTC
TCTTGACGCCCACACAGGCCCGACCGTTTGCTTATCTGCACAGAGCTTGAAGTCTAGGAGAGGAAGGGGT
TTCTATTTATATCTGCCCTCCCCCACCTGAAACTAGGGGCTTCAGTTCAGTTTGAAGCTATGATCACTCA
```

FIGURE 20 cont'd

TGGCTGCCTCAGACTAAGCTAGACTTTATAGGAGGGGTTACCATGGCAACAGGAGCCCAGATTTGGATCC
AATGGAAATACCTGAAGTCTCCTAAAAGTACCCTCCCCTCCACCTAGAATTATGGAGCTGGGGAGTAACT
TTGTGTGACCTTGCAAAGTCCCTGCTCCTCTCTGAGTCTCAGTGTGTCCATCTGCAGAATGGAATTCTGT
ATGAATAAGTTCCTTCCTGCTTTGACACACTGAGTGTATAATTTTTGGATTCATCTGTTGCCCTATCCCA
TGCTGGAGATTGGGGGTAAGACTGGTGCCCATACCCTCATTTTCTCATTTCTCCTTTTTAGCCCCTCTTG
GTTGGCTGCCTGGGGATCTGCCCTTCTACAGGAAAGAATCAACTTCCCTGAGCACTCTCTGAGGGACAGT
AGCTGATAATTAAGGTTCAAATCCCAGCACTGACACTCACTATGTAATCGTGGGAAAATCATTTTAACTT
TCTGAGTCTCAGTTTCTTCACCTGCAATATGGGAATTATACTCCCTACCTTTCACCACTTGTTGCCAGGA
TGAAGTGGATCATGAGACTAGTGTCCTGGGCACAGCACCTGGCACACAGTGGTGGCATTCACCACCATCC
CCACCGCCTCAGCCAAGCCAAACGGTCTGGAGGCACTAGTCAACAGAACCAGTACCAGGGAGACCCCAGA
GGGTACGGTATGTATTCAAGGTGGAGACAAAGGCTGATACCCTTTCCCAAAGCACCTGCTGGGGCTGGG
ACCCTGAGAAACAGATGGGCAGGAATAGTGAACCCAGCAGCTGGGGTGTGCAAGGATTTTAACAACTAT
GTTTAGTTGCTTTGGGAGTATCTGCTGGCCTCCATTTTTCCTCTCCGCTAACAGCAGTAATTAACTAGGC
ACCTACAGTGTGCTGGTGTGGTGAGCCCTGCTCTCAGAAACATCACAACTCTGTCATCCTCTTATACAGT
TGAGGAAACAGATTCAGAGGCGGGACGGGACTTTTGCAACCTCACACAGCTGATCCTGGATTCAAACACA
GTCTGGTTGCACCCTAACTGCACCCCACTAGCGGTCAGTCCTGGGGCTGAAAGCTCTATCCTGTGCAAG
GTGGAGATAGTCAGATCAGGAGACCCAAATCCAGCTGTCAGGGCTCCCTGCAGCCTTCCTGGGTCCTTAG
ATTCCTAGGTCCTTGCTGGCCTTCTGCCTGTGACCCCAGCCTGTGCCTGCACCCAGGCCTCCTATCCACC
CCTGTGCTTCCCAGACTCCAGGCTTCCCTCTGCACCCACCTTGGTTGCTTCTCAGGGACTCCCTCCTCC
CTGTCCCACTGGTGTCCCGGCCTCAACCCCCTTTCTCCACACTCTGCTTTCCGGGGGACCCCTCTTGTCC
TTGATGTTCATGCTGGTTACCCCTCAGACCCCCCGCCTCCACACAGAACTCCCACCCACGTGTCCTTGG
TGCTCCCACAATCTTATCCACACCTGTGTCTTCCGTGCCCCCTAAGGCCACCAACTACTGAAACCCCCTC
CAACCTTGGTGTGCCCAGTGCCCTCCGTTACCTGTTTCCTCAGACCCCCCTTACCCCCAGACAGGAAGCC
TCCAGCTCCATGTCCTGGGCGCGCTGCCAGCCCCTGCGCCCTCGGCTGCCCCAGACACCACGACCCCG
CGCCCTCGGTGTCCCGCGCCCACCTTTGATGCTGATGCCCAGCCCACCGGCGTCGGCCTTGCGCACCGTC
ACGCGGCGCCGCTGGAGCAGTAGCGCCTCTGGCAGCTGCGGGGCCCGGCGCCCGGCTCCGCGGCGCCGT
TGAGCTGCGCGGGCTCCTGCTCCCGCGGAGCGCCGGGCTCGGGACCAGGGTCGCCGTCGGCGGGCTCAC
GGTCAGCACGTCCTCCGCCAGACTCAGCAGCACCCGCTGCCATCGCTCGCCGCCGGCCCCGAGCCCGCC
CCGGCGCGCAGCTCCAGCAGCCCGGTGCGCGGGCGCGCCTGCCGGACGCCATCTTCGCCTCCGAGCCCC
CGGGCCGCCGCGCTCGCCCTGTCCCGCTTTGCCCAGCCCGCTCCGACCAAGCGCCCAGGGCAGAGGGCAG
CGGGGGCCCGGCTGGGCCAGCCGCCACCCTACCCGGCCGCTGGGGAGGAGCTCTGGGGGCGGGGCTAC
CCTGGGGTGTGGCCAGTGCTGGGGAGGGGCCTCGGGCAAATGCAGGAGGCCGGGCGGGCGGGCCGGGAGC
CGAGGGCCGCCGTGTGGGACTACCTAGCGGGTGGGTCAGAAGGGCGGCGGGGCGGGCCACTAAGTAAGG
CGAAAGCCCGGGAGGCGTGGTGCTGGGCGGGGCGTCAGGGGGCGGGGCTTCGCGTCGGGGGCGGAACCCA
GTGAGCCCGCGCAGGGGCTCGGCGCTCGGAATGCCCATCGAGGGCCGGGACTGTAACTCCCGGACGTGG
GAGCGCATGAAAAAGAGACAGAACCACGTATCCTGGTGCGAAGCACTGGGCATCGGGCTGGGCTGCATAT
GGCGGAGGGCTGGGCTGCGTATGGTAGAGCGTTGGACTCCAAGGCTTGAGTTTAAGAGGTAGACACCGTC
TGGGCGTGGAGGCTCACGCCTGTAATCCCAACACTTTGGGAGGCCTAGATGACAGCCCAGAAGCTCGAGG
CTGCAGTAAGCCGCGATCGCGCCACTGCACTCCAGCCTGGGTGACAGAGCGAAACCCTGTGTCAAAAAA
AAAAAAAAAAAAAAAGGTAGATGCTGAGCCGCGAGAGACCTTGCGGGCACAGTTGCTAGTTGGGGAGCTG
AGGAAGAAGTTGGTTTCCTATCGGGGAGGGCGGGGATGGGGGTGGGGTCGAGGCTTTGGTCTGTGGG
CGTGGCTTATCGCTGGCGTGGCTTCTAAAGATGACAGGCCCCGCCCCTGGAGGAGACCGCTACCGACAC
CGCTTAGGGCTTGGGGGAGGTGTGGGCAGGATCCCCACTTCAAAACTGGAGGGAAGTTTAAGAGATTAAC
CCCTGGCTGTGTTCACAGTCGAGTATAGAAAAGCCTGAAGTCCCACACTTTGAGGCCTGGCAGAAAAAAA
ACAGAACTGGTGTGTGGGAAGAGGGTTGCAAGGTGGGCTCTGGGTCTGGCGACTGGAGACATGGTTTC
TAATCTTTGCTGCCTCTGTTAGCTCCAAGTCGACTTTGGTCCCCTCACGTCACTGCTCTAGGCCTCAATT
TCCTCATCTGTAAAATGTGGATCATAATAATACCTACTTCACTGGGCTGGTGTGAGGATTAAATCAATGT
GAAAACACGTGGTAAACTGTGACTCCCTATTCTATAGAAATAATCACTTTCATTTAGTGAATGCTTACTC
TTACCTAGGGCTGGCAGAATATTTTCCAAGTGTTATCTTTACATTAGCCTCCTGGAGTAGCTAAGAGCAC
CCCCAGCTGGGCACAGTGGCTCACACCTGTAATCACAGCTGAGGTGGCAGGATCGCTTGAGCCTTGGAGG
TCCAGGCTGCAGTGAGCTGTGATTGCACCATCACACTCCAGCCTTGGTGACAGAGCAAGAAAAAGAGCA
CCCCTATTATACAGAAGGGAAAACTTGGATTTAGTCTAATTGGCCTAGGTCACACATTTATGAGTGAGGA
AGAGCTGCGATTCAAACCCAGGCCTGTTTGACACCAGTGCCTGGGCACTGAACCACTCTGCTAGACAGCT
GACAAATACAGAGGTAAAGCATGATTGTAATCTGAAAAATCCACCACATCACACAGCTCAACTGGCCTTC
ATACCTGCTCCTTGTCTCTATCCTCCATTCCTAGCTGGGATATGTTGAGCAATAAATAAGTAGGACTACA
CCAGTGTTTAGCCTCCCTGAACTTTGGGTAAAATCCTCCACATAAGATACCATCAAGAAAAAAAGAGG
GGGCCAGGTATGGTGGCTCATGCCTGTAATCCCAGCACTTTAGGAGGCCGAGGCAGGTAGATCACGAGGT
CAGGAGTTTGAGACTCAGCCTGGCCAACATGGTGAAACCCCATCTCTACTAAAAATATAAAAAATTAGC
CGGGCGTGGTGGCAGACACCTATAATCCCAGCTACTCAGGAGGCTGAGGCAGGAGAATCACTTGAACCCG
GGAGGCGGAGATTGCAGCAAGCAGAGATTGCACCACTGCACTCCAGCCTGGGTGATAGGGTGAGACTCCG
TCTCAAAAAAAAAAAAAAAAAAAAACCAACAACAAAAAAAAGGAATTGTTTTAAGTTAGAGTGGTAGGTGT

FIGURE 20 cont'd

```
CAAAACAGGAGAGACACAGGTTTTAAAAAAAGAACCCAGGGTCTTTTATACATATATATATGGGATGCCG
AGGAGGAATGATCACTTGAGGCTAGGAGTTTGAGACCACTTGGGCAACTTCACGAGACTCCATCTCTACA
AAATAAAGAAATTAGCCAAGCGTGGTAATGTGCACCTGTACTCCCAGCTACTTAGGAAGCTGCAGCAGGA
GGCCTGTTTGAGGCTGCTGCTGTGAGCCACAATCATGCCACTGCACTCCAGCCTGGGTGACAGAGCAAGA
CCCTGTCTCAAAAATAAATAAAAGAAAGTGAGAGGAAGGAAGGAGAGAAGGGAGGCAGGGAAGGAATATA
GCATTGTATATAAGCATTGATATCTTAAAAGTATGACTGTGCTTAAAGATTGTAGGACAGCCTGAGGAAT
TTGGGGTAAGCACTTGTGATAAATAACTACAGCCTACTTGGCTTGTGGAAGCTTCACTCCAATGGTAGAG
AAGGGAGGGGAGGACAGACCTGGCAGGAGGCAAGAGACCAGCAGGGAATTGAAGCTCCTTTCCCAAGACC
AAAGCCTGGAACCAGATCCTTAAAAGTCCCCCCACGTACTGCCCTGCTTAAAAAAGACTTAATGAGGCCC
AGACAAACTTACTGAGAAAGAGCCCTAAGAGAGGGCTTCTCCTCTGGGGGACAGTTTCCTGTGGATATAA
CAGGAAGGAAGGAAGTAGGGAAAGGAGTGATGTGTGCAAAGGGGCTAACACAGAAAGAAGATGTAGAGCC
AAGGAAACAGTGACGTGTGTATGCATATGTATACGTCTGTATGTGAGTATGGGTGTGTGTGTTTGTGATC
ACACTTGATAGGCAGTGCCAATCACCTGTAGCTACCCCAAGAACCCTGTAGCTGCAGGAATGCTCTATC
CCTACACTGTGGTCAGCCGATGCCTCTCTGCTGTGGCTCAGAAATTGGCCTCCCAGATAGATACACATAG
GCCCGGCTCCCTGCCAAGCCCCAGGCAGAGCTCCCAGAGAAACCAGTTCACTCCCAAGGAATAGGAGAG
GGGGAAGGGGAAAAAAAGGGAGAGAGGGGAGCTGCCCAGCCTACTAAAGTCTCTGCAAGCTCTGGCCAGG
CGCGGTGGCTCACACCTGTAATCCCAGCACTTTAGGAGGCCTAGGCGGCTGGATCACCTGAGGTCAGGAG
TTCAACAGCAGCCTGGCCAACATGGTAAAACCCCATTCTCTACAAAAATACGAAAATTAGCTGGGCACGG
TGGCTCAAGCCTGTAATCCCAGCACTTTGGGAGGCCGAGGTGGGCAGATCACGAGGTCAAGCTATCGAGA
CCATCCTGACCAACATGGTGAAACCCGTCTCTACTAAAATACAAAAACTTGGCTGGGCACGGTGGCTCA
TGCCTGTAATCCCAGCACTTTGGGAGGCCGAGGCGGGCGGATCGCGAGGTCAGGAGATCAAGACCATTCT
GGCTAACACAGTGAAACCCCATCTCTACTAAAAATACAAAAAGAAATTAGCAGGGCGTGGTGGCGGGCGC
CTGTAGTCCCAGCTACTCAGGAGGCTGAGGCAGGAGAATGGCGTGAACCTGGGAGGCGGAGCTTGCAGTG
AACCAAGATGTGCTGCTGCACCTCAGCCTGGGTGTCAAAGCGAGACTCCGTCTCAAAAAAAAAAAAATCT
ATGCATAAATCCTAAACAATCTACTGTTTAGTTTTACATTTTTTAACATCACATAAATGGACATTTCTCC
TTCTGCTTTTGGAAGTTATATTCTCTAGTTGTATTAAGAGCACTCTATTATCTTCAATTACTTACTCTCC
CAAATTATTTGCTATGTTGTTAAGTATTTAGCGCTAAATATTTTCTTTTTATTTATTTATTATTATTAT
TTTTTTAAGACGGAGTTTCACTCCTATTGCCCAGGATGGGGTGCAGTGGCGCGATCTCCACTCACTGCAA
CCTCCGCCTCCCGGGTTCAAGCGATTCTCCTGCCTCAGCCTTCCAAGCAGCTGGGATTACAGGCGCCCGC
CATCACACCCAGCTAATTTCTGTATTTTTAGTAAAAACAGGGTTTCTGCAGTGAAACCCCATCTCTACTA
AAAATACAAAAAATTGGCCAGGCATGTTGGTACACGCCTGTAGTCCCACCTTCTTGGAAGGCTGAGGCAG
GAGAATCTCTTGAACCCAGGAGGCAGATGTTGCAGTGAGCTGAGATCACACCACTGCACTCCAGCCTGGG
TGACAGAGTGAGACTCTGTCTCAAAAAAAAAAAAAAAAGGGGGTTTCACCACGTTGGCCAGGATGGTCT
TGAACTCCTGACCTCAGATGATCCGCCCACCTCGGCCTCCCAAAGTGCTGGAATTACAGGTGTGAGCCAT
CGCACCCAGCCTCTTTTTATTTAGTTTTTTATTTTATTTATTTTATTTTATTTTGAGACTGAGTCTCAC
TCTGTCACCCAGGCTGGAGTGCAATGGCACTATCTTGACTCACTGCAACCTCTGCCTCCCAGGTTCAAGC
GATTCTTCCAACTCAGCCTCTAGAGTAGCTGGGATTACAGGCACATGCCACCACGCCCAGCTAATTTTTG
TATTTTTGTAGAAACGGAATTTCACCATGTTGGCCAGGCTGGTTTCAAACTCCTGACCTCAGGCAACCTG
CCCGCCTCAGCCTCCCAAAGTGCTGGGATTACAGGCATGAGCCACTGCACCCAGCCTGAAGGTGGCAGGC
AAAGCTTTCTATCAAAGAAGGCCAAATGCCTCTTGCCCAATCTTTAATTATCTCTTAAATTAGAATATCT
TACTCAAATCTCCATGTCTCTTAACTTTCTTTCATATCTTCTCTTTACTTTTTTCCATACTGCATTCTGA
GTAATTTCTTCAGTGATATCTTCCAGTTTACTAATTCTTTCTTTAACTAGAACTAATCTACTGTTTATCC
TATTCTTTGAATTTAAAATATCAATTGTTACTTTTTTATTTCTAGAAATTCTACTTTTTTTTTTTTTTT
TTTTTGAGACGGAGTCTCACTCTGTCACCCAGGCTGGAGTGCAGTGGCACAATCTCAGCTCACTGCAACC
TCCACCTCCTGGATTCAAGCAATTCTCCTGCCTCAGCCTCCTGAGTAGCTGGGGTTAAAGGCGCATGCCA
CCACATCCAGCTAGTTTTGGGGTTTTTTTGTTTGTTTGTTTGTTTGAGATGGAATCTCACACTGT
TGCCCAAGCTGGAGTGCAGTGTCACGATCTCAGCTCACTGCAACCTCTGCCTCCCAGCTTCAAGGGATTC
TCCTGCCTCAGCCTCTCAAATAGCTGGGATTACAGGCACCTGCCACCACGCCCAGCTAATTTTTGTATT
TTCAGTAGAGACAGGGTTTCACTATGTTGGCCAGGCTGGTCTCAAACTCCTGATCTCGTGATCCACCCAC
CTCGGCCTCCCAAAGTGCTGGATTACAGGTGTGAGCCACCACGCCCTGCCATAATTTTTGTATTTTTAG
TAGAGACAGGGTTTCACCATGTTGATCAGGCTAGTCTTGAACTCCTGACCTCATGATCCGCCTGCCTCAG
CCTCCCAAAGTGCTGGATTACAGGCATAAGCCACCATGCCCGGCCCTACTTTTTTTCCACATCTGTCT
GATTATGTTTATAGTATCTTTTTTTTTTGAGACAGAGTCTTGCTCTGTCCCCAGGCTGGAGTGCAA
TGGCGTGATCTTGGCTCACTGCAACCTCCACCTCCCGGGTTCAAGTGATTCTCTTGCCTCAGCCTCCCAA
GTTATCTGGATTACAAGTGCCCACAACCACCCCGGCTAATTTTTGTATTTTTAGTAGAGACGGGGGT
TTTGCCATCTTGGCCAGGCTGGTCTCGAACTCCTGACCGCAGGTGATCCACCCGCCTCAGCCTCCCAAAG
TGCTGGGATTACAGGCGTGAGCCACCATAACTGGCATAGTCTCTCTATTCTTTACCCATGCTTTTGATAC
CCTTTTGAAATGTATTTAAACCTATGAATTGTACTTATTTTATATTATCTATATAGTAGTTCTTTTTTGT
TTTTATTTTATTTATTTATTTTTGAGGCAGGGTCTCACTCTGACGCCCAGGCTGGAGTGCAATGGC
ATGATCTCAGCTCACTGCAACCTCCACCTCCCAGGTTCAAGCGATTCTTCTGCCCAGGCTCCCAAGTAG
CTGGGATTACAGACATGTGCCACCACTCGCAACTAATTTTTTGAATTTTTAGTGGAGACGGGGTTTCACC
```

FIGURE 20 cont'd

ATGTTGGCCAGGCTGGTCTCGAACTCCTGACCTCAAATGATCCACCCGCCTCGGCCTCCCAAAGTGTTGG
GATTAAAGGTGTGAGCCACCGCGCCCAGCCTCTTTTTGTTTTAAAGAGACGGGGCTTGCTTTGTGATGC
AGACTGGAGTACAGTGGCATGATCCTAGCTTCCTGCAGCCTCTAACTCCTGGGCTCAAGACAGGCGAGCC
CCAAATTGGGCCTTAGCCTGGGAAAGTTCTTGGCTTCTCCCAGGAAATAATTCAAAGGTGAGCCAGTGGT
ATCAGACAGCAACTTTTATTGAAGCAGCAGCGTACAGCAGCAGCAGAGGGACTGCCCTTGCAGAGGAGGG
TTAACACACAGGCAGTGTGCCCAGAAGAGTTTCATATGGGCTGGGGCAGCTGTATTTATACCCACTTTT
TTTTTTTTTGAGACGGAATCTGGCCCTGTTGCCCAGGTTGGAGTACAGTGGCATGATCTTGGCTCACTGC
AGCCTCTACCCCACTGATTCCAGAGATTCTCCTGCCTCAGCCTCCCAAGTAGCTGGGATTACAGGTGTGT
GCCACCACACCTGGTTCATTTTTTTGTATTTTTAGTAGAGATGGAGTTTCACTATGTTGGCCATGAACTC
CTGACTTCAGGCGATCTGCCCGCCTCAGCCTCCCAAAGTGCTAGGATTACAGACGTGAGCCACCCCGCCC
GGCCTAGACCCACTTTTAATTATACACAAATTAAGAGGCAAGTTATTCAGAACGTTCTGGAAAATGGACA
GTTTCTGGAACCATATAAGGTAACTTCTGGGCCATTGCCATGGCCATTGCCAGAGCCTTTCTAAACTATC
ATGGCACTAGTGGGAGTGTCTTATGCAAATGAGCAGTGAGGGCAACTAGCGGTCACTTTAGTCACCATC
TGCTGATTTTGGCTGGCGTCTTCACTGCACCCTGGATTGACCAGTTTCTGCTCTGATCAGCGGGATGGTG
ACCAGTCATAACCAGTGCTTGGAAAACAAATCTTGCTGATCTACCTCAAAATTCCTGGGTTCAAGCTATC
CTCCTGCCTCAGCCTCCCAAAGCACTGGGATTACAGGCATGAGCCTATATAGTAATTCTGATTCTGAAGT
GTTGGTGGCTCTTTTTACTTTTTCTTTTTAAAATTTGTTTAATTGGCCGGGCGCGGTGGCTCATGCCT
GTAATCCCAGCACTTTGGGAGGCCGAGGCAGGCGGATCACAAGGTCAGGAGATCGAAACCATCCTGGCTA
ACACAGTGAAACCCCATCTCTACTAAAAATACAAAAATTAGCCAGGCGTGGTGGCAGGCGCCTGTGGTC
CCCGCTACTCTGGAGGCTGAGGCAGGAGAATGGTGTGAACCCGGCAGGCAGAGGTTGCAGTGAGCCGAGA
TTGTACCACTGCACTCCAGCCTGGGCGAAAGAGCGAGACTCCATCTAAAAAAAAAAAAAAAAAATTTGTT
TTAATTTACTTTAAATAGAAACGGGGTCCCACTATGTTGCCCAGGCTGGTCTGGAACTCCTGGACTCAAG
CCATCCTCCCACCTTGGCCTCCCAAAGTCCCAAGATTACAGGCATGAGCCACTGAGCCCAGCCTTTTCT
TAAAGCAATAAAAGAATGGCTACTCCATAGACAGCAGCTGGTGGATCTTTTTCTTCATTACACATGTGT
AATCTTGTCAACTACACAGTTTATATGCATTCTTTGAGGTCTGGTATGAAGTAGGTTCTATTCCTTCAGA
GAGGATTTGTGGGTACTTCTGTCAGATGCCTGATGGGACAGCCAACCTAAGAGTGCTTTCAGGGCCGGGC
GTGGTCGCTCACGCCTATAATCCCAGCACTTTGGGAGGCCAAGGCAGGTGGATCATGAGGTCAGGAGTTT
GAGACCAGCCTGACCAACATGGTGAAACACAGTCTTTACTAAAAATACAAAACTTAGCCGGGCATGATGG
TGCGTGTCTGTCATCCCAGCTACTCAGGAGGCTGAGACAGGAGAATCACTTGAACCCGGAAAGCGGAGCT
TGCACTGACCTGAGATCGCGACACTGCACTCCAGCCTGGGTGACAGAGCAAGACTCTGTCTCAAAAAAAG
AGTGCTTTCAGTACTTAGCATGAGGCCAGTCACGGTGGCTCACACCTGTAATCTCAGCACTTTAGGAGGC
CAAGGCAGGCAGATCCACCTGAGGTCAGGAGTTTGAGACCAGCCTGGCCAACATGATGAAACCCCGTCTCT
ACCAAAAATAAAAAATTAGCCGGGCGTGGTGGTGAATGCCTGTAATCCCAGCTACTTGGGAGGTTGAGGC
AGAAGAATCGCTCGGACCTGGGAGGCGGAGGTTGCAATGAGCAGAGATCATGCCACTATACTCCAGCCAG
GTCATCAAGAGCGAAATGCCGTCTCAAAAAATAAAATAAAATATTTTAGCACGGGATCTTTTGAT
TCACACAAAGAGTAGAAATACAGGTTGCAATCCCATGTGAGGTTACGAATTCTCAGAGATGCTTTCCCCC
TCTGCCCACCATGTTCACGATGGAGAAATTTCTTTGCTGGTGCCCTCTGCAAGATTTTTGCAGTCCGCTC
TTTCTTTCTTTTTTTTTTTTTTTGAGATGAAATCTTGCTCTGTTGCCCAGGCTGGAGTGCAATGGCG
TGATCTCGGCTCACTGCAACCTCCGCCTCCTGGGTTCAAGTGATTCTCCTGCCTCAGCTTCCTGAGTAGC
TGGGATTATAGGCACCCACCACCACGCCTGAGTAATTTTTTACTTTTGGTAGAGGTGGGGTGTCACCATG
CTGGCCAGGCTGGTCTCAAACTCCCGACCTCAGGCGATCTGCCTGCCTTGGCCTTCCAAAGTGCTAGGAT
TACAGGTGTAAGCCACCACACCCGGCCCAGTCCACTCTTTCAATGAGGATGCAGGCTTTCCAGACCCTGG
CTTTATGTGGGGGTCACCTAACAGCTTTTTCACCCTGGGTGGGCCCTGGGTTTCTCTCTTGCCCCATAAT
TCCAAATGTGCATCAAAACTGAAGCTTTGTGGCCGGGCGGAGTGGCTCACACCTATAATCCCAGCACTTT
GGGAGGCTGAGGTGGGTGGATCACGAGCTCAGGTGATCAAGACCATCCTGAACTGGGTTTCAACATGGTG
AAACCCAGTCTCTACTAAAAATACAAAAATTAGCTCGGTATAGTGGTGCCTGCCTGTAATCCCAGCTACT
CGGGAGGCTGAGGCATGAGAATCGCTTGAACCCAACAGGCAGAGGTTGCAGTGAGTCGAGATAACGCTGC
TGCACTCCAGCCTGGGTGACAGAACGAGACTCTGTCTCAAAAAAAAAAAAAAAAAAGGCCGGGCTCAG
TGGCTCACACCTGTAATCCCAGCATTTCAGGAGGCCGAGGCGGGCGGATC

FIGURE 21
SEQ ID NO: 13
Genbank ID      : AL360204.1
Unigene ID(#167) : Hs.283853
Unigene name    :        MRNA full length insert cDNA clone EUROIMAGE 980547

>gi|8919406|emb|AL360204.1|IRO980547 Homo sapiens mRNA full length insert
cDNA
clone EUROIMAGE 980547
GGAGCCACAGTGAAAGTCAAGAATGTCAGTGATTCCACATTTAATATCTACATTTTTGCAGGGCAGTTAC FIGURE 21 cont'd

```
TCTTTTGTAGTATAACATTGAGCTGATAGCACATAGTGTAGACAAGTGAATACAGGATTCTCTGGGTTGT
ATTCCCAGAAGTCTGGAGGTCATTTGGATATTTGTGGGCCCTTGGCTTCACTCTGACTTGTGTGACACAT
AAAAATTGTGATGAAATGTCCTATAGATGTCCTGCAGGTCTTAAAAGAACCTTTCCAAACTATGAAACAG
CCCAGCAGCACTGAGTTAGAGGTAAATTCTGAACCCTTGAACACTAAAACTATTCTAACTGCACATAGAA
TTGGCAAGTAGCATTCTATGTCTATGAACAGTATGTCTTTTCTATATAACAGAGAAAATCTTTTTAAGCA
AACTACTCAGTTTAAAACCTAATTCTTCTCATAATCTCAGTACTTTTGAATGAAGACATATCAATGCAAC
AGTACACTCTTATTCAGGCATTTGAAAGAAAGAATTCGAGATCTAGTTTGTATCAGATATTATAAATTAG
TATGGTTTAGTCTTTGTCATGAAATTCTACTTAATTTTGGACTATAGGTTTAAGAATGTAAGCAGAAGT
TCTGCACCAATCAGAATAAGCTACATTATGCTTGAGTGACAACTACTGTAATGACAAAATATCAGTGGCT
TAATACAATGGTTTTCTCTCATACTTGTTCATAAAGAGTCAGCAAGGACCCTGCTCATTATGGTCCCTC
AGGGACCCAGGTTGTTGGAAGCTCCACCATTTTAGATAGCTCCCTTCAAAGTCAGCCATCTTTGCAGTCA
TGTCCCCCAACAGCTGCAAAATTTGCTCTGATGCTCAAGAATTGAGCATCGGCAGTTAAATGCTTCAACA
TGAAAGTGACACCTGCCACTCCCACTCACATCCCATTGGCCAGAACTAGTCACATGGCCAGACCTAACTT
CAGAAGGTTGGAGAATTGTAATCCTCCATGTACCCAAAAAGTAGAGAAGCCAGATACTGAGAAACATCAA
TAATGGCTAACAGAAATCCATTCTACCATTCCCTTTGCCTAAAGTGAAAAGATGAGTACTTTCATCAATT
TGTAAACTGTACTTTTGAAGTAAATCCTGGTAGCTTGCATGGGGCTGGATTTCCAGAAAGCCATATGTA
ATTTGGGAATGACATTCACTTAAGCTCATAGAATATCATTATTTGATGTAAAATGCCCTCATTTGCAATA
CAGGACCAAAATGCACTAACCACAAAATTCCACTCCACAAGGGTCTGGGTTCTAATTTCTTCATTCTTTA
AATGAGGCATTCTATGATTTGGAATGGAAGCCCAGTTGTAGTCGTAAGAATTTTACTTAATTCAAGAATT
ATTCTCACTGAATATGTGCCAGTTCTGAAAGGAATGCAAAGTCAAATTTTGCATCTTCTTTGCTCAAGGG
CCTTTAGATGTAACAACACAGACATGATACAAGGCTGACAATGACATTATGATTTAAATATGTTAAACAA
CTTATTAAATTGTGAATCAACAAAAATTTATGTTCTTTATTTTATGGTTTTGCATAGTCCTGACTCACTG
CCTACATACCCCTCTTGTTCCTCAGTTCTTATCCCTGATTTCTTACAGGATGGCCTAAGACAGCTGTAGA
TGTTTTTATTTAGCAAAAAAAAAAAAAAAAA
```

FIGURE 22
SEQ ID NO: 14
Genbank ID        : BC001651.1
Unigene ID(#167)  : Hs.48855
Unigene name      :        cell division cycle associated 8       CDCA8
>gi|12804484|gb|BC001651.1|BC001651 Homo sapiens, hypothetical protein FLJ10468
, clone MGC:2726 IMAGE:2822261, mRNA, complete cds

```
GGCACGAGGGTGGAGTTTGAATTGGGTGGCGGTTGACTGTAGAGCCGCTCTCTCTCACTGGCACAGCGAG
GTTTTGCTCAGCCCTTGTCTCGGGACCGCAGGTACGTGCCTGGCGACTTCTTCGGGTGGTCCCCGTCCGC
CCTCCTCGTCCCTACCCAGTTTCTTGCTTCCCTGCCCCATCTCCGCCGCTCCCCGCAGCCTCCGCCGAGC
GCCATGGCTCCTAGGAAGGGCAGTAGTCGGGTGGCCAAGACCAACTCCTTACGGAGGCGGAAGCTCGCCT
CCTTTCTGAAAGACTTCGACCGTGAAGTGGAAATACGAATCAAGCAAATTGAGTCAGACAGGCAGAACCT
CCTCAAGGAGGTGGATAACCTCTACAACATCGAGATCCTGCGGCTCCCCAAGGCTCTGCGCGAGATGAAC
TGGCTTGACTACTTCGCCCTTGGAGGAAACAAACAGGCCCTGGAAGAGGCGGCAACAGCTGACCTGGATA
TCACCGAAATAAACAAACTAACAGCAGAAGCTATTCAGACACCCTGAAATCTGCCAAAACACGAAAGGT
AATACAGGTAGATGAAATGATAGTGGAAGAGGAAGAAGAAGAAGAAAATGAACGTAAGAATCTTCAAACT
GCAAGAGTCAAAAGGTGTCCTCCATCCAAGAAGGAACTCAGTCCATACAAGGAAAAGGAAAAGGGAAAA
GGTCAAGCCGTGCTAACACTGTTACCCCAGCCGTGGGCGATTGGAGGTGTCCATGGTCAAACCAACTCC
AGGCCTGACACCCAGGTTTGACTCAAGGGTCTTCAAGACCCCTGGCCTGCGTACTCCAGCAGCAGGAGAG
CGGATTTACAACATCTCAGGGAATGGCAGCCCTCTTGCTGACAGCAAAGAGATCTTCCTCACTGTGCCAG
TGGGCGGCGGAGAGAGCCTGCGATTATTGGCCAGTGACTTGCAGAGGCACAGTATTGCCCAGCTGGATCC
AGAGGCCTTGGGAAACATTAAGAAGCTCTCCAACCGTCTCGCCCAAATCTGCAGCAGCATACGGACCCAC
AAATGAGACACCAAAGTTGACAGGATGGACTTTTAATGGGCACTTCTGGGACCCTGAAGAGACTTCTTCC
CTTCAGGCTTATTGTTTGAGTGTGAAGTTCCAGAGCAAGGAGCCATGTTCCTCTAAGGGAATTCAGGAAT
TCAGACGTGCTAGTCCCACACCAGTTAGGTAGAGCTGTCTGTTCACCCTCCCATCCCAGCTGATCCCAGT
CACTGCTTGCTGGGGCATGCCATGGAAGCTTCCCATCAGTCTCCCAGCTGAATCCTCCCTGCTCTCTGA
GCTGCTGCCTTTTGCCTCCTGCAACTCAACATCCTCTTCACCCTGCCCTGCCTGCAGTTGAGGGGGCGAA
GAAGAACCCTGTGTTCTCAGGAAGACTGCCTCCACCACCGCTACCCAGAGAACCTCTGCATCTGGCATTT
CTGCTCTCTATGCTTGAGACCGGGAGGTTTAGGCTCAGATAAGTGAGCTCTGGGCCATGAGAGGGTAGGT
CCAGAAGGTGGGGGGAACTGTACAGATCAGCAGAGCAGGACAGTTGGCAGCAGTGACCTCAGTAGGGAAC
ATGTCCGTCTACCCTCTCGCACTCATGACACCTCCCCTACCAGCCCTCCTCTTCCTCCTCCTCCTC
CTGTGGGAGGTGGTCAGTGGGACTTAGGGATCTTTCACCTGCTGTGCCCAGTAGTTCTGAAGTCTGCTTG
TGGAGCAGTGTTTTATGTTTATCCCTGTTTACTGAAGACCAAATACTGGTTTGGAGACAACTTCCATGTC
TTGCTCTTCTACCTCCCTAGTTAGTGGAAATTTGGATAAGGGAACTGTAGGGCCCAGATTCTGGAGGTTT
```

FIGURE 22 cont'd

TATGTCATTGGCCACAGAATAACTGTCTCTAAGCTATCCATGGTCCAGTGGTCCCTGCCAAGTCTGTAGA
CTTCAGAGAGCACTTCTCTCTTATGGGGTTCATGGGAACAGGGGCGGGTGTGACTTGCTTGGTGGCCTCA
TTCCATGTGTGCCTGTGCCTGGGGCATGGACTTTGTTAAGCAGAGTCAGCAGTGAGGTCCTCATTCTCCA
GCCAGCCTCTCTGCCCTGGAGAATCATGTGCTATGTTCTAAGAATTTGAGAACTAGAGTCCTCATCCCCA
GGCTTGAAGGCACATGGCTTTCTCATGTAGGGCTCTCTGTGGTATTTGTTATTATTTTGCAACAAGACCA
TTTTAGTAAAACAAAAAAAAAAAAAAAAAAAAAAA

FIGURE 23
SEQ ID NO: 15
Genbank ID        : NM_004392.1
Unigene ID(#167)  : Hs.63931
Unigene name      :      dachshund homolog (Drosophila)      DACH
>gi|4758113|ref|NM_004392.1| Homo sapiens dachshund homolog (Drosophila) (DACH)
, mRNA
GCGGCCGCGAGCAACGGCAGCGGCGGCGGCGGCGGCGGCATCAGCGCTGGCGGCGGCGTCGCTTCCAGCA
CCCCCATCAACGCCAGCACCGGCAGCAGCAGCAGCAGCAGTAGCAGCAGCAGCAGCAGCAGTAGTAG
CAGCAGCAGCAGTAGCAGCAGCAGCTGCGGCCCCCTCCCCGGGAAACCCGTGTACTCAACCCCGTCCCCA
GTGGAAAACACCCCTCAGAATAATGAGTGCAAAATGGTGGATCTGAGGGGGGCCAAAGTGGCTTCCTTCA
CGGTGGAGGGCTGCGAGCTGATCTGCCTGCCCCAGGCTTTCGACCTGTTCCTGAAGCACTTGGTGGGGGG
CTTGCATACGGTCTACACCAAGCTGAAGCGGCTGGAGATCACGCCGGTGGTGTGCAATGTGGAACAAGTT
CGCATCCTGAGGGGACTGGGCGCCATCCAGCCAGGAGTGAACCGCTGCAAACTCATCTCCAGGAAGGACT
TCGAGACCCTCTACAATGACTGCACCAACGCAAGTTCTAGACCTGGAAGGCCTCCTAAGAGGACTCAAAG
TGTCACCTCCCCAGAGAACTCTCACATCATGCCGCATTCTGTCCCTGGTCTCATGTCTCCTGGGATAATT
CCACCAACAGGTCTGACAGCAGCCGCTGCAGCAGCTGCTGCTGCTACCAATGCAGCTATTGCTGAAGCAA
TGAAGGTGAAAAAAATCAAATTAGAAGCCATGACAACTATCATGCCAGTAATAACCAACATGGAGCAGA
CTCTGAAAACGGGGACATGAATTCAAGTGTCGGACTGGAACTTCCTTTTATGATGATGCCCCACCCTCTA
ATTCCTGTCAGCCTACCTCCAGCATCTGTCACCATGGCAATGAGCCAGATGAACCACCTCAGCACCATTG
CAAATATGGCAGCAGCAGCACAAGTTCAGAGTCCCCCATCCAGAGTTGAGACATCAGTTATTAAGGAGCG
TGTTCCTGATAGCCCCTCACCTGCCCCCTCTCTGGAGGAGGGGAGAAGGCCTGGCAGTCACCCATCATCA
CATCGCAGCAGCAGCGTGTCCAGCTCCCCTGCTCGGACTGAGAGCTCTTCCGACAGAATCCCGGTCCATC
AGAATGGGTTGTCCATGAACCAGATGCTGATGGGCTTATCACCAAATGTACTTCCTGGGCCCAAAGAGGG
AGATTTGGCCGGTCATGACATGGGACATGAGTCAAAAGGATGCATATTGAAAAAGATGAGACCCCGCTT
TCTACACCAACCGCAAGAGACAGCCTTGACAAACTCTCTCTAACTGGGCATGGACAACCACTGCCTCCAG
GTTTTCCATCTCCTTTTCTGTTTCCTGATGGACTGTCTTCCATCGAGACTCTTCTGACTAACATACAGGG
GCTGTTGAAAGTTGCCATAGATAATGCCAGAGCTCAAGAGAAACAGGTCCAACTGGAAAAAACTGAGCTG
AAGATGGATTTTTTAAGGGAAAGAGAACTAAGGGAAACACTTGAGAAGCAGTTGGCTATGGAACAAAAGA
ATAGAGCCATAGTTCAAAAGAGGCTAAAGAAGGAGAAGAAGGCAAAGAGAAAATTGCAGGAAGCACTTGA
GTTTGAGACGAAACGGCGTGAACAAGCAGAACAGACGCTAAAACAGGCAGCTTCAACAGATAGTCTCAGG
GTCTTAAATGACTCTCTGACCCCAGAGATAGAGGCTGACCGCAGTGGCGGCAGAACAGATGCTGAAGGA
CAATACAAGATGGAAGACTGTATTTGAAAACTACTGTCATGTACTGAATCTTTCCTGTTGAAGAAATCCA
TGTTATAGAAAAGAACTTTGCAGTCAGACATTCGTCATGGGAAAGTTCAGAAAAAAATAAAGTCCTTTTA
AGGGAACTTCCTGAATTTTGTGTATTAATGTTCTTTAAAAGTTTAAGTATTCTACAAAAAAAAAAAAAAG
TTTTCTCCATTGATTTTCACCTGTGGTTCATACCAGAGACCTGAGAATGTTTGTAAATGTACAAGTATCA
AAGTTCTTACAGTTAATTACTGCAACTTGCTGCTGGACAATTGTATACAGAGTTAAAGGCAGGTCTGAAT
AAGACCTAGCTTTGTTTTTTTCTAATGGAATGAACCATTTTCCTCTTCTGAAAATTCTGTATCTGAGCAC
ATCAAGAGACTCTTGTAGCAGTGGTTACCCAGACTTACAGAATTATGTCCTCCAGAAACCAGCAAGAACA
CTTGGAATGAACGAATGAACTTGTAGGGGCATAGAGGATTCTTGAAAAAAAAAAATGCAAGAGTGATTT
TCTGTTACATTCAATTTCAAACTCTCTAATTGTGGGTTTTCTCCTGAAGAATTTTTTTTCACATACTTTC
CAAAAGACCAACAAATGGATGTTGACAACAACCCAATGAAATAACATTTTGCATATCTGAAAAGAAGCAT
TGAATATAAGCCAAAAGCTTTCACTGAAGGTTTTTTTTTCTTAAAAAAAAAAAAAAAAAAA

FIGURE 24
SEQ ID NO: 16
Genbank ID        : NM_003462.2
Unigene ID(#167)  : Hs.406050
Unigene name      :      dynein, axonemal, light intermediate polypeptide 1
      DNALI1

FIGURE 24 cont'd

>gi|13518030|ref|NM_003462.2| Homo sapiens dynein, axonemal, light intermediate
 polypeptide 1 (DNALI1), mRNA
CAAACAAGGCCCACACTGGACAGGGCAGCTGCTGGGTTGCTACTCTCGCCTCCGCCATGATTCCGCCCGC
AGACTCTTTTGCTCAAGTACGACACCCCAGTGCTGGTGAGCCGGAACACGGAGAAACGGAGCCCCAAGGT
CGGCTACTGAAAGTCAGCCCCCAGCAGCCTGGACCTTCAGGTTCAGCCCCACAGCCACCCAAGACCAAGC
TCCCCTCAACTCCCTGTGTCCCAGATCCTACAAAGCAGGCAGAAGAAATCTTGAATGCCATACTACCCCC
AAGGGAGTGGGTGGAAGACACGCAGCTATGGATCCAGCAGGTGTCCAGCACCCCTACGCACCAGGATGGA
CGTGGTGCACCTCCAGGAGCAGTTAGACTTAAAGCTGCAGCAGCGGCAGGCCAGGGAAACAGGCATCTGC
CCTGTCCGCAGGAACTCTACTCACAGTGTTTTGATGAGTTGATCCGGGAGTCACCATCAACTGTGCGGAG
AGGGGGCTGCTGCTGCTGCAGTCGGGACGAGATCCGCATGACCATCGCTGCCTACCAGACCCTGTACGAG
AGCAGCGTGGCGTTTGGCATGAGGAAGGCACTGCAGGCTGAGCAGGGGAAGTCAGACATGGAGAGGAAAA
TCGCAGAATTGGAGACGGAAAAGAGAGACCTGGAGAGGCAAGTGAACGAGCAGCAGAAGGCAAAATGTGAAGC
CACTGAGAAGCGGGAGAGCGAGAGGCGGCAGGTGGAGGAGAAGAAGCACAATGAGGAGATTCAGTTCCTG
AAGCGAACAAATCAGCAGCTGAAGGCCCAACTGGAAGGCATTATTGCACCAAAGAAGTGATAATTTCCAC
ATGATTAATTTCCAACAAGACACTTGGGAGTTATTTACTGTGTTCCTCTGGCAGCCAATAAAATCATCAT
AAGCCCTTTGTAATAAAAA

FIGURE 25
SEQ ID NO: 17
Genbank ID        : NM_030896.1
Unigene ID(#167)  : acc_NM_030896.1
Unigene name      :
>gi|13591867|ref|NM_030896.1| Homo sapiens hypothetical protein FLJ13520
(FLJ13
520), mRNA
GTCAACAACCCCCGAGGAAATTTCCACCCCAATAGAAACAACATATAGAACGGAACATTCAGGTCCACCA
GAGTGGGCAACTTAAATCCTGGAGCTAAAATATGGGTACAGTGTCCATCAGATCCTGCCCCTAAGACTGC
TGACCTTGTAGCTATTGGAGCAGAATATGAAGGCACAGTACAATTTCCTAAAGATGAAAAACAGTATCAT
GTTCCCCTCCATTTTTGTTACTACAGAGAATAACCTGTCTGCTAGTAATCAGCACCTGGATCACCATGTC
TGAGGCTGAGAATGAGTTCATCAACTGGGTAGCCACTGCTGCAATAGAAGCCAACTGCAGTCAGTGCTGG
CTCTGTGTTGAGTTGCCAGAGGCCGCTGGGAATGGGCTACCTTGGAGAATTGTCCCTGCTAACATTTCTG
AATGGATATGCCAATACCAATGGGAGTGGGATAACACTTGGTTTTGTTTTGATTTTTTGAGCCAGAGTGT
CTCTCTGTCGCCCAGGCTGGAGTGCAGTGGCACGATCTTGGCTCAGTGCAACCTCTGCCTCCTGGGTTCA
AGCGATTCTCCTGCCTCAGCCTCCCAAGTAGCTGGGATTATAGGTGCATGTCGCCACGCCTGGCTAATTT
TTTGTATTTTTAGTAGAGACGGGGTTTCACCGTATTGCCCAGGCTGATGTCAAACTCCTGAGTTCAGGTG
ATCTGCCCTCCTCGGCCTCCCAAAGTGCTGGGATTGCAGGTGTGAGCCACCGCGCCTGGCCCGGATAAC
ACTTGAAATCCAACCTGGACTTCTTTTAACCAAACAGTCTATTTTTGCCCTTGCCCAAACAAAACACAGC
ACCCTTGTTACTTCAATTACACATTACAGCGATACAATTATAGGAGAACTCTTCCTGTTCCCTGGGGGGC
CCTCTAGGTATGCGAATCCTACAGGTGGCAATACCTGCTTGGACGGGGAGACACACTTGGGGGTGGCCAT
TAATTCCATTCACCATCTGGGATAATATTTCTCTCCCCAGTAATCTAGATGCTTACAAACATTGCTGGTT
ATGAATGCGCCGGACTCCCTGGTGACGGTACCCTATCACAGTATTCTCCCCTGCCACCGGTACAATCCTG
CTTCAGCAACAAATTCAAACATTCAGCTTACATGTAGAAAAAGCTCTTAATGATAGTAGCATGGAACTTA
TGTTGTAATCAGATAAATTTGCTCAGCTGTGTACTGTCATGTTGCAAAGTCAAATGGCATTAGGTTTGCT
TACTGCAGCCCAAGGAAAGGTTTGCCCCTTACTGCATCCTGAATGTTATGTGTATATCCCTGACAATTCT
CACAATATGAATCTCCTTGCGAAGCCATGAGGGGTGTGGTTTTTATTAATTATGCTTTTAGTTCTCCTGT
GCTTACCCTGTATCTGTAATCTATATCAATTGTGGCTTCCCTGTGTATCCGTAAGAGTATTTTCCTACAG
TTGAGTATCAGATTGAGGCCAAATGTGGAGGAAAAGTTAAATATTAAATTTGAACTCAATTGAACATGGA
CACAAACAATGGTCACCAAGTCCCGGAACAGGTTGTGTGAGCCCCTTGAGGCATTCATCCAGCGCTGTTT
CAGATAAATCTCTATTTCAATCTATTCCTATATGTTAGTTATTGAAAAACAACAGACAATCGCAAAAACA
AGTTGACCTTTTTGTGTTCCTTGAGCCTGGTCATGAAGGGCCCTCGTGCCTGGAGCTCATGCCAAACAAC
TCATTACAAAAGAGCTAGGGTCCTAGATTGTGCCGAAGCTTCATGAGACCTCTCCTCGTCTGTGCACGGA
CGAGTGGCCGACTCTGGAGCCCAGGCCGTTGTTTCCTAGTCTGGTGGTGAATCCGCCATAGTCTGGTGAG
TGCAGTGTCCGACTCTCGAGCCCAGGCTGTTGCTGTTGCTTCCAGTCTGGTGGTGAATCCTCCATAGTC
TGGTGAGTATAAATACATATATCTCTTTTCCTTTCTCCCCTTCCCATTGCAACTTGCTTACTATATCATT
TGCTTATTATATCTGCATTGCCATTTATGTGGGATAAAGCTTGTTTACCCTT

FIGURE 26
SEQ ID NO: 18
Genbank ID         : AW242997
Unigene ID(#167)   : acc_AW242997
Unigene name       :
>gi|6576776|gb|AW242997.1|AW242997 xn28a11.x1 NCI_CGAP_Kid11 Homo sapiens cDNA
clone IMAGE:2695004 3' similar to TR:Q64698 Q64698 CALPAIN, LARGE ;, mRNA seque
nce
CTGGCTCACAACTTTAATTGATTGCTTTCCCTCCACTGGGCCCACCGGGTCGGCTTACATAGCTCATAGC
TCAGTGCTGCTGAAATAGACCCAGGGCAAGAAAGGTATGAACAACCAGTGAATGCCACTGGAGCATAAAT
GTTCACAAAATTGTAGAGAAGGGGTGACAAGAAGCAAGCAGTGGGGCAGGGAGTGTCACTGATGTCCGAA
ACCCCGGGTCAGACCAACACGCAGCACAGCCACTCGGCCAGAGAGAGCTGAACCATGCCATCCTTGTCTT
CGTCCAGAAGGCTGAATAGTTTGAAGAGGGTCTCCAGGCGGATCATACAAGCCACGAAGCTGTCAAAGTT
GATGCCAAGCTTGCTGCACGCATTCCCGAAGGGCAATGGTCTGCTGCACCTGGCTGTTGAGGGTGAAACC
TGCCTTCCTGAGGGCTGTCCTCATCTCGTGGGCATCGATGGTGCCCGAGTGGTTATAATCAGTTTCCCAA
TAGATCTCCTAAAGCAGGAAAGAAATCCCAAGTAGAAAACAACCATTCACGGCCCCTGCCAGAACCATCT
CCCTCCACCACACTG

FIGURE 27
SEQ ID NO: 19
Genbank ID         : AU156421
Unigene ID(#167)   : Hs.518736
Unigene name       :         CDNA FLJ13457 fis, clone PLACE1003343.
>gi|11017942|gb|AU156421.1|AU156421 PLACE1 Homo sapiens cDNA clone PLA
CE1003343 3', mRNA sequence
GTTTTGTCCTCCAAATTTTCCTGTAGCAAAATGAAATTGTTGTCTCCTATCAGATTATAGCAATCCTGGC
ATTATTATAAAAGATTTCCCTTATCTAATTGGAACTAAGAAGTGATATGTTTTAATCTGAGATATTTCTA
GACTGACATAAAAAGTAAAGTTTTGAATTTGGCTATATCACTTAACCCATAAACAAGCTTAGTACACCTT
ACTTCAGATTCCTTATGAATAAATTCTGACTTTGATAGAAAAATTAACACAAGTTTATTGTATGTTTTGT
GTGTCAGAAATTGTGCTACATGATAGAAAACACACAGAAACATAAGATTCTCATAAGGNTAAGGACTATG
AAATATAAGGAAATCAATAAAATTAGCCAAAATGCCTCATGAAAATGCAAATCATGTTTTAAATGCTAAA
GAGACTCATATTAACTGTATAGAACTTTATATTCCCACNCNTTATGAAANTGAACCACCAGTGAA

FIGURE 28
SEQ ID NO: 20
Genbank ID         : AI435828
Unigene ID(#167)   : Hs.155223
Unigene name       :          stanniocalcin 2    STC2
>gi|4305913|gb|AI435828.1|AI435828 th79e05.x1 Soares_NhHMPu_S1 Homo sapiens cDN
A clone IMAGE:2124896 3', mRNA sequence
TGCCATTTATTTAAAACTTTTATTAACGCTTGAAGAAAAATAATGCAATGTGACAATGTACAGGTCCTGT
TGCCTAAATCCGTAGTAGAAACAGATATTATCACTTAGCAAGCTCACGTGGTGCCAATTCTGAGATCAGA
CGGGGTTGTTCCTCCTTAGGAAGTGGCCACTGGAAGCATTGTTTTTCCATGCTATTTCCGTGAAGCCTTT
TGCTTGGTTCGAGTTTAAATTTCTCCCTTTGTGTGAGTATGACTATAGTTCTGGCCTGGTGTTTTCTATT
TATTTAGTTTTAGATGTCAGCATTTTACTATACTTGGTCCTCTCACTTCAGAATAACAGGGCTATTTATT
GATACAAAGGAGAGGTGTTCAGATCATCTTGTTAAGATGCAGAGCTCAAAATAAACACTAAATCTTTATT
TGGAGATCCACATCCTTCCTCAAAGGAAGGCTCATGAGTAAATTTGTATGCAGTATAAAGCCCAAGTAGA
GGGTGTATTTTTAATGACTACTTTGCTTACAT

FIGURE 29
SEQ ID NO: 21
Genbank ID           : AA742697
Unigene ID(#167)     : Hs.62492
Unigene name         :     secretoglobin, family 3A, member 1    SCGB3A1
>gi|2782203|gb|AA742697.1|AA742697   nx30g04.s1   NCI_CGAP_GC4   Homo   sapiens   cDNA cl
one IMAGE:1257654 3', mRNA sequence
GCTCTTAACCACGTTTATTGAGAGGGGCCGGGGGAAGGGGATGGACGGTCCTCCCCGCGGCGGGTATTTC
AGCCCTCGCGGGTGGGCAGCGTCTTGTCCTCAGGTGTAGATGCTCCAGTCTCGGCTCAGCCAAACACTGT
CAGGGCCCCCAGCAGGGCCTTCAGGGCATTCACGGCCCCACGGCCTGGGGACCCAGCTCAGCCACACACT
TCTGGGAGCCCTCTATGAGGTGGTTCACGGGGATGCCCAGGCTGCTCAGCAGGAGCTTCAGCGGGTTGAG
GGTGCCGAGGGGGTTGGCCAGGGTCCCGGCCCCGGGCTCCGGCGCCGACTCCAGCGCAGANCAGGCTTGG
GCACAGGCTTTGGCGGAGCCACTAAGAAAAGCAGCAGCGGACTGNGAACAAGGGCCACGCAGAGCCCCAG
GAAGGGGCCGAGCTTTCATGGCGCCGGGGCTCGGGGCGCGCCGGGAACCTGCGGCTGCCCGGGCAAAGGC
AAGAGGCTTCTTTATACCGGTTCTTGGCCCTCGTGC

FIGURE 30
SEQ ID NO: 22
Genbank ID           : BG271923
Unigene ID(#167)     : Hs.237809
Unigene name         :     guanylate binding protein 5    GBP5
>gi|12980554|gb|BG271923.1|BG271923   nai60d01.x1   NCI_CGAP_HN20   Homo   sapiens   cDNA
  clone IMAGE:4264369 3', mRNA sequence
GGTCGACATCATCATCATCATGGATTTGCTGGTGCAGTACAACTTTTTTTTTTTTTTTTGGGGTTT
TCCAAAAATGTTTTTATGGTTAAAATCTGTACAAACAGATATATTTATATAAGTTACATATTTTAAGAAA
AATCAGTCATTTTTCATATATAATTGCAAAGAATTAAGATCATTTAACTTTAGCACTATAAGCAAGCATT
AAATTAAATGCACTCAGATTTTTGGCACATTATATGGCATTCCTTATACCACATATTTATAAGATCTAAA
GGATTATAAACAT

FIGURE 31
SEQ ID NO: 23
Genbank ID           : AI961235
Unigene ID(#167)     : Hs.96885
Unigene name         :     hypothetical protein FLJ12505   FLJ12505
>gi|5753948|gb|AI961235.1|AI961235   wt15d02.x1   NCI_CGAP_Ut1   Homo   sapiens   cDNA cl
one IMAGE:2507523 3', mRNA sequence
TTTAAGTTTCCAGGATGGTTTTATTAAAGTCCCATGCTGTGTTAGAAACATACAAGTGATGAGAAAAACA
TTAACTTGAAACATGCACTTACTGGCATTCTCTAAAATACCATTATACAAGTTTTCATTTAATTAGAAAA
ATACCCACTAAAACAATCACAGTTCTTCTTAAAGATTTAAAAAAAATGTATTGGCCAGAACAAAGTCCAA
GAGAATAAACAAAGTTCTGAATTGTATGTCAAAAAAACTGTACAAGGTTGTACATAAAACTATAGCTTAC
AAAAGACTCAGGTATAGTAAGAATTCTGAATTAAGATTTCCAAAGTTCTATTTACCAATATCTATTAATA
AAATCCTTATGAAATAATTGACTTAGAAAAAGTGAAATGCTCATGATTTCAGAGTGTATAGAAAATACTA
AATATCACTTTCCGAAATAAAGTGTACTCAAAACAGCACAACATACAGTCTAAAATCAAGATTTCTGTCA
TTCATTTAAACTTTGCATATATTGCCATGATGGCTTAAACATA

FIGURE 32
SEQ ID NO: 24
Genbank ID           : AI810764
Unigene ID(#167)     : Hs.102406
Unigene name         :     Transcribed sequences
>gi|5397330|gb|AI810764.1|AI810764   tu04c11.x1   NCI_CGAP_Pr28   Homo   sapiens   cDNA c
lone IMAGE:2250068 3', mRNA sequence FIGURE 32 cont'd AAAGGCACAGCTTTCCCAGTGTTTGTGTTCCTTGCTTGCGCCCTGTTTTAATGTTGTAGTTACAGGTGTC
CAGCAGGGAGGAATGCAGCCCCTGTGGGCGCTTGGGGGAGCTGCTGGGAATCCAAGTTCAAGGAGCAGCT
GTTTTCTGTTTTCTGTTGCCCCACAGCGCCACCTCCTGGCCCCTTGGTGGTGATGATTTTGAAGTCAGCA
GGTTCTGGTGGGCCGTGTGAACTCCAGCAGCTCTGGGCTGAGCTGTGGAAACACTGCGTCCTTTGAAATA
ATACAGCTTTCCTGAGCCCACCCCAGTCCCTAAAGACTGCCTCTGGGGTTGAGATTCTGAGATGCTTGAC
AGCATGGCTTTTCCCGGTGTTATGTGTCGTTTCTATCCTTAAGCCTGTTAGGGGTGGACTGGAGGCTGGA
CCAAGCTCCACTGGCTGCAGGAGGACCCTTCTGTGGGCTCCAGGCTGGCCGTGTGCGTGTGGGGAGGTGG
GATTTGCTGCTAGGCTTCATGATCACTGTGAAGAAGCAGCCCCCAAGAATAGGGTGATAGGCCCTCCCCA
TGTCACCG

FIGURE 33
SEQ ID NO: 25
Genbank ID        : AI990465
Unigene ID(#167)  : Hs.38070
Unigene name      :        lymphoid nuclear protein related to AF4    LAF4
>gi|5837346|gb|AI990465.1|AI990465  wt74h04.x1  Soares_thymus_NHFTh  Homo
sapiens
cDNA clone IMAGE:2513239 3' similar to SW:LAF4_HUMAN P51826 LAF-4 PROTEIN
;cont
ains element TAR1 repetitive element ;, mRNA sequence
GCGGCCGCGGGCTCCTCGGGCCGGTGGCAGTTGGCGCCGTCCCCGGCTGAGGTCCTCTCGGTGCGCCTGG
TGGGCTTCTTGCCCGCGGACCTCCGGGCAGGCGCGGGCGCGTTCTCCGCGGGCGCACAGGGCACTGCGGG
TGGCGGGGCGGCTGCGCTCACCGCCACGGCCACGGCCGCGGGCGGGGACTTCTGCTTCACGCCTTTACTC
CCAGGGGCCTTGTTGGCTGTCCTTGGCCTTTGCTCCTCCTTGCAAGTGCTCTTGATCTCCTTCTCTCTCA
GGCTGGGCTGGCAAACGTCGGGGACTTTCCCACAGTCCTGGCAGTCCTCTTTCACCGGGTTGTAGTACTG
ATTGCTCTCTGACCCGTGGCTTTCATTTTGGATCAGAATAGGAGGCTTGTGGGGATTAACTTTGTTTAGC
CATTTATCCAGCTGCCACTTGTTAGAGGATGCCGGTTCAGCCTCGGGGCTGGAGAAGTGGGGGCCTTGC
TGCCCTCACTCTCGCTGGAGCTGCTCTCGGTCTCCGAGTCAGATCCGGAGCTGCTCTCTGAGTCGCTGGA
GGAGCTGCTGCTGCCGCTGCTGCTGCTGGTGCTGCTGCCCTTGCTGGAAGGGCACGAGGTTTCTGCATTT
GGGCTGCTGGACCAACGGCGCTGTCAAGAGAGCGCCGGAGAGCCGTCTCTGAGCTGGCTGCTGTCAATTT
CCTCTTTATAACTGCTTAGCTTAAGGGATCTTTCCAACATTGT

FIGURE 34
SEQ ID NO: 26
Genbank ID        : AK000345.1
Unigene ID(#167)  : Hs.272499
Unigene name      :        dehydrogenase/reductase   (SDR  family)   member  2
    DHRS2
>gi|7020368|dbj|AK000345.1| Homo sapiens cDNA FLJ20338 fis, clone HEP12179
TACATTGGGTCTACTGCACAAATTACAGGGCTCCAAGTGTCTTATGAGAGCAGGACTTGGGCTGACCATG
TCTCTCTGCCCTCACCCATGCTCTGCTCTGATTTCAGGTCCTAAGTGTGAACGTGAAGTCCCAGCCCTG
CTGCTGAGCCAGTTGCTGCCCTACATGGAGAACAGGTATGGCAGGGCGGGGGTGGGGACCAGTCGGAGTT
GGGGACCTGAGGTGGGCACAGAAATACAGTCGGTAGCACAGCCAGTAGTGGGTAGAGGACAGAAGAGGTC
TGGGATCTCCACATCCCTCATCTTCTTGTCCTGCCTCCCCATCTGTGTGGCTGCCATTCCCAATTCCAGT
GGCTGCAGGATGAGAGTAGTATTCCAGGGGCCCAGGCATAGCCTCCTTGGCCTTGACATCAGCAGGTTTG
GGACAAGGCTATGCTTTAACTCCTTGACCTTGTGGGCTGGTCATTGTCACCTTACCTGCTCTCTGTTCTT
ACCAACTTAAAACCAATGACAGGGTTAGCCCCATTCCTCTCCATAGGAAAAAGCCTGTCCCAGACCTCTC
CTCATGCCTGCGCTTGGTCTCCAGGGACCCTGCCTGTGTTCCAGGTCCTGCAGATCTGACTGTACCCCTC
ACAGACACACCCTTAGGAACTGGCCAGGGCTGTCTTCAGTAGAAGGAAAGTCCCTGACTGTCACTTCTG
GTCTCCCTTACCCCATCTGCTCCTTAGAGGTTGCTCATTGATAGGCACTCACCATCAGCCTTGGGTGCCT
CTTCACAAAGCCCACCCTGCCCTCTCCTTCAAGCCCCTGGCAGAGAGGAAGCAGAAGATAAGGGTTCTG
AGCATGGACATCGTATTTATGAGAAATAGGCATGGAATCCTAGCTCTGCCGTGTATTGGCTGGTACTAAA
CCTTTCTGAGCCTCAGTTTTCTGAACTCTGAGATGGGGACAGTAATAGGACCTGTGTTGCTTCTGTGAGG
GTTGCATCATTTAATGAACTCATGATAGTGTCACCATCAGTGGTAAGCTCTTAGCTTCAGCTTCTCTTAT
GTTTGTCTTGTCTCAGGAGGGGTGCTGTCATCCTGGTCTCTTCCATTGCAGCTTATAATCCAGTAGTGGT
AAGTGCTTGGTCCTTGTGCTCCTGAGTGGTATAGGGTGAGGGCAACTTTGTTCTTTTCCTCAGAGCCTT
ACAGACAAAGTGCCTGGGACAGACCCCCACCATCCTCCTGCTGCCCTGGGCTGAGCTTGTCTCCATGTGG
GTGGGAGGGCTGCTGGGCCTGTGAGATCCCTGTAGGTGAGAAATCCAACTGATGCTTTCCCCCACTCTCC

FIGURE 34 cont'd

```
CATATCCTAATCACTCTGTCAATTCCCTTCCCAGGCGCTGGGTGTCTACAATGTCAGCAAGACAGCGCTG
CTGGGTCTCACTAGAACACTGGCATTGGAGCTGGCCCCCAAGGACATCGGGTAAACTGCGTGGTTCCAG
GAACTATCAAAACTGACTTCAGCAAAGTGGTGAGGATTGGGTGTGTCTTCCATCTCCCAGTCTGGCTCAG
TGGGAACCCTTCCCAGTGAATAAGGGATCAAGGGGTGACTGAATCCTTAGGTCAGCATGCCTATGACTGA
GGTCCTCATTGTTCTCTGAACTCAGCCATGGTGCAGTCCATCCATCCTGAAAAGATGCTCCTTCTTTTGA
GAAGGGCAAAGCTGCCCTAGGTGTTCTGCCTGGTGGCCTTCCCGGGGCCCTGCCCATCTTGTTTTAGTAG
CACTGACTCCTTCATTTCTTCCCTTTGCCCAGTTTCATGGGAATGAGTCTCTCTGGAAGAACTTCAAGGA
ACATCATCAGCTGCAGAGGCAAGTGGGGTTTGGAGATTTGGTGGTCCATGTGTGGCTAGGCAGGGGCAGT
TGAGTCTATTGCAAGAGCAGACCCCTCCCTGTCATCTGGCCATTGTTTTTGCTGAAATCTGGAGTCCACA
TGGCCCTGGAGGGTGCAAGTAGCCCTGCTGCATCCACCTTGTTCCCCATGGAGCCCACTCCCACCTGTCA
TCCGTGAGCCCCAGAGCAGCAGAATCAGAGTACGAGATGCTTGACACTGTGTCCTTCTTCCATCCAGGAT
TGGGGAGTCAGAGGACTGTGCAGGAATCGTGTCCTTCCTGTGCTCTCCAGATGCCAGCTACGTCAACGGG
GAGAACATTGCGGTGGCAGGCTACTCCACTCGGCTCTGAGAGGAGTGGGGGCGGCTGCGTAGCTGTGGTC
CCAGGCCAGGAGCCTGAGGGGGTGTCTAGGTGATCATTTGGATCTGGAGGCAGAGTCTGCCATTCTGCC
AGACTAGCAATTTGGGGCTTACTCATGCTAGGCTTGAGGAAGAAGAAAAACGCTTCGGCATTCTCCTTA
GGACTTATCTGCTTGTAGATTTGGCTGATCCAATTAACATGTGGGGTTCTTGGTGTGGGTCTGAGGAGCT
GAAGGATTTTATGGAGCTGGTGCTTTGGAGGAATCTTAAGGGAAAGGAGTAGAAGCTCAGGCCTTTGAAG
GATTTCAGCTCCTCCTCTCTGTAATTTGTGCTTTAAGCATTTTTTTTCCTAAAATAAACTCAATTTATC
CTCAAAAAAAAAAAAAAAA
```

FIGURE 35
SEQ ID NO: 27
Genbank ID        : BF245284
Unigene ID(#167)  : Hs.354427
Unigene name      :        Transcribed sequences
>gi|11159216|gb|BF245284.1|BF245284   601863760F1   NIH_MGC_57   Homo   sapiens
cDNA cl
one IMAGE:4081214 5', mRNA sequence

```
GAGCAGGGCTCTGCCTTCCAGCAGATCTGAGAGGAGTCCCATTTGGCTCCTTCCTAGCTGCCCTCCATTC
TCTAAGACCTGTAAAACAGGGATGGCCAGAGGGCTCTTGTTGCACAGTAAGTGCTATGCTTCCTAAATGC
TAGTTCCTGAAATAGAATGGTTTAACCTCTACTTACTAAACACCTGCTACAATCCTGTTAATTCTTTTGA
CATGTAAGACTAAAATAAATAAATAAATAAATATAAAAAAAAAAAAAAAAAAAAAAAAAAAAAAAA
AAAAAAAAAAAAAAAAACAACAACAAAAAGAAGACAGGCGGGAAAGAAAAAAAAACAGAAGAACAAAC
AACAACAACAGCAGCGAGCGGTGGGGGCGCGGCGCACGCCGCCGCCAGGAGAACAACTGTTAACCCCCAA
CACAGTGGTGGGGGCGGGCGGCGCGCCCCACAGGGAGTGAGTAGCAAAGAGGAGGGTGAATATCATGCGG
TCGCTCCGAGAGAACAGATGTCGGGGCAGACAGAACAAAGCAGCGCGGGGGCTCACACCCCCGAAAATAA
AAAAAGCCGGGGCGGGCAAAAAAAGGGGGGTCTGGGAAACACCCGCGGAGAGGGGTCGCGACGAGCGCAG
AGGGGGGTACTAACAAAGGGGGGGCCACAGAGACGCGTAATAAATAGCCCCGC
```

FIGURE 36
SEQ ID NO: 28
Genbank ID        : NM_003226.1
Unigene ID(#167)  : Hs.82961
Unigene name      :        trefoil factor 3 (intestinal) TFF3
>gi|4507452|ref|NM_003226.1|  Homo  sapiens  trefoil  factor  3  (intestinal)
(TFF3),
 mRNA

```
GATGCTGGGGCTGGTCCTGGCCTTGCTGTCCTCCAGCTCTGCTGAGGAGTACGTGGGCCTGTCTGCAAAC
CAGTGTGCCGTGCCGGCCAAGGACAGGGTGGACTGCGGCTACCCCCATGTCACCCCCAAGGAGTGCAACA
ACCGGGGCTGCTTTGACTCCAGGATCCCTGGAGTGCCTTGGTGTTTCAAGCCCCTGACTAGGAAGAC
AGAATGCACCTTCTGAGGCACCTCCAGCTGCCCCTGGGATGCAGGCTGAGCACCCTTGCCCGGCTGTGAT
TGCTGCCAGGCACTGTTCATCTCAGTTTTTCTGTCCCTTTGCTCCCGGCAAGCTTTCTGCTGAAAGTTCA
TATCTGGAGCCTGATGTCTTAACGAATAAAGGTCCCATGCTCCACCCG
```

FIGURE 37
SEQ ID NO: 29
Genbank ID        : R73030

FIGURE 37 cont'd

Unigene ID(#167) : Hs.252938
Unigene name    :         low density lipoprotein-related protein 2 LRP2
>gi|847062|gb|R73030.1|R73030 yj94c11.s1 Soares breast 2NbHBst Homo sapiens cDN
A clone IMAGE:156404 3', mRNA sequence
ANTTTTTTTTCTGCAACTAATACACATTTATTAGAACTTTTTCAGCAGCATTATTTCCAGTTGTTTATC
TAATCAAAGTAATTACAGTCAGCACTCAAAATATCAGCAACAAATATTTTGAGAACTCTGGAATAAAATA
ATCAGTAGTATATGTTTCATTCATTCATCCATCCATCCATCCATCCATTCATTCATTGTTTAACAAATGT
GCAATATTAGCACAGAGAGTCAGGTATGCTATTTGCTATGGGAAAGTGTATATTCCNGCCATGGGTTCCN
GTTGTGCAGACTATACCCACTATTTAAGAGGGAGAGCTGGGAAGCCAGGGGCACAGTGGGCTCACGGCCC
GTAACCCCAACCACTCAGGGGGGCTGAGGGTGGGGNGGGGTCACTTGAGGCCCGGGGGCTTTCAAGGTTC
AGCCTTG

FIGURE 38
SEQ ID NO: 30
Genbank ID      : AL080170.1
Unigene ID(#167) : acc_AL080170.1
Unigene name    :
>gi|5262639|emb|AL080170.1|HSM800689 Homo sapiens mRNA; cDNA DKFZp434C091 (from
  clone DKFZp434C091)
CCCAGCGCCCCGGAAGTGATCTGTGGCGGCTGCTGCAGAGCCGCCAGGAGGAGGGTGGATCTCCCCAGAG
CAAAGCGTCGGAGTCCTCCTCCTCCTTCTCCTCCTCCTCCTCCTCCTCCAGCCGCCCAGGCTCCCCC
GCCACCCGTCAGACTCCTCCTTCGACCGCTCCCGGCGCGGGCCTTCCAGGCGACAAGGACCGAGTACCC
TCCGGCCGGAGCCACGCAGCCGCGGCTTCCGGAGCCCTCGGGGCGGCGGACTGGCTCGCGGTGCAGGTAA
AGCTCCAGATGGCTCTGGAACTTATGAGGAAAGAGTTGGAGGACGCCTTGACTCAGGAGGCCAACGTGGG
GAAAAAGACTGTCATTTGGAAGGAGAAAGTGGAAATGCAGAGGCAGCGCTTCAGATTGGAGTTTGAGAAG
CATCGTGGCTTTCTGGCCCAGGAGGAGCAACGGCAGCTGAGGCGGCTGGAGGCGGAGGAGCGAGCGACGC
TGCAGAGACTGCGGGAGAGCAAGAGCCGGCTGGTCCAGCAGAGCAAGGCCCTGAAGGAGCTGGCGGATGA
GCTGCAGGAGAGGTGCCAGCGCCCAGCCCTGGGTCTGCTGGAGGGTGTGAGAGGAGTCCTGAGCAGAAGT
AAGGCTGTCACAAGGCTGGAAGCAGAGAACATCCCCATGGAACTGAAGACAGCATGCTGCATCCCTGGGA
GGAGGGAGCTCTTAAGGAAGTTCCAAGTGGATGTAAAGCTGGATCCCGCCACGGCGCACCCGAGTCTGCT
CTTGACCGCCGACCTGCGCAGTGTGCAGGATGGAGAACCATGGAGGGATGTCCCCAACAACCCTGAGCGA
TTTGACACATGGCCCTGCATCCTGGGTTTGCAGAGCTTCTCATCAGGGAGGCATTACTGGGAGGTTCTGG
TGGGAGAAGGAGCAGAGTGGGGTTTAGGGGTCTGTCAAGACACACTGCCAAGAAAGGGGGAAACCATGCC
ATCTCCTGAGAATGGGGTCTGGGCCCTGTGGCTGCTGAAAGGGAATGAGTACATGGTCCTTGCCTCCCCA
TCAGTGCCTCTTCTCCAACTGGAAAGTCCTCGCTGCATTGGGATTTTCTTGGACTATGAAGCCGGTGAAA
TTTCATTCTACAATGTCACAGATGGATCTTATATCTACACATTCAACCAACTCTTCTCTGGTCTTCTTCG
GCCTTACTTTTTCATCTGTGATGCAACTCCTCTTATCTTGCCACCCACGACAATAGCAGGGTCAGGAAAT
TGGGCATCCAGGGATCATTTAGATCCTGCTTCTGATGTAAGAGATGATCATCTCTAAAATTCTGTTCCCA
AGATGCAGTCCTAGCGTAGCGAACGTTCCTGGAGTGGGGTGAAGGATATCAATATACTAAGTTTTAACAG
ATACCCCATTTAGGTCAGCACTTGATTCGTTGTTGCTGTGAAATATGTCCATGGGACAAAAGAGGGAATA
TGAAATATTTGCATATGGGAAGATTATAGAGCATAATAATTTTGTAAATGGAGCAATCTCAACCTCTATT
TCTAGATCACATTTTCTTGATGTCTTCCTTCAAATTAATGACCTTGGATTACATAAGGATTTCTATGCAT
TCATTATAATTTGTTATTCCTTTCAATATCCTTGTATTTCAAATCTTCCATATAAGAATTAGACATGGCA
ATTCTTAAATTGATTCAGAATGGTCTGATACTATTCCAGTATCACCTCCTTAATTCTGTTTCTCCTCGTT
TTCCTGATTTTCCTTCTCATTCTCTCCTTCCCCGCTCTGTCTCTCTCCCTGTCACTCTCTCTCTCG
TTCCTTATTTTTTGTTTCTTACCTCTTACTGTTTAACCTGTTGCTTCCTTCTGGATTAATACATTTAGAG
CCATTCCTTTATATGGTCACATTTCCTATGACTTTACTCAATTACTTTTAAAATCCTTTCTATTCTGAGA
CTAATTTTTAAGAATTACAAAGCTCATTCTTCTGAATCTAATATCACTAACTCCTAGACTTTTTCCGTTT
TCTTTGGATACACTTTAAGTAGGAATTTATCAGAATTTTCATTCAACTCGTTCTTTAATGCAGATATTTA
CTGGTTATAAGACCTTAAGGCTGGGTGCAGTGGCTCACGCCTGTGGTCCCAGCGCTTTGGGGGCTGAGG
CGGGTGGATCACAGGCTCGGGAGTTCGGGGCCAGCCTGGCCAGCATGGTGAAACCCTGTCTCTACTAGAA
AAAAAAA

FIGURE 39
SEQ ID NO: 31

FIGURE 39 cont'd

```
Genbank ID       : NM_002466.1
Unigene ID(#167) : Hs.179718
Unigene name     :    v-myb    myeloblastosis    viral    oncogene    homolog
(avian)-like 2     MYBL2
>gi|4505292|ref|NM_002466.1|   Homo    sapiens    v-myb    myeloblastosis    viral
oncogene h
omolog (avian)-like 2 (MYBL2), mRNA
GCTGACGCCTTCGAGCGCGGCCCGGGGCCCGGAGCGGCCGGAGCAGCCCGGGTCCTGACCCCGGCCCGGC
TCCCGCTCCGGGCTCTGCCGGCGGGCGGGCGAGCGCGGCGCGGTCCGGGCCGGGGGGATGTCTCGGCGGA
CGCGCTGCGAGGATCTGGATGAGCTGCACTACCAGGACACAGATTCAGATGTGCCGGAGCAGAGGGATAG
CAAGTGCAAGGTCAAATGGACCCATGAGGAGGACGAGCAGCTGAGGGCCCTGGTGAGGCAGTTTGGACAG
CAGGACTGGAAGTTCCTGGCCAGCCACTTCCCTAACCGCACTGACCAGCAATGCCAGTACAGGTGGCTGA
GAGTTTTGAATCCAGACCTTGTCAAGGGGCCATGGACCAAAGAGGAAGACCAAAAAGTCATCGAGCTGGT
TAAGAAGTATGGCACAAAGCAGTGGACACTGATTGCCAAGCACCTGAAGGGCCGGCTGGGGAAGCAGTGC
CGTGAACGCTGGCACAACCACCTCAACCCTGAGGTGAAGAAGTCTTGCTGGACCGAGGAGGAGGACCGCA
TCATCTGCGAGGCCCACAAGGTGCTGGGCAACCGCTGGGCCGAGATCGCCAAGATGTTGCCAGGGAGGAC
AGACAATGCTGTGAAGAATCACTGGAACTCTACCATCAAAAGGAAGGTGGACACAGGAGGCTTCTTGAGC
GAGTCCAAAGACTGCAAGCCCCCAGTGTACTTGCTGCTGGAGCTCGAGGACAAGGACGGCCTCCAGAGTG
CCCAGCCCACGGAAGGCCAGGGAAGTCTTCTGACCAACTGGCCCTCCGTCCCTCCTACCATAAAGGAGGA
GGAAAACAGTGAGGAGGAACTTGCAGCAGCCACCACATCGAAGGAACAGGAGCCCATCGGTACAGATCTG
GACGCAGTGCGAACACCAGAGCCCTTGGAGGAATTCCCGAAGCGTGAGGACCAGGAAGGCTCCCCACCAG
AAACGAGCCTGCCTTACAAGTGGGTGGTGGAGGCAGCTAACCTCCTCATCCCCGCTGTGGGTTCTAGCCT
CTCTGAAGCCCTGGACTTGATCGAGTCGGACCCTGATGCTTGGTGTGACCTGAGTAAATTTGACCTCCCT
GAGGAACCATCTGCAGAGGACAGTATCAACAACAGCCTAGTGCAGCTGCAAGCGTCACATCAGCAGCAAG
TCCTGCCACCCCGCCAGCCTTCCGCCCTGGTGCCCAGTGTGACCGAGTACCGCCTGGATGGCCACACCAT
CTCAGACCTGAGCCGGAGCAGCCGGGGCGAGCTGATCCCCATCTCCCCCAGCACTGAAGTCGGGGGCTCT
GGCATTGGCACACCGCCCTCTGTGCTCAAGCGGCAGAGGAAGAGGCGTGTGGCTCTGTCCCCTGTCACTG
AGAATAGCACCAGTCTGTCCTTCCTGGATTCCTGTAACAGCCTCACGCCCAAGAGCACACCTGTTAAGAC
CCTGCCCTTCTCGCCCTCCCAGTTTCTGAACTTCTGGAACAAACAGGACACATTGGAGCTGGAGAGCCCC
TCGCTGACATCCACCCCAGTGTGCAGCCAGAAGGTGGTGGTCACCACACCACTGCACCGGGACAAGACAC
CCCTGCACCAGAAACATGCTGCGTTTGTAACCCAGATCAGAAGTACTCCATGGACAACACTCCCCACAC
GCCAACCCCGTTCAAGAACGCCCTGGAGAAGTACGGACCCCTGAAGCCCCTGCCACAGACCCCGCACCTG
GAGGAGGACTTGAAGGAGGTGCTGCGTTCTGAGGCTGGCATCGAACTCATCATCGAGGACGACATCAGGC
CCGAGAAGCAGAAGAGGAAGCCTGGGCTGCGGCGGAGCCCCATCAAGAAAGTCCGGAAGTCTCTGGCTCT
TGACATTGTGGATGAGGATGTGAAGCTGATGATGTCCACACTGCCCAAGTCTCTATCCTTGCCGACAACT
GCCCCTTCAAACTCTTCCAGCCTCACCCTGTCAGGTATCAAAGAAGACAACAGCTTGCTCAACCAGGGCT
TCTTGCAGGCCAAGCCCGAGAAGGCAGCAGTGGCCCAGAAGCCCCGAAGCCACTTCACGACACCTGCCCC
TATGTCCAGTGCCTGGAAGACGGTGGCCTGCGGGGGACCAGGGACCAGCTTTTCATGCAGGAGAAAGCC
CGGCAGCTCCTGGGCCGCCTGAAGCCCAGCCACACATCTCGGACCCTCATCTTGTCCTGAGGTGTTGAGG
GTGTCACGAGCCCATTCTCATGTTTACAGGGGTTGTGGGGGCAGAGGGGGTCTGTGAATCTGAGAGTCAT
TCAGGTGACCTCCTGCAGGGAGCCTTCTGCCACCAGCCCCTCCCCAGACTCTCAGGTGGAGGCAACAGGG
CCATGTGCTGCCCTGTTGCCGAGCCCAGCTGTGGGCGGCTCCTGGTGCTAACAACAAAGTTCCACTTCCA
GGTCTGCCTGGTTCCCTCCCCAAGGCCACAGGGAGCTCCGTCAGCTTCTCCCAAGCCCACGTCAGGCCTG
GCCTCATCTCAGACCCTGCTTAGGATGGGGGATGTGGCCAGGGGTGCTCCTGTGCTCACCCTCTCTTGGT
GCATTTTTTTGGAAGAATAAAATTGCCTCTCTCTTTG
```

FIGURE 40

SEQ ID NO: 32

```
Genbank ID       : NM_003225.1
Unigene ID(#167) : Hs.350470
Unigene name     :    trefoil  factor  1  (breast  cancer,  estrogen-inducible
sequence expressed in)    TFF1
>gi|4507450|ref|NM_003225.1|   Homo  sapiens  trefoil  factor  1  (breast cancer,
estr
ogen-inducible sequence expressed in) (TFF1), mRNA
ATCCCTGACTCGGGGTCGCCTTTGGAGCAGAGAGGAGGCAATGGCCACCATGGAGAACAAGGTGATCTGC
GCCCTGGTCCTGGTGTCCATGCTGGCCCTCGGCACCCTGGCCGAGGCCCAGACAGAGACGTGTACAGTGG
CCCCCCGTGAAAGACAGAATTGTGGTTTTCCTGGTGTCACGCCCTCCAGTGTGCAAATAAGGGCTGCTG
TTTCGACGACACCGTTCGTGGGGTCCCCTGGTGCTTCTATCCTAATACCATCGACGTCCCTCCAGAAGAG
GAGTGTGAATTTTAGACACTTCTGCAGGGATCTGCCTGCATCCTGACGGGGTGCCGTCCCCAGCACGGTG
```

FIGURE 40 cont'd

ATTAGTCCCAGAGCTCGGCTGCCACCTCCACCGGACACCTCAGACACGCTTCTGCAGCTGTGCCTCGGCT
CACAACACAGATTGACTGCTCTGACTTTGACTACTCAAAATTGGCCTAAAAATTAAAAGAGATCGATATT
AAAAAAAAAAAAAAAAAAAAAAAAAAAAAAAAAAAAAAAAAAAAAAAAAA

FIGURE 41
SEQ ID NO: 33
Genbank ID         : NM_018510.1
Unigene ID(#167)   : Hs.283031
Unigene name       :        epidermal growth factor receptor pathway substrate
15-like 2    EPS15L2
>gi|8924091|ref|NM_018510.1| Homo sapiens epidermal growth factor receptor path
way substrate 15-like 2 (EPS15L2), mRNA
AGGCATATCACTTCTCTTTTTAAATCTCTTAGACTCTCCTGCACACAGGAAGGAATCTAAGGTTTCCCTA
TGGGCACCAGACTCCATGTAATCTAGTCTTTGGCCACCTCTGATCTCATCTGCTAAAATCATTTCAATCT
CTCCTTACTCAGTCCATCCCAAGCCATCCCTGGAAGGTTTCATCCCAACTGGTTCTCACATCCAGTCTTT
GCACTTCAGCTGTCTGTCCCTTGAATGCTTCCACAAAACATAGCAGGGGAACTATTATTTAGGCCTCTGT
TCAAGTATCACCTCCTTCAAGTGGTCTTTCCTGACTGTCCACTCTAAGGAGCCTCCCTTCTGTCACCATT
TAGCTGTATTTCCCTTTACTTACAGCAAAATTGTAACTAGATAATGCATTACATGTTTTTCTGTTGCATG
TATATTCTGTTTCTTTCTCATAAATGTAAACCCTCCTATGGCCCAAATCTTCATTTGCCTTTTCAACTCC
TTTATCTCCAGCATGTGGAGCACACTTGGTACACATTAGGAGCTGAAATGCTCCATAGCTGCTGAATCAG
TAGCACCAACATGTGTACCCACCACCTTCTCAAGTGTGGCTTTATAAGATGTTCATCATGGTTGAGTGAG
GATAAGGGAAAGAATAGTCTGTTTCTTTTATGATATGGTTTGGCTGTGTCCCATGCAAATCTCATCTTG
AATTCCTATGTGTTGTGGGAAGGACCCTGTGGGAGGTCATTGAATCACGGGGGCAGGCCTTTCCCATGCT
GTTCTGGTGATAGTGAATAAGTCTCACAAGATCTGATAGTTTTAAAAGGAGGAGTTCCCCTGTACAAGCT
CTCTCTCTTTGCCTGCTGCCATCCATGTAAGACGTTACTTGCTCCTCCTTGCCTTCCACCATGCTTGTGA
GATCTTCCCAGCCAAGTGGAATTGTAAGTCCATTACACCTCTTTTTCTTCCCAGTCTTGAGTATGTCTTT
ATCAGCAGCCTGAAAATGGACTAACACATTTTATGATTGGTGCAAATTGGCTACTGATAAAAATCCTGAT
GATAGGAAAATTTCAAATTTCCTTATAGTAAAAATACTACTTAATTTAATTTTTAGAGACAAGGAAAAAC
ATTTTGCAGAGTTTGGCTCCACTATTGAAAAGGGATGCTTTAGGTTGAACCATTGTAGCCTCAGATTCT
ATCTTTTCCTAAATAAACACATTAAAGCCTCATGTGTGAAATTATTTTTAAAAATATTTATCTGGATTT
AAAGAATAACAGATCAACAGATACCTCTCAATGTGTTTGCTAATTAATAAAAATCAGTTTCTTACAACTA
ATGTTTGTAAGAAAATGTTCATTTTAAGTGCTAAATAGTGAAGAAAATTTATCACCTAAAATACACCCAT
CAATATAAGGCAAGAAAAAATCTTAACATGCAGCCATTCGCTTTTGCCATGCCCTGTCCTGTTTACTTCT
TAAGAGGTTTATTTTTGTACTTTTGCAGAATAAACTTTAGTAATCTAGAACTGGAAGGTACTATATATGT
ATGTGTGTGTATATATATATATAAAAGAAAAACATATATATATTTCAATTACTTGAAATGTAAAAACTTA
CCGAATACAAATGGAAAAAGTGATGTGTATTATATCATATTGCTTTTTGTCCATCTTTGTGATTTATTTA
CTCACTTCATGTTTTTCATTTACAAAATTGTCAAGCTAGCCAAAATAATTCTTGTTTTCTTAATTGGGAG
AGAAGAGACCTGACAGATTATCTATACTCTTCATATGTTAAAAGACCATTTCCTGTAAAACTGACCTAGT
GCACAAACTGAATTTGAAATAGACTGTGAAGTAAACTATAACTTGTCCTTTTAATTTTGTTTAACATGGT
TACTGACTTACATGATGTATTGAATATCAAGATAAAGAAAAATGTGTCTAAAAGCTAATTAGAATTCTCT
GGGTCACCAAGTCAAGGTGCTATTGATCTGGGTTAATCTGAGTAACTTATTGTCTAGCCTATAAATAAGT
TCCAAAATATCGAATTCAAAAAAAAAAAAAAAAAAAAAAAA

FIGURE 42
SEQ ID NO: 34
Genbank ID         : AI668620
Unigene ID(#167)   : Hs.144151
Unigene name       :        Transcribed sequences
>gi|4827928|gb|AI668620.1|AI668620 yo53h06.x5 Soares breast 3NbHBst Homo sapien
s cDNA clone IMAGE:181691 3' similar to contains L1.t2 L1 repetitive
element ;,
 mRNA sequence
TTAAACATCANGTTTATATACTTTTATTAATACAGGACACACATTATAAGTCACACACAAAAAGAGATAA
AATAATTAGATAAAATAACATAAGAATTTGAATATTTTCTTCTTTTGCCTAAGATATATTCAGCTTGCCC
CATGTATTTTATGGCCCTCTTTCTGCTAATAACAATAACACACTAAAAAATACTTGCTCTGAGTCATCAG
ATGGAGTCTTCCTTCAACAAGGCTCTTCAGGTCATTGGTGCTATGAAGGAGACCCCATCAGACTAACAGT
GGATTTCTCAGCAGAAATCATAAAGGCCAGAAAACAGTGGAATGGCATTTTCAAAATGCTCTTTCCATTG
CTTTTTCCATACCACTGCTTTTCCCAGGACTGGAGACTTGGTTTCCAGCTCTTTGCACCTCCTCCAGCAAT
GTCTTTTTTGCAGATGTGCTTGGCCTTAATTCCATCAACAGTGTCCTGAGACTGAGGATAGATAAAATAC
TTCAGGTCAAAGCAGAGCCTTTTTTTTAAAAAAATAATCTTTTACTGGGAGGTGGCAAGAGACCCATTT
CTTCAGAATTCCTGTATGGCTCATATTCTGTGTCAGGGATTGTGGGAAAGACAATTC

FIGURE 43
SEQ ID NO: 35
Genbank ID        : NM_022358.1
Unigene ID(#167)  : Hs.528664
Unigene name      :     potassium channel, subfamily K, member 15 KCNK15
>gi|11641274|ref|NM_022358.1| Homo sapiens two pore potassium channel KT3.3 (LO
C64181), mRNA
GGAGCGCGCGGTCCGGGCACACGGAGCAGGTTGGGACCGCGGCGGGTACCGGGGCCGGGGCGCCATGCGG
AGGCCGAGCGTGCGCGCGGCCGGGCTGGTCCTGTGCACCCTGTGTTACCTGCTGGTGGGCGCTGCTGTCT
TCGACGCGCTCGAGTCCGAGGCGGAAAGCGGCCGCCGACTGCTGGTCCAGAAGCGGGGCGCTCTCCG
GAGGAAGTTCGGCTTCTCGGCCGAGGACTACCGCGAGCTGGAGCGCCTGGCGCTCCAGGCTGAGCCCAC
CGCGCCGGCCGCCAGTGGAAGTTCCCCGGCTCCTTCTACTTCGCCATCACCGTCATCACTACCATCGGGT
ACGGCCACGCCGCGCCGGGTACGGACTCCGGCAAGGTCTTCTGCATGTTCTACGCGCTCCTGGGCATCCC
GCTGACGCTGGTCACTTTCCAGAGCCTGGGCGAACGGCTGAACGCGGTGGTGCGGCGCCTCCTGTTGGCG
GCCAAGTGCTGCCTGGGCCTGCGGTGGACGTGCGTGTCCACGGAGAACCTGGTGGTGGCCGGGCTGCTGG
CGTGTGCCGCCACCCTGGCCCTCGGGCCGTCGCCTTCTCGCACTTCGAGGGCTGGACCTTCTTCCACGC
CTACTACTACTGCTTCATCACCCTCACCACCATCGGCTTCGGCGACTTCGTGGCACTGCAGAGCGGCGAG
GCGCTGCAGAGGAAGCTCCCCTACGTGGCCTTCAGCTTCCTCTACATCCTCCTGGGGCTCACGGTCATTG
GCGCCTTCCTCAACCTGGTGGTCCTGCGCTTCCTCGTTGCCAGCGCCGACTGGCCCGAGCGCGCTGCCCG
CCCCCCCAGCCCGCGCCCCCGGGGGCGCCCGAGAGCCGTGGCCTCTGGCTGCCCCGCCGCCCGGCCCGC
TCCGTGGGCTCCGCCTCTGTCTTCTGCCACGTGCACAAGCTGGAGAGGTGCGCCCGCGACAACCTGGGCT
TTTCGCCCCCCTCGAGCCCGGGGGTCGTGCGTGGCGGGCAGGCTCCCAGGCCTGGGGCCCGGTGGAAGTC
CATCTGACAACCCCACCCAGGCCAGGGTCGAATCTGGAATGGGAGGGTCTGGCTTCAGCTATCAGGGCAC
CCTCCCCAGGGATTGGAAACGGATGACGGGCCTCTAGGCGGTCTTCTGCACGAGCAAGTTTCTCATTACT
GTCTGTGGCTAAGTCCCCTCCCTTCTTTCCAAAAATATATTACAGTCACCCCATAAAAAAAAAAAAAAAA
AAAAAAAAAAAAAAAAAAAAAAAAA

FIGURE 44
SEQ ID NO: 36
Genbank ID        : BC004863.1
Unigene ID(#167)  : Hs.286049
Unigene name      :     phosphoserine aminotransferase 1    PSAT1
>gi|13436073|gb|BC004863.1| Homo sapiens phosphoserine aminotransferase 1, tran
script variant 1, mRNA (cDNA clone MGC:10519 IMAGE:3938160), complete cds
GGCACGAGGGCCAGGAACGCCAGCCGTTCACGCGTTCGGTCCTCCTTGGCTGACTCACCGCCCTCGCCGC
CGCACCATGGACGCCCCCAGGCAGGTGGTCAACTTTGGGCCTGGTCCCGCCAAGCTGCCGCACTCAGTGT
TGTTAGAGATACAAAAGGAATTATTAGACTACAAAGGAGTTGGCATTAGTGTTCTTGAAATGAGTCACAG
GTCATCAGATTTTGCCAAGATTATTAACAATACAGAGAATCTTGTGCGGGAATTGCTAGCTGTTCCAGAC
AACTATAAGGTGATTTTTCTGCAAGGAGGTGGGTGCGGCCAGTTCAGTGCTGTCCCCTTAAACCTCATTG
GCTTGAAAGCAGGAAGGTGTGCGGACTATGTGGTGACAGGAGCTTGGTCAGCTAAGGCCGCAGAAGAAGC
CAAGAAGTTTGGGACTATAAATATCGTTCACCCTAAACTTGGGAGTTATACAAAAATTCCAGATCCAAGC
ACCTGGAACCTCAACCCAGATGCCTCCTACGTGTATTATTGCGCAAATGAGACGGTGCATGGTGTGGAGT
TTGACTTTATACCCGATGTCAAGGGAGCAGTACTGGTTTGTGACATGTCCTCAAACTTCCTGTCCAAGCC
AGTGGATGTTTCCAAGTTTGGTGTGATTTTTGCTGGTGCCCAGAAGAATGTTGGCTCTGCTGGGGTCACC
GTGGTGATTGTCCGTGATGACCTGCTGGGGTTTGCCCTCCGAGAGTGCCCCTCGGTCCTGGAATACAAGG
TGCAGGCTGGAAACAGCTCCTTGTACAACACGCCTCCATGTTTCAGCATCTACGTCATGGGCTTGGTTCT
GGAGTGGATTAAAAACAATGGAGGTGCCGCGGCCATGGAGAAGCTTAGCTCCATCAAATCTCAAACAATT
TATGAGATTATTGATAATTCTCAAGGATTCTACGTTTGTCCAGTGGAGCCCCAAAATAGAAGCAAGATGA
ATATTCCATTCCGCATTGGCAATGCCAAAGGAGATGATGCTTTAGAAAAAAGATTTCTTGATAAAGCTCT
TGAACTCAATATGTTGTCCTTGAAAGGGCATAGGTCTGTGGGAGGCATCCGGGCCTCTCTGTATAATGCT
GTCACAATTGAAGACGTTCAGAAGCTGGCCGCCTTCATGAAAAAATTTTTGGAGATGCATCAGCTATGAA
CACATCCTAACCAGGATATACTCTGTTCTTGAACAACATACAAAGTTTAAAGTAACTTGGGGATGGCTAC
AAAAAGTTAACACAGTATTTTTCTCAAATGAACATGTTTATTGCAGATTCTTCTTTTTTGAAAGAACAAC
AGCAAAACATCCACAACTCTGTAAAGCTGGTGGGACCTAATGTCACCTTAATTCTGACTTGAACTGGAAG FIGURE 44 cont'd

```
CATTTTAAGAAATCTTGTTGCTTTTCTAACAAATTCCCGCGTATTTTGCCTTTGCTGCTACTTTTTCTAG
TTAGATTTCAAACTTGCCTGTGGACTTAATAATGCAAGTTGCGATTAATTATTTCTGGAGTCATGGGAAC
ACACAGCACAGAGGGTAGGGGGGCCCTCTAGGTGCTGAATCTACACATCTGTGGGGTCTCCTGGGTTCAG
CGGCTGTTGATTCAAGGTCAACATTGACCATTGGAGGAGTGGTTTAAGAGTGCCAGGCGAAGGGCAAACT
GTAGATCGATCTTTATGCTGTTATTACAGGAGAAGTGACATACTTTATATATGTTTATATTAGCAAGGTC
TGTTTTTAATACCATATACTTTATATTTCTATACATTTATATTTCTAATAATACAGTTATCACTGATATA
TGTAGACACTTTTAGAATTTATTAAATCCTTGACCTTGTGCATTATAGCATTCCATTAGCAAGAGTTGTA
CCCCCTCCCCAGTCTTCGCCTTCCTCTTTTTAAGCTGTTTTATGAAAAAGACCTAGAAGTTCTTGATTCA
TTTTTACCATTCTTTCCATAGGTAGAAGAGAAAGTTGATTGGTTGGTTGTTTTTCAATTATGCCATTAAA
CTAAACATTTCTGTTAAATTACCCTATCCTTTGTTCTCTACTGTTTTCTTTGTAATGTATGACTACGAGA
GTGATACTTTGCTGAAAAGTCTTTCCCCTATTGTTTATCTATTGTCAGTATTTTATGTTGAATATGTAAA
GAACATTAAAGTCCTAAAACATCTAAAAAAAAAAAAAAAAAAAAAAAAAAAAAAAAAAAAA
```

FIGURE 45
SEQ ID NO: 37
Genbank ID      : BC001012.1
Unigene ID(#167) : Hs.512620
Unigene name    :        hypothetical protein FLJ20151 FLJ20151
>gi|12654376|gb|BC001012.1|BC001012   Homo   sapiens,   hypothetical   protein
FLJ20151
, clone MGC:1073 IMAGE:3344130, mRNA, complete cds
```
GGCACGAGGGGAGCTCAAATGTGTGTGTGTCTCTCTGTGTGTTTGTGTGTGTGTGCACTCAAGACCTC
TAACAGCCTCGAAGCCTGGGGTGGCATCCCGGCCTTGCCATTAGCATGCCTCATGCATCATCAGATGACA
AGGACAACCCTCATGACGAAGCAACATGAATTAGGGGGCCTCTTGGCCTTGGTCCAAAATTGTCAATCAG
AAATGAACATAAAGGACTCCAGAGCAGTGGGACTGTCTGTCAAAAGACTCTGTATATCTTTTGTGGATGA
GTTTTGTGAGAGAACAGAGAGACCATTGTACCTGGCACAAGGGCTCTTCATGAAAAGGGAGACTTACTGG
GAGGTGCAAGACAGTGGCATTTCTCCTCTCCTCTTGCTGCTCAGCACAGCCCTGGATTGCAGCCCCGAGG
CTGAGACCAGACAAAGCCCGGGAGGCAGAAAGATGCTCAAGAACCAACACTATCAATGTCTTTGCAAAT
CCTCACAGGATTCCTGTGGGTCCAGCTTTGGAACTGGGAAACCTTTCTTCGGATCCGCACTCATTCCACT
GATGCCAGCTGCCCCTGAAGGATGCCAGTACTGTGGTGTGTGAGTCTCAGCAGCCGCCCACACGCTCCTA
ACTCTGCTGCATGGCAGATGCCTAGGTGGAAATAGCAAAAACAAGGCCCAGGCTGGGGCCAGGGCCAGAG
GGGAAGGCCCTGGATTCTCACTCATGTGAGATCTTGAATCTCTTTCTTTGTTCTGTTTGTTTAGTTAGTA
TCATCTGGTAAAATAGTTAAAAAACAACAAAAAAAAAAAAAAAAAAA
```

FIGURE 46
SEQ ID NO: 38
Genbank ID      : NM_003221.1
Unigene ID(#167) : Hs.33102
Unigene name    :        transcription factor AP-2 beta (activating enhancer
binding protein 2 beta) TFAP2B
>gi|4507442|ref|NM_003221.1| Homo sapiens transcription factor AP-2 beta
(activ
ating enhancer binding protein 2 beta) (TFAP2B), mRNA
```
TGCACTCACCTCCTAGAGACCAGGCTGCCATCATGCTCTGGAAGCTTGTGGAGAATGTCAAGTACGAAGA
TATCTATGAGGACCGGCACGATGGTGTCCCGAGCCACAGCTCGCGGCTCTCCCAGCTGGGCTCGGTGTCC
CAAGGACCCTACTCGAGCGCCCCGCCGCTGTCCCACACCCGTCGTCGGACTTCCAGCCGCCCTACTTCC
CACCCCCTACCAGCCGCTCCCCTACCACCAGAGCCAGGACCCCTACTCCCACGTCAACGACCCCTACTC
CCTGAACCCACTGCACCAGCCCCAGCAACATCCCTGGGGGCAACGGCAGCGGCAAGAAGTGGGTCGGAA
GCCGGCTCTCTCCTGCCCCAGCCTCGGGCCGCCTTGCCCCAGCTCTCGGGCCTTGACCCCCGGAGGGACT
ACCACTCGGTCCGCCGGCCGGACGTGCTGCTGCATTCGGCGCACCACGGCCTGGACGCGGGCATGGGTGA
CAGCCTCTCGCTGCACGGCCTCGGCCATCCCGGAATGGAAGACGTCCAGTCAGTTGAAGATGCCAATAAC
AGCGGCATGAATCTATTGGACCAGTCTGTCATTAAAAAAGTTCCAGTTCCTCCCAAATCGGTGACTTCTC
TAATGATGAATAAAGACGCTTCCTGGGAGGCATGTCTGTCAACACCGGCGAGGTGTTTTGCTCCGTCC
AGGCCGTTTGTCTCTGCTCAGTTCAACTTCGAAGTACAAAGTAACTGTGGGAGAAGTTCAGAGACGGCTG
TCGCCCCCTGAATGCCTCAATGCATCTCTCCTCGGCGGAGTCCTCAGAAGAGCCAAATCGAAAAATGGGG
GGAGATCTTTGCGAGAAAGGCTAGAAAAAATCGGTTTGAATTTACCCGCGGGCAGGCGCAAAGCAGCAAA
TGTCACGTTACTCACCTCCCTGGTGGAAGGAGAAGCTGTTCACTTAGCTAGGGATTTTGGGTACATTTGC
GAAACGGAGTTTCCCGCCAAAGCCGTCTCTGAGTATTTGAACCGGCAGCACACAGACCCGAGTGACCTGC
```

FIGURE 46 cont'd

```
ACTCCCGAAAGAATATGCTGTTGGCCACCAAGCAACTTTGTAAAGAATTTACGGATCTACTGGCGCAGGA
CCGGACACCGATAGGGAACAGCCGACCCAGCCCCATCCTGGAGCCGGGGATCCAGAGCTGCCTCACGCAC
TTCAGCCTCATCACGCACGGCTTCGGCGCCCCGGCCATTTGCGCCGCGCTCACGGCCCTGCAGAACTATC
TCACCGAGGCGCTCAAAGGCATGGACAAGATGTTCTTGAACAACACCACCACTAACAGGCACACGTCTGG
GGAAGGCCCAGGTAGTAAAACTGGCGACAAGGAGGAGAAACACAGGAAATGAAAAATTTTT
```

FIGURE 47
SEQ ID NO: 39
Genbank ID        : NM_001255.1
Unigene ID(#167)  : Hs.82906
Unigene name      :    CDC20   cell   division   cycle   20   homolog   (S.
cerevisiae) CDC20
>gi|4557436|ref|NM_001255.1|  Homo  sapiens  CDC20  cell  division  cycle  20
homolog
(S. cerevisiae) (CDC20), mRNA
```
CCACGCGTCCGGGCGTAAGCCAGGCGTGTTAAAGCCGGTCGGAACTGCTCCGGAGGGCACGGGCTCCGTA
GGCACCAACTGCAAGGACCCCTCCCCCTGCGGGCGCTCCCATGGCACAGTTCGCGTTCGAGAGTGACCTG
CACTCGCTGCTTCAGCTGGATGCACCCATCCCCAATGCACCCCCTGCGCGCTGGCAGCGCAAAGCCAAGG
AAGCCGCAGGCCCGGCCCCCTCACCCATGCGGACGATCCCCACAGCGCCGGCAGGACTCCGGG
CCGAACTCCTGGCAAATCCAGTTCCAAGGTTCAGACCACTCCTAGCAAACCTGGCGGTGACCGCTATATC
CCCCATCGCAGTGCTGCCCAGATGGAGGTGGCCAGCTTCCTCCTGAGCAAGGAGAACCAGTCTGAAAACA
GCCAGACGCCCACCAAGAAGGAACATCAGAAAGCCTGGGCTTTGAACCTGAACGGTTTTGATGTAGAGGA
AGCCAAGATCCTTCGGCTCAGTGGAAAACCACAAAATGCGCCAGAGGGTTATCAGAACAGACTGAAAGTA
CTCTACAGCCAAAAGGCCACTCCTGGCTCCAGCCGGAAGACCTGCCGTTACATTCCTTCCCTGCCAGACC
GTATCCTGGATGCGCCTGAAATCCGAAATGACTATTACCTGAACCTTGTGGATTGGAGTTCTGGGAATGT
ACTGGCCGTGGCACTGGACAACAGTGTGTACCTGTGGAGTGCAAGCTCTGGTGACATCCTGCAGCTTTTG
CAAATGGAGCAGCCTGGGGAATATATATCCTCTGTGGCCTGGATCAAAGAGGGCAACTACTTGGCTGTGG
GCACCAGCAGTGCTGAGGTGCAGCTATGGGATGTGCAGCAGCAGAAACGGCTTCGAAATATGACCAGTCA
CTCTGCCCGAGTGGGCTCCCTAAGCTGGAACAGCTATATCCTGTCCAGTGGTTCACGTTCTGGCCACATC
CACCACCATGATGTTCGGGTAGCAGAACACCATTCGTGGCCACACTGAGTGGCCACAGCCAGGAAGTGTGTG
GGCTGCGCTGGGCCCCAGATGGACGACATTTGGCCAGTGGTGGTAATGATAACTTGGTCAATGTGTGGCC
TAGTGCTCCTGGAGAGGGTGGCTGGGTTCCTCTGCAGACATTCACCCAGCATCAAGGGGCTGTCAAGGCC
GTAGCATGGTGTCCCTGGCAGTCCAATGTCCTGGCAACAGGAGGGGGCACCAGTGATCGACACATTCGCA
TCTGGAATGTGTGCTCTGGGGCCTGTCTGAGTGCCGTGGATGCCCATTCCCAGGTGTGCTCCATCCTCTG
GTCTCCCCATTACAAGGAGCTCATCTCAGGCCATGGCTTTGCACAGAACCAGCTAGTTATTTGGAAGTAC
CCAACCATGGCCAAGGTGGCTGAACTCAAAGGTCACACATCCCGGGTCCTGAGTCTGACCATGAGCCCAG
ATGGGGCCACAGTGGCATCCGCAGCAGCAGATGAGACCCTGAGGCTATGGCGCTGTTTTGAGTTGGACCC
TGCGCGGCGGCGGGAGCGGGAGAAGGCCAGTGCAGCCAAAAGCAGCCTCATCCACCAAGGCATCCGCTGA
AGACCAACCCATCACCTCAGTTGTTTTTTATTTTTCTAATAAAGTCATGTCTCCCTTCATGTTTTTTTT
TTAAAA
```

FIGURE 48
SEQ ID NO: 40
Genbank ID        : AW183154
Unigene ID(#167)  : Hs.3104
Unigene name      :    kinesin family member 14    KIF14
>gi|6451630|gb|AW183154.1|AW183154   xj67b12.x1   Soares_NFL_T_GBC_S1   Homo
sapiens
cDNA clone IMAGE:2662271 3', mRNA sequence
```
TTTCTAATGCTGAAAAGATTTATTAAAGGCATTCTCTTTATAACATTTCTTGTCAGTGCACATAATTCCA
ATAGCAAATATTTTTTCACCATTCATTCAAATACAGTATCACAATGTGTTTAGTATAAATATGTATACAA
AATTTTATAAAGACACTAAAAAGTTTCTGACCAATTAAGTCATGAGTTTACAAAGCACAAACTGAAGATT
AAATACTGAATATTAAGATGAAAACTACTATACAGGTACTTTAGGAAGTTCTTCAAAGAAGTGCACCTCC
CGGGAAATCCTCATATGTACATCTACACTCCAGCAAACTGCACAGGCAAAGTGCTACTTGCCAGATTATT
GACTAATAAAAACACATATAGAGCTTCAGAAAGAATACAAGGTCAAATGCCAAAAATAAAAAAAGAAATG
AAAGCAAATGTGCTACATTGTACCATTTTAAAGAGCTTGAAAACACCACACAAGGTTCACTAATACTGTT
CTGACTGCAATGACCGTATTTACTTACAATCTCTTCCTAACAAGGAAACTATCAGATNTATTCATGGTAC
GAATG
```

FIGURE 49
SEQ ID NO: 41
Genbank ID         : AI424243
Unigene ID(#167)   : Hs.435861
Unigene name       :     signal peptide, CUB domain, EGF-like 2    SCUBE2
>gi|4270174|gb|AI424243.1|AI424243 te95c06.x1 NCI_CGAP_Pr28 Homo sapiens cDNA c
lone IMAGE:2094442 3', mRNA sequence
CAATTTACCAAAATATCTGTATTATCTATAAAAATTGAACTCTAATGAGTCACTGATACGGGAGGCAGCA
ATACCCGACTGTGCTGACATGCAGAAGGAAGACAGCTCTGTCCCACCAACCCTATAGCAGAACATTTGCA
TTGAGTGGCACGTGGGCTGAGTCATTTGTAAGGTCTCAAAAACCTGGACACTTTGGAACGTAGCAATCGG
ATGAACGATCTTGGAAACATCTCTCGGGACTCCTGGGCTGTGTACTTGAAATAGTTCTGGGGATGGGCCA
GGACATCAAACAGAGCCTTGATAAGTTTCTTATCCTTAAGTATTTCCTGATGGTTCTCAGATGCATAGAG
CCTGCCATCTCGAACTATGTCTTCAATGAGNTTCCTGTAGTCCTCATCATATGTCACGTATGGGACCTGG
AACCCTCTAGCGCTGTTCCCTTCATTGGACTTGAACTGAATCCACAGCTTCTTTGACC

FIGURE 50
SEQ ID NO: 42
Genbank ID         : NM_006143.1
Unigene ID(#167)   : Hs.92458
Unigene name       :     G protein-coupled receptor 19 GPR19
>gi|5453665|ref|NM_006143.1| Homo sapiens G protein-coupled receptor 19 (GPR19)
, mRNA
AATTAAGAGAAAAAAAGTGAATATGGTTTTTGCTCACAGAATGGATAACAGCAAGCCACATTTGATTATT
CCTACACTTCTGGTGCCCCTCCAAAACCGCAGCTGCACTGAAACAGCCACACCTCTGCCAAGCCAATACC
TGATGGAATTAAGTGAGGAGCACAGTTGGATGAGCAACCAAACAGACCTTCACTATGTGCTGAAACCCGG
GGAAGTGGCCACAGCCAGCATCTTCTTTGGGATTCTGTGGTTGTTTTCTATCTTCGGCAATTCCCTGGTT
TGTTTGGTCATCCATAGGAGTAGGAGGACTCAGTCTACCACCAACTACTTTGTGGTCTCCATGGCATGTG
CTGACCTTCTCATCAGCGTTGCCAGCACGCCTTTCGTCCTGCTCCAGTTCACCACTGGAAGGTGGACGCT
GGGTAGTGCAACGTGCAAGGTTGTGCGATATTTTCAATATCTCACTCCAGGTGTCCAGATCTACGTTCTC
CTCTCCATCTGCATAGACCGGTTCTACACCATCGTCTATCCTCTGAGCTTCAAGGTGTCCAGAGAAAAAG
CCAAGAAAATGATTGCGGCATCGTGGATCTTTGATGCAGGCTTTGTGACCCCTGTGCTCTTTTTCTATGG
CTCCAACTGGGACAGTCATTGTAACTATTTCCTCCCCTCCTCTTGGGAAGGCACTGCCTACACTGTCATC
CACTTCTTGGTGGGCTTTGTGATTCCATCTGTCCTCATAATTTTATTTTACCAAAAGGTCATAAAATATA
TTTGGAGAATAGGCACAGATGGCCGAACGGTGAGGAGGACAATGAACATTGTCCCTCGGACAAAAGTGAA
AACTATCAAGATGTTCCTCATTTTAAATCTGTTGTTTTGCTCTCCTGGCTGCCTTTTCATGTAGCTCAG
CTATGGCACCCCATGAACAAGACTATAAGAAAAGTTCCCTTGTTTTCACAGCTATCACATGGATATCCT
TTAGTTCTTCAGCCTCTAAACCTACTCTGTATTCAATTTATAATGCCAATTTTCGGAGAGGGATGAAAGA
GACTTTTTGCATGTCCTCTATGAAATGTTACCGAAGCAATGCCTATACTATCACAACAAGTTCAAGGATG
GCCAAAAAAACTACGTTGGCATTTCAGAAATCCCTTCCATGGCCAAAACTATTACCAAAGACTCGATCT
ATGACTCATTTGACAGAGAAGCCAAGGAAAAAAAAGCTTGCTTGGCCCATTAACTCAAATCCACCAAATAC
TTTTGTCTAAGTTCTCATTCTTTCAATTGTTATGCACCAGAGATTAAAAAGCTTTAACTATAAAAACAGA
AGCTATTTACATATTTGTTTTCACTCAACTTTCCAAGGGAAATGTTTTATTTTGTAAAATGCATTCATTT
GTTTACTGT

FIGURE 51
SEQ ID NO: 43
Genbank ID         : NM_017422.2
Unigene ID(#167)   : Hs.180142
Unigene name       :     calmodulin-like 5 CALML5
>gi|13699870|ref|NM_017422.2| Homo sapiens calmodulin-like skin protein (CLSP),
mRNA
CCCGGATCCCTGCGGCTGCCTGCACTCTGGACCACGAGCTCTGAGAGCAGCAGGTTGAGGGCCGGTGGGC
AGCAGCTCGGAGGCTCCGCGAGGTGCAGGAGACGCAGGCATGGCCGGTGAGCTGACTCCTGAGGAGGAGG FIGURE 51 cont'd CCCAGTACAAAAAGGCTTTCTCCGCGGTTGACACGGATGGAAACGGCACCATCAATGCCCAGGAGCTGGG
CGCGGCGCTGAAGGCCACGGGCAAGAACCTCTCGGAGGCCCAGCTAAGGAAACTCATCTCCGAGGTTGAC
AGCGACGGCGACGGCGAAATCAGCTTCCAGGAGTTCCTGACGGCGGCAAGGAAGGCCAGGGCCGGCCTGG
AGGACCTGCAGGTCGCCTTCCGCGCCTTCGACCAGGATGGCGACGGCCACATCACCGTGGACGAGCTCAG
GCGGGCCATGGCGGGGCTGGGGCAGCCGCTGCCGCAGGAGGAGCTGGACGCCATGATCCGCGAGGCCGAC
GTGGACCAGGACGGGCGGGTGAACTACGAGGAGTTCGCGAGGATGCTCGCCCAGGAGTGAGGCTCCCCGC
CTGTGTCCCCCTGGCTGCGCTCTGAGCCTTCAGGGCCACCGCCCGCTGCTGCTTTTGTGCTGGGACTCTC
CGGGGAAACCTGGTCGGTGGATGGGAAACTGCCTCCCCCTGGGAGGAAGGCTTTGCGCTCCGGGGCCTGG
ATGCGGCGCCCTCGGGCCGCCTGCGAGCCCCTCTCTGCCTTCAGACCTTGGGCAGAAGGAGGCCTCCTTG
GGCCTGGTCCCCCTTTGCCCTGCAGTGGAATGAGGGCCCCTTAACCCCGCATTGATCTAAATAAAGGACT
GCCGAGTTCCAAAA

FIGURE 52
SEQ ID NO: 44
Genbank ID        : NM_000156.3
Unigene ID(#167)  : Hs.81131
Unigene name      :       guanidinoacetate N-methyltransferase      GAMT
>gi|7549759|ref|NM_000156.3|    Homo    sapiens    guanidinoacetate    N-methyltransferase
(GAMT), mRNA
GGGCGGCGCGCGATCGAGGTCGGGTCGCCGTCCAGCCTGCAGCATGAGCGCCCCCAGCGCGACCCCCATC
TTCGCGCCCGGCGAGAACTGCAGCCCCGCGTGGGGGCGGCGCCCGCGGCCTACGACGCAGCGGACACGC
ACCTGCGCATCCTGGGCAAGCCGGTGATGGAGCGCTGGGAGACCCCCTATATGCACGCGCTGGCCGCCGC
CGCCTCCTCCAAAGGGGGCCGGGTCCTGGAGGTGGGCTTTGGCATGGCCATCGCAGCGTCAAAGGTGCAG
GAGGCGCCCATTGATGAGCATTGGATCATCGAGTGCAATGACGGCGTCTTCCAGCGGCTCCGGGACTGGG
CCCCACGGCAGACACACAAGGTCATCCCCTTGAAAGGCCTGTGGGAGGATGTGGCACCCACCCTGCCTCA
CGGTCACTTTGATGGGATCCTGTACGACACGTACCCACTCTCGGAGGAGACCTGGCACACACACCAGTTC
AACTTCATCAAGAACCACGCCTTTCGCCTGCTGAAGCCGGGGGGCGTCCTCACCTACTGCAACCTCACCT
CCTGGGGGAGCTGATGAAGTCCAAGTACTCAGACATCACCATCATGTTTGAGGAGACGCAGGTGCCCGC
GCTGCTGGAGGCCGGCTTCCGGAGGGAGAACATCCGTACGGAGGTGATGGCGCTGGTCCCACCGGCCGAC
TGCCGCTACTACGCCTTCCCACAGATGATCACGCCCCTGGTGACCAAAGGCTGAGCCCCCACCCCGGCCC
GGCCACACCCATGCCCTCCTCCGTGCCTTCCTGGCCGGGAGTCCAGGGTGTCGCACCAGCCCTGGGCTGA
TCCCAGCTGTGTGTCACCAGAAGCTTTCCCGGCTTCTCTGTGAGGGGTCCCACCAGCCCAGGGCTGATCC
CAGCTGTGTGTCACCAGCAGCTTTCCCAGCTTCTCTGTGAGGGTCACTGCTGCCCACTGCAGGGTCCCTG
AGGTGAAGTAAACGCCGGCGCTGCGCTTGGCCAGTCGGCAGTGA

FIGURE 53
SEQ ID NO: 45
Genbank ID        : NM_006739.1
Unigene ID(#167)  : Hs.77171
Unigene name      :      MCM5 minichromosome maintenance deficient 5, cell
division cycle 46 (S. cerevisiae)   MCM5
>gi|6981191|ref|NM_006739.1|  Homo  sapiens  MCM5  minichromosome  maintenance defic
ient 5, cell division cycle 46 (S. cerevisiae) (MCM5), mRNA
TTTTCCCGCGAAACTCGGCGGCTGAGCGTGGAGGTTCTTGTCTCCCCTGGTTTGTGAAGTGCGGAAAACC
AGAGGCGCAGTCATGTCGGGATTCGACGATCCTGGCATTTTCTACAGCGACAGCTTCGGGGGCGACGCCC
AGGCCGACGAGGGGCAGGCCCGCAAATCGCAGCTGCAGAGGCGCTTCAAGGAGTTCCTGCGGCAGTACCG
AGTGGGCACCGACCGCACGGGCTTCACCTTCAAATACAGGGATGAACTCAAGCGGCATTACAACCTGGGG
GAGTACTGGATTGAGGTGGAGATGGAGGATCTGGCCAGCTTTGATGAGGACCTGGCCGACTACTTGTACA
AGCAGCCAGCCGAGCACCTGCAGCTGCTGGAGGAAGCTGCCAAGGAGGTAGCTGATGAGGTGACCCGGCC
CCGGCCTTCTGGGGAGGAGGTGCTCCAGGACATCCAGGTCATGCTCAAGTCGGACGCCAGCCCTTCCAGC
ATTCGTAGCCTGAAGTCGGACATGATGTCACACCTGGTGAAGATCCCTGGCATCATCATCGCGGCCTCTG
CGGTCCGTGCCAAGGCCACCCGCATCTCTATCCAGTGCCGCAGCTGCCGCAACACCCTCACCAACATTGC
CATGCGCCCTGGCCTCGAGGGCTATGCCCTGCCCAGGAAGTGCAACACAGATCAGGCTGGACGCCCCAAA
TGCCCATTGGACCCGTACTTCATCATGCCCGACAAATGCAAATGCGTGGACTTCCAGACCCTGAAGCTGC
AGGAGCTGCCTGATGCAGTCCCCCACGGGGAGATGCCCAGACACATGCAGCTCTACTGCGACAGGTACCT
GTGTGACAAGGTCGTCCCTGGGAACAGGGTTACCATCATGGGCATCTACTCCATCAAGAAGTTTGGCCTG FIGURE 53 cont'd ACTACCAGCAGGGGCCGTGACAGGGTGGGCGTGGGCATCCGAAGCTCCTACATCCGTGTCCTGGGCATCC
AGGTGGACACAGATGGCTCTGGCCGCAGCTTTGCTGGGGCCGTGAGCCCCCAGGAGGAGGAGGAGTTCCG
TCGCCTGGCTGCCCTCCCAAATGTCTATGAGGTCATCTCCAAGAGCATCGCCCCCTCCATCTTTGGGGGC
ACAGACATGAAGAAGGCCATTGCCTGCCTGCTCTTTGGGGGCTCCCGAAAGAGGCTCCCTGATGGACTTA
CTCGCCGAGGAGACATCAACCTGCTGATGCTAGGGGACCCTGGGACAGCCAAGTCCCAGCTTCTGAAGTT
TGTGGAGAAGTGTTCTCCCATTGGGGTATACACGTCTGGGAAAGGCAGCAGCGCAGCTGGACTGACAGCC
TCGGTGATGAGGGACCCTTCGTCCCGGAATTTCATCATGGAGGGCGGAGCCATGGTCCTGGCCGATGGTG
GGGTCGTCTGTATTGACGAGTTTGACAAGATGCGAGAAGATGACCGTGTGGCAATCCACGAAGCCATGGA
GCAGCAGACCATCTCTATCGCCAAGGCTGGGATCACCACCACCCTGAACTCCCGCTGCTCCGTCCTGGCT
GCTGCCAACTCAGTGTTCGGCCGCTGGGATGAGACGAAGGGGGAGGACAACATTGACTTCATGCCCACCA
TCTTGTCGCGCTTCGACATGATCTTCATCGTCAAGGATGAGCACAATGAGGTGAGGGATGTGATGCTGGC
CAAGCATGTCATCACTCTGCACGTGAGTGCACTGACACAGACACAGGCTGTGGAGGGCGAGATTGACCTG
GCCAAGCTGAAGAAGTTTATTGCCTACTGCCGAGTGAAGTGTGGCCCCCGGCTGTCAGCAGAGGCTGCAG
AGAAACTGAAGAACCGCTACATCATCATGCGGACGGGGCCCGTCAGCACGAGAGGGACAGTGACCGCGTC
CAGCATCCCCATCACTGTGCGGCAGTTGGAGGCCATTGTGCGCATCGCGGAAGCCCTCAGCAAGATGAAG
CTGCAGCCCTTCGCCACAGAGGCAGATGTGGAGGAGGCCCTGCGGCTCTTCCAAGTGTCCACGTTGGATG
CTGCCTTGTCCGGTACCCTGTCAGGGGTGGAGGGCTTCACCAGCCAGGAGGACCAGGAGATGCTGAGCCG
CATCGAGAAGCAGCTCAAGCGCCGCTTTGCCATTGGCTCCCAGGTGTCTGAGCACAGCATCATCAAGGAC
TTCACCAAGCAGAAATACCCGGAGCACGCCATCCACAAGGTGCTGCAGCTCATGCTGCGGCGCGGCGAGA
TCCAGCATCGCATGCAGCGCAAGGTTCTCTACCGCCTCAAGTGAGTCGCGCCGCTCACTGGACTCATGGA
CTCGCCACGCTCGCCCTCCTTGCCGCTGCCTGCCATTGACAATGTTGCTGGGACCTCTGCCTCCCCACTG
CAGCCCTCGAACTTCCCAGGCACCCTCCTTTCTGCCCCAGAGGAAGGAGCTGTAGTGTCCTGCTGCCTCT
GGGCGCCCGCTCTAGCGGGTTCTGGGAAGTGTGCTTTTGGCATCCGTTAATAATAAAGCCACGGTGTGTT
CAGGT

FIGURE 54
SEQ ID NO: 46
Genbank ID        : AF237813.1
Unigene ID(#167)  : Hs.1588
Unigene name      :        4-aminobutyrate aminotransferase    ABAT
>gi|9963907|gb|AF237813.1|AF237813 Homo sapiens NPD009 mRNA, complete cds
CACGAGGGTGAATTCTGCCCTGGACAGGGCTTTGCCCTTGGAGGATCCCCAGGTGGCCTTACCCGTGATT
CTTACTCGGCATCCTCCATTCCCCAAACTCCCTCCTCCCTGTTAAATGTCAACCTAGACCTGGACCTGGG
TGGGAGGAAACTGTAGCCTGAGTGTCCACAGGGACACACGTGAGCCACAGGGCTAGAAGCACAGGCCCGT
CACCCCAGGAGGAAAAGCCCAGGGTCTGGGGCAGCAGAGCCATCGCATCATGTTCCAGGGCAACTTGA
GGTCTGACTTTTGGCTCCCTCGCCCTAAGAGGCTCTTCCTCTCTTTTGCTCATCCACCTTCACACCACTT
GTGAGCTGACCCCCAGGAACAGCTTGGCTGTTCCACCAGAGCAGAGGGAATCATTGCTGGACTGGATTTC
TTCTGGAGGGAAGCACCATGAATTAAAGGTGCCAGAGCTCCATGCATGGAAAAGTGGCCTGTTGGTTCAA
CGTGGTTTCCTTGTACTTGATCCTCCTGAAATGAGAGATTTTCCTGAGATGACTGAGTATGGAGATTACC
AGGCAGATGATACCGAAATGCTTAAAGGGGCTGTGGCTGAGGCTGTAGCATCTCTGCTGGAGGTGAGACA
CTCTGGGAACTGATTTGACCTCGAATGCTCCTAAAAGAGAACTTGATAGCCTGACAGCAGAGAAGTATTA
TTTGGTGGGGAGTCTGAGAAAGCCTGGCTTGTATTATCTGTCCAAAAGGAAGCCTCTTCATCTCCTGGTG
CCTTGGTTGACTATTTTGGAAATAGGCATATCAAGGTTCCTGATTCAGCACTTTGCTCTTTTAATAACAA
ATCGTCCAAAGATCTCAAAGTAAGGGTTTTTTTTTTAGCTTCCACTCTTCCGCAGACTTGGTCATCGAC
CTATTTTTGTTGAAGAATGAAAGGCAATGACAAGTTTAACATATACAAATTCGTGAATTCTTGTTCATTT
TGCATTCCTGCAGTCAGTGCTAATCCGTCGTTCTTAATCAGGAGTTCTGCCAGGTTTAAGGTCACCTGCA
CTCCCAGCCAAGTGGTGATGTATGCCTCCCACTCTCTGCAAGGTTTTCCTCATTTTTATATTCATTTATT
CATCATTCATTCATTCACCTAACTTTCATTAAATAGCTGCACCATCCCAGGCCCTGTGCGGATCGGGAAT
ACAAAGATGAGATAAAACATTGTCCCTGCCCCCGGGGCTTCACATGCCACTGGAAACAACAGACTCTTA
AACTAACAATTCAAGCAGGCGCCAAGTGCTACGACAGAGGTGTGAATAAAAGCATCAGGAAATCGGATGG
AGAACCACCATTCACCCAAGGGTCAGAGGAGGTTTCAAAGAAAAGGTGTCATTGGAGCAGTGTTTTGCAG
AATGAGCCAGAGTTCACCAAGCAGGCAAGGCAAGGAAGGGTGTTGCAGAGAGGGAACAGCATATGCAAAG
GCATATCAGTTCATGGCATCACATCTTTCACTGGGGAAGCCAGTTTCCACAGGCAGCATCCCAAGGTTCA
ATAAGGCCTTATTTAACAAGCAAGCAAAATGCAAACCAAACCATTATTCATTTATTGGCTTAAGTATGCT
TTCTCCTGAAAACTTTAGCATTGGGTGCAAATATTCAGTATGGTTCTCGGAGTCCAAAGGGTTTTAAGCC
AGGGCACAACCAGAAAAGTGGCTCTCTTTGGTAGGGAGAGGGGCTCCAATATTTCGTTCTCTCCCCATGG
GGCACTGACAGAGAAATGAAATAGTTTTATCTGGAAAATTCCAGAGCTATTATTTACTCCTTACCAAGGG
AAGTTACTTCTTGTAAAAACTTTTAAGCCATTTATCAACAAGTTCTTGTTGACTCAGGGCATAATGAGTT
CCTGAGACATGCTCTTTTGGGGCTGGGCTTTAGGTAGAAGAATTTCAAGGAAAAGAATTCTCAGCAGA
GCTCAAGATTGTAGAAACTCAGCAGAAGCTGGTAAAAACATGGGGAGCCCGGAGGACAGGCTGCTGTCCA FIGURE 54 cont'd GGGCAGAGGCCATGAAGAAGTGCTTCCGTGGCCGACAGTCTGGAAATGAATCCATCATACATTAGTGCCA
TAGAGTTTAGTAACCGTCCAGCAAGTGTCATCACTTTTACAGAAAACAAGGTCCAGTAATAGCAAGTCTT
AGTACATCCTCACTTTTATTATAAATGGGTGTTTTTTCATAATTTTTACTGACGCTCAGTAACCATGCAA
AATTGTGTATAGCATTAATGTATCTACATACCTACACCTATCTATATATAAGCTCATGGTAGAAAACCAT
AGCTAAGTAGCATCGCAGACTTAAGCGTACAAAGTGATCTTGTTCACAAGTAATCTGTTGACAGTGCCAA
TAAATGATAAAAAAAAAATTAACATGTCACAATGTAACGGATGACCATATGCACAATTCCATGAATTAAA
TCTGTTTCCTGTGTTAGTCAGTATTCTTAAATAAAATTTATAATTGAAAAAAAAAAAAAAAAAA FIGURE 55
SEQ ID NO: 47
Genbank ID      : AA876372
Unigene ID(#167) : Hs.432978
Unigene name    :    solute    carrier    family    7    (cationic    amino    acid
transporter, y+ system), member 2   SLC7A2
>gi|2985449|gb|AA876372.1|AA876372   oj24d06.s1   NCI_CGAP_Kid5   Homo   sapiens
cDNA c
lone IMAGE:1493099 3', mRNA sequence
TTTTACAGTGGTAAAGCAGCAGTTTTTATTTATTACAAATTCTAAAAAAGAATCCAACTTTATAAGTAAA
AAGGAACACTGATGATCACTTAAAACATTTAAATTTAAAATTACTACTAAAAAAACCCTGTACATTCACA
CAAGTCCAATGCCTTTGTTGGTTTTTACAGACATAGAATTTCTGTAGGGTTTTGGGCCCTATCAACAATT
TTTATTAAGTACTGCAATAACAAAATACAGCAATAAAACAACTGGACACTCCTAGGGGACACCAAAGATA
AAGGGCCCATTAATCAGGTGTAGGCCAGAGAAACCCAACCTGTTGGCAATATGACGCTCTTTCCCAACTG
GGTCTTGGTGAGACACGTGGCACAGCAAGGCTGTCAGTGCATGTGCATAAATTGTAGACCAGGTCCCACT
ATGCTACTTCAGGATTCAGCCAGCCCTTCTATGAGTCACAGAGGTCCCTTGGTCGTTATTCATCTTGATA
TACTCATGGGATGTTTGGAATTAAGGAGCCCAACTACCTTACTTGCATTTGAAGTCTTTCACTTCATATC
CTACCCCTCAGTCTAAGAGCCCACCAACAAGGGTAGCTACACCTAGATGCTCACATCTATAGGCTGCCTG
AATCCTGGACCAGCTCGGGCCCTGATATGAT FIGURE 56
SEQ ID NO: 48
Genbank ID      : NM_003579.1
Unigene ID(#167) : Hs.66718
Unigene name    :       RAD54-like (S. cerevisiae)      RAD54L
>gi|4506396|ref|NM_003579.1|   Homo   sapiens   RAD54-like   (S.   cerevisiae)
(RAD54L),
mRNA
GAATTCGGGCAGATTAGACCCTGGTCCTACACTCTTAGCCGCTGCCTGCTTTTGACCTTTGGCTCATGGG
TACTTGACGTTTTAAACTCCTAGGCCCAGGATGAGGAGGAGCTTGGCTCCCAGCCAGCTGGCCAAGAGAA
AACCTGAAGGCAGGTCCTGTGATGATGAAGACTGGCAACCTGGCCTAGTGACTCCTAGGAAACGGAAATC
CAGCAGTGAGACCCAGATCCAGGAGTGTTTCCTGTCTCCTTTTCGGAAACCTTTGAGTCAGCTAACCAAT
CAACCACCTTGTCTGGACAGCAGTCAGCATGAAGCATTTATTCGAAGCATTTTGTCAAAGCCTTTCAAAG
TCCCCATTCCAAATTATCAAGGTCCTCTGGGCTCTCGAGCATTGGGCCTGAAAAGGGCTGGGGTCCGCCG
GGCCCTCCATGACCCCCTGGAAAAAGATGCCTTGGTTCTGTATGAGCCTCCCCCGCTGAGCGCTCATGAC
CAGCTGAAGCTTGACAAGGAGAAACTCCCTGTCCATGTGGTTGTTGACCCTATTCTCAGTAAGGTTTTGC
GGCCTCATCAGAGAGAGGGAGTGAAATTCCTGTGGGAGTGTGTCACCAGTCGGCGCATCCCTGGCAGCCA
TGGCTGCATCATGGCTGATGAGATGGGCCTAGGAAAGACGCTGCAGTGCATCACATTGATGTGGACACTT
TTACGCCAGAGTCCAGAGTGCAAGCCAGAAATTGACAAGGCAGTGGTGGTGTCGCCTTCCAGCCTGGTGA
AGAACTGGTACAATGAGGTTGGGAAATGGCTCGAGGGAGGATCCAACCTCTGGCCATCGATGGAGGATC
TAAGGATGAAATAGACCAAAAGCTGGAAGGATTCATGAACCAGCGTGGAGCCAGGGTGTCTTCTCCCATC
CTCATCATTTCCTATGAGACCTTCCGCCTTCATGTTGGAGTCCTCCAGAAAGGAAGTGTTGGTCTGGTCA
TATGTGACGAGGGACACAGGCTCAAGAACTCTGAGAATCAGACTTACCAAGCCCTGGACAGCTTGAACAC
CAGCCGGCGGGTGCTCATCTCCGGAACTCCCATCCAGAATGATCTGCTTGAGTATTTCAGCTTGGTACAT
TTTGTTAATTCCGGCATCCTAGGGACTGCCCATGAATTCAAGAAGCATTTTGAATTGCCAATTTTGAAGG
GTCGAGACGCTGCTGCTAGTGAGGCAGACAGGCAGCTAGGAGAGGAGCGGCTGCGGGAGCTCACCAGCAT
TGTGAATAGATGCCTGATACGGAGGACTTCTGATATCCTTTCTAAATATCTGCCTGTGAAGATTGAGCAG
GTCGTTTGTTGTAGGCTGACACCCCTTCAGACTGAGTTATACAAGAGGTTTCTGAGACAAGCCAAACCGG
CAGAAGAATTGCTTGAGGGCAAGATGAGTGTGTCTTCCCTTTCTTCCATCACCTCGCTAAAGAAGCTTTG
TAATCATCCAGCTCTAATCTATGATAAGTGTGTGGAAGAGGAGGATGGCTTTGTGGGTGCCTTGGACCTC

FIGURE 56 cont'd

```
TTCCCTCCTGGTTACAGCTCTAAGGCCCTGGAGCCCCAGCTGTCAGGTAAGATGCTGGTCCTGGATTATA
TTCTGGCGGTGACCCGAAGCCGTAGCAGTGACAAAGTAGTGCTGGTGTCGAATTACACCCAGACTTTGGA
TCTCTTTGAGAAGCTGTGCCGTGCCCGAAGGTACTTATACGTCCGCCTGGATGGCACGATGTCCATTAAG
AAGCGAGCCAAGGTTGTAGAACGCTTCAATAGTCCATCGAGCCCTGACTTTGTCTTCATGCTGAGCAGCA
AAGCTGGGGGCTGTGGCCTCAATCTCATTGGGGCTAACCTGCTGGTCATGTTTGACCCTGACTGGAACCC
AGCCAATGATGAACAAGCCATGGCCCGGGTCTGGCGAGATGGTCAAAAGAAGACTTGCTATATCTACCGC
CTGCTGTCTGCAGGGACCATTGAGGAGAAGATCTTCCAGCGTCAGAGCCACAAGAAGGCACTGAGCAGCT
GTGTGGTGGATGAGGAGCAGGATGTAGAGCGCCACTTCTCTCTGGGCGAGTTGAAGGAGCTGTTTATCCT
GGATGAAGCTAGCCTCAGTGACACACATGACAGGTTGCACTGCCGACGTTGTGTCAACAGCCGTCAGATC
CGGCCACCCCCTGATGGTTCTGACTGCACTTCAGACCTGGCAGGGTGGAACCACTGCACTGATAAGTGGG
GGCTCCGGGATGAGGTACTCCAGGCTGCCTGGGATGCTGCCTCCACTGCTATCACCTTCGTCTTCCACCA
GCATTCTCATGAGGAACAGCGGGGCCTCCGCTGATAACCAGCTGGTCTGGGTGTAGCTCTTAGAGGAAGG
AGATAGGGAAAAGGGGCTCCTTGCTCCACAGGGCCCTGTTGAATTTTGTTCTCTGGGAGAAAATCATCAA
GAAGGGCTGCATGATGTTTGCCCAAAATTTATTTTATAAGAAAAACTTTTTTGGTTAAAAAAAAGAATAA
AGGTATGAAAGGGCTGGTGACAGTCAGGGATGCCCCCGGCACACAGGGACTAGGTCTAGTGAGAACATCA
GGAGCAGCCAGGGATCC
```

FIGURE 57
SEQ ID NO: 49
Genbank ID            : AY029179.1
Unigene ID(#167)      : Hs.435733
Unigene name          :         cell  division  cycle  associated  7     CDCA7
>gi|13641303|gb|AY029179.1|  Homo  sapiens  c-Myc  target  JP01  (JP01)  mRNA,
complet
e cds

```
CCCGAGCCCCGCCCCTCCGGGCCCGGGTCGGCGCGCCCAGCCTGCCAGCCGCGCTGCTGCTCCTCCT
GCTGTGGGACCGCTGACCGCGCGGCTGCTCCGCTCTCCCGCTCCAAGCGCCGATCTGGGCACCCGCCAC
CAGCATGGACGCTCGCCGCGTGCCGCAGAAGATCTCAGAGTAAAGAAGAACTTAAAGAAATTCAGATAT
GTGAAGTTGATTTCCATGGAAACCTCGTCATCCTCTGATGACAGTTGTGACAGCTTTGCTTCTGATAATT
TTGCAAACACGAGGCTGCAGTCAGTTCGGGAAGGCTGTAGGACCCGCAGCCAGTGCAGGCACTCTGGACC
TCTCAGGGTGGCGATGAAGTTTCCAGCGCGGAGTACCAGGGGAGCAACCAACAAAAAGCAGAGTCCCGC
CAGCCCTCAGAGAATTCTGTGACTGATTCCAACTCCGATTCAGAAGATGAAAGTGGAATGAATTTTTTGG
AGAAAAGGGCTTTAAATATAAAGCAAAACAAAGCAATGCTTGCAAAACTCATGTCTGAATTAGAAAGCTT
CCCTGGCTCGTTCCGTGGAAGACATCCCCTCCCAGGCTCCGACTCACAATCAAGGAGACCGCGAAGGCGT
ACATTCCCGGGTGTTGCTTCCAGGAGAAACCCTGAACCGAGAGCTCGTCCTCTTACCAGGTCAAGGTCCC
GGATCCTCGGGTCCCTTGACGCTCTACCCATGGAGGAGGAGGAGGAAGAGGATAAGTACATGTTGGTGAG
AAAGAGGAAGACCGTGGATGGCTACATGAATGAAGATGACCTGCCCAGAAGCCGTCGCTCCAGATCATCC
GTGACCCTTCCGCATATAATTCGCCCAGTGGAAGAAATTACAGAGGAGGAGTTGGAGAACGTCTGCAGCA
ATTCTCGAGAGAAGATATATAACCGTTCACTGGGCTCTACTTGTCATCAATGCCGTCAGAAGACTATTGA
TACCAAAACAAACTGCAGAAACCCAGACTGCTGGGGCGTTCGAGGCCAGTTCTGTGGCCCCTGCCTTCGA
AACCGTTATGGTGAAGAGGTCAGGGATGCTCTGCTGGATCCGAACTGGCATTGCCCGCCTTGTCGAGGAA
TCTGCAACTGCAGTTTCTGCCGGCAGCGAGATGGACGGTGTGCGACTGGGGTCCTTGTGTATTTAGCCAA
ATATCATGGCTTTGGGAATGTGCATGCCTACTTGAAAAGCCTGAAACAGGAATTTGAAATGCAAGCATAA
TATCTGGAAAATTTGCTGCCTGCCTTCTACTTCTCAAATCTTTCTTGTAAAAGTTTCCAATTTTTTCACT
GAAACCTGAGTTAAAAATCTTGATGATCAGCCTGTTTCATAAGAAACTCCAATCAAGTTAATCTTAGCAG
ACATGTGTTTCTGGAGCATCACAGAAGGTATATTGCTAGTTACACTTTGCCCTCCTGCAGTTTCTTCTCT
GCTCCCAACCCCCATCTCATAGCATCCCCCTCTATTTCCAATGCTCCTCTCCAACCGCTTAGTTTCTGAA
TTTCTTTTAAATTACAGTTTTATGAAAGCATATTTTATTTACTTGGTGTTGAAATAGCCCTCATAAAACC
TAAGCACTTGGAAACACAATAATAGTATTAACTAACTAGATCTATTGAATTTCAGAGAAGAGCCTTCTAA
CTTGTTTACACAAAAACGAGTATGATTTAGCACTCATACTAGTTGAAATTTTTAATAGAATCAAGGCACA
AAAGTCTTAAAACCATGTGGAAAAATTAGGTAATTATTGCAGATTGATGTCTCTCAATCCCATGTATTGC
GCTTATGTTACAAGTTGTTGTCACAGTTGAGACTTAATTTCTCCTAATTTCTTCTGCCCGAAGGGTAAGT
GGTGCGTCCAGCTTACACGATCATAATTCAAAGGTTGGTGGCAATGTAATACTTAATTAAAATAATGAT
GGAAGAGCTATCTGGAGATTATGAGTAAGCTGATTTGAATTTTCAGTATAAAACTTTAGTATAATTGTAG
TTTGCAAAGTTTATTTCAGTTCACATGTAAGGTATTGCAAATAAATTCTTGGACAATTTTGTATGGAAAC
TTGATATTAAAAACTAGTCTGTGGTTCTTTGCAGTTTCTTGTAAATTTATAAACCAGGCACAAGGTTCAA
GTTTAGATTTTAAGCACTTTTATAACAATGATAAGTGCCTTTTGGAGATGTAACTTTTAGCAGTTTGTT
AACCTGACATCTCTGCCAGTCTAGTTTCTGGGCAGGTTTCCTGTGTCAGTATTCCCCCTCCTCTTTGCAT
TAATCAAGGTATTTGGTAGAGGTGGAATCTAAGTGTTTGTATGTCCAATTTACTTGCATATGTAAACCAT
TGCTGTGCCATTCAATGTTTGATGCATAATTGGACCTTGAATCGATAAGTGTAAATACAGCTTTTGATCT
GTAATGCTTTTATACAAAAGTTTATTTTAATAATAAAATGTTTGTTCTAAAAAAAAAAAA
```

FIGURE 58
SEQ ID NO: 50
Genbank ID         : AI492388
Unigene ID(#167)   : Hs.356349
Unigene name       :   zinc finger protein 145 (Kruppel-like, expressed in promyelocytic leukemia) ZNF145
>gi|4393391|gb|AI492388.1|AI492388 ti27d10.x1 NCI_CGAP_Kid11 Homo sapiens cDNA
clone IMAGE:2131699 3', mRNA sequence
TTTTGACAACTGAATTAACTTTATTCTCTTCTAACTGCAGATTCAAGGTATACAACTGAACATTGCTATT
TTTCTTATGAGACTTATAAATAAAAATACAAAAAATGTTCACTACAAAAAAATCTACTGTTAGTAGGATG
TAAAAAATATTCTCTTTGCTATAGAAGGCACAAACTTCACTTAGTGACACATGGAGAGAGAAAAAAACCT
GCAGCAGTAAATTCATTTTTTCTTTTTTTTTCCTTTTTTTTTTTTTAAATCTTGTCAGAAACACTGAAA
TTACAAAGAAACGCGTCAATCTACACGAAACGAAGGCAGATGCGGAAAGCTGCAACCAGGACTGCACAAC
TTCGAGTGAAACTGCTTCGGAACTAGAACAGATAAGGAGCGGCAAGCACAACTCGGGGAAGTGGGCTGGG
GAGGGGGCAGCAGGAGGCAGGAGAGAGGGAGAGAGAATGGAGTGGACAGAAATGAGA

FIGURE 59
SEQ ID NO: 51
Genbank ID         : NM_002653.1
Unigene ID(#167)   : Hs.84136
Unigene name       :     paired-like   homeodomain   transcription   factor   1
      PITX1
>gi|4505824|ref|NM_002653.1|   Homo   sapiens   paired-like   homeodomain
transcription
 factor 1 (PITX1), mRNA
GGGAGGGCGGCAGTGAGGGCGCGGCGGCGGGCGGCTTGGGGCTGGATTCCGGCTCCCTCGCTCGCTCGCT
CCCTCCCGAGCCCCCTCCCACCCAGGCCCACCCCACCCAGCACCCCTGGCGCAGGGACTGCTGGAACCTG
GCTGTGCCCGTGTCGCTTTAAGACAGACTCTGCCGGCGCCGTCCGGAGCCTTAGAAACGGCCCCGGATCG
CGAGCCGGAGCCGGAGCCGGAGCCGGAGCCGGGCCGGCCGGGCTGCTGAGGCCCGAGCGGCAG
GAGCGACGCGGAGCGCTGAGCCAGGCGCCCAGTCGCGAGAAGCTGCCGCCGCCTCTGGCCGCCGCCGCAG
CCCCGGGGCGGTCCATGGGGCGGGCACCGGCCGTGCTGCAGGCTGTCGGCAGCCTGGAGGCCAGCCGCTT
AGCGTGCGCTCTTGTCCCCGCAGGTCGCAGCCAGGGCGGCGGCGCGCCCAGCCCCGGCCCCTGGAGCGC
CGCCGCGGTCCCCACCTCCATGGACGCCTTCAAGGGGGGCATGAGCCTGGAGCGGCTGCCGGAGGGGCT
CCGGCCGCCGCCGCCGCCACCCCATGACATGGGGCCCGCCTTCCACCTGGCCCGGCCCGCCGACCCCCGC
GAGCCGCTCGAGAACTCCGCCAGCGAGTCGTCTGACACGGAGCTGCCAGAGAAGGAGCGCGGCGGGGAAC
CCAAGGGGCCCGAGGACAGTGGTGCGGGAGGCACGGGCTGCGGCGGCGCAGACGACCCAGCCAAGAAGAA
GAAGCAGCGGCGGCAACGTACGCACTTCACAAGCCAGCAGTTGCAAGAGCTAGAGGCCACGTTCCAGAGG
AACCGCTACCCCGACATGAGCATGAGGGAGGAGATCGCCGTGTGGACCAACCTCACCGAGCCGCGCGTGC
GGGTCTGGTTCAAGAACCGGCGAGCCAAGTGGCGTAAGCGCGAGCGTAACCAGCAGCTGGACCTGTGCAA
GGGTGGCTACGTGCCGCAGTTCAGCGGCCTAGTGCAGCCCTACGAGGACGTGTACGCCGCCGGCTACTCC
TACAACAACTGGGCCGCCAAGAGCCTGGCGCCAGCGCCGCTCTCCACCAAGAGCTTCACCTTCTTCAACT
CCATGAGCCCGCTGTCGTCGCAGTCCATGTTCTCAGCACCCAGCTCCATCTCCTCCATGACCATGCCGTC
CAGCATGGGCCCAGGCGCCGTGCCTGGCATGCCCAACTCGGGCCTCAACAACATCAACAACCTCACCGGC
TCCTCGCTCAACTCGGCCATGTCGCCGGGCGCTTGCCCGTACGGCACTCCCGCCTCGCCCTACAGCGTCT
ACCGGGACACGTGCAACTCGAGCCTAGCCAGCCTGCGGCTCAAGTCCAAACAGCACTCGTCGTTTGGCTA
CGGCGGCCTGCAGGGCCCGGCCTCGGGCCTCAACGCGTGCCAGTACAACAGCTGAC

FIGURE 60
SEQ ID NO: 52
Genbank ID         : BG492359
Unigene ID(#167)   : Hs.35962
Unigene name       :     CDNA clone IMAGE:4448513, partial cds
>gi|13453871|gb|BG492359.1|BG492359 602536279F1 NIH_MGC_59 Homo sapiens cDNA cl
one IMAGE:4655418 5', mRNA sequence FIGURE 60 cont'd

```
GATATACGGACCGGATTGTTTTCGCTGGCCCAGTGTCCCCGGAGCTTGTGTGCGATACAGAGAGCACCTC
GGAAGCTGAGGCAGCTGGCACTTGACAGAGAGGATGGCGCTGTCGACCATAGTCTCCCAGAGGAAGCAGA
TAAAGCGGAAGGCTCCCCGTGGCTTTCTAAAGCGAGTCTTCAAGCGAAAGAAGCCTCAACTTCGTCTGGA
GAAAAGTGGTGACTTATTGGTCCATCTGAACTGTTTACTGTTTGTTCATCGATTAGCAGAAGAGTCCAGG
ACAAACGCTTGTGCGAGTAAATGTAGAGTCATTAACAAGGAGCATGTACTGGCCGCAGCAAAGGTAATTC
TAAAGAAGAGCAGAGGTTAGAAGTCAAAGAACATATTCTTGAAAGTTATGATGCATTCTTTTGGGTGGTA
ACAGATCATAAAGACATTTTTTACACATCAGTTAATATGGGATTATTACAATATTGGCTATATCAAAAGA
GAAAACAACAAAAAGCATGACGACGAACACAAACCTCTGTTGGTGGCCACGGGCTCGTGGGCCCCATGCG
AAGAAGCATTCTCTATTAGACCCACTCTGTTTGTGGGGCGCCGGGCGGCCCCATGGTTGATGTGTTAGG
TTGTCCAAAACCGCTGGTCATCAAATAAGGAGGGTTCCCCAACAGAGGAGAAACCCGGGTGGCTTCAACG
AACACAGGTTGCTCGTGGGATTTTCCCCACCCCGATAATAAGAAAACGCCGCCGGGGTGGAAACACCGA
AGATCGTTTTTGAGACAACAATACCCACGAATAGTGGGTATTACAGAGGGCACACATGAAGGGGGAATCT
TTAATCACAAGGAGTAGTTTCAAGGGCACCCTCGGGATATACCATGTACCG
```

FIGURE 61
SEQ ID NO: 53
Genbank ID        : AI638593
Unigene ID(#167)  : Hs.441708
Unigene name      :        hypothetical protein MGC45866 MGC45866
>gi|4690827|gb|AI638593.1|AI638593   tt31a01.x1   NCI_CGAP_GC6   Homo   sapiens cDNA cl
one IMAGE:2242344 3', mRNA sequence
```
TTTTTTTTTTTTGATCTTAAAAAACCATTTAATAAAAAAAAATCTTTGAAGGGACAAATGGGAAGTTTTC
ACTTAGAGTTTGATTTACAAGACAATAGGAGGAATCAGATTTGGGAACACAACAGGCTTGAACACTTTCT
GGAGACTGAGAGACAGTTCAGAGTCAGCCCTCACCGTTAGCCAGACCCCTGGCCAGGACCCGCAGCAGGC
TGGTCCAGCGGGTCTGTGGGGCACTCCTGTGGGGCACTCTTGGTGGAAACGATGAGCCAGGTGATGGTCT
CCCCAGGAGTGGGCAATGGGTGAGGCCTGAGCCCTGAACTGGCTGGCTTTTGGACAGTCGTTGAAAATGT
GGCTGCTCCAGAAGCCACTCAAGCTGGACCATGGTCACAGTTAACCTCAGGCCCAACATTAAACAAAAAT
GTACTGAGTGCTCAGTCACTAGAGATGATTTTACTGTTACACAGGGAAGGCAAAAAATAGCT
```

FIGURE 62
SEQ ID NO: 54
Genbank ID        : NM_006551.2
Unigene ID(#167)  : Hs.204096
Unigene name      :        secretoglobin, family 1D, member 2  SCGB1D2
>gi|10947028|ref|NM_006551.2|  Homo sapiens secretoglobin, family 1D, member 2 (
SCGB1D2), mRNA
```
AATTCTAGAAGTCCAAATCACTCATTGTTTGTGAAAGCTGAGCTCACAGCAAAACAAGCCACCATGAAGC
TGTCGGTGTGTCTCCTGCTGGTCACGCTGGCCCTCTGCTGCTACCAGGCCAATGCCGAGTTCTGCCCAGC
TCTTGTTTCTGAGCTGTTAGACTTCTTCATTAGTGAACCTCTGTTCAAGTTAAGTCTTGCCAAATTT
GATGCCCCTCCGGAAGCTGTTGCAGCCAAGTTAGGAGTGAAGAGATGCACGGATCAGATGTCCCTTCAGA
AACGAAGCCTCATTGCGGAAGTCCTGGTGAAAATATTGAAGAAATGTAGTGTGTGACATGTAAAAACTTT
CATCCTGGTTTCCACTGTCTTTCAATGACACCCTGATCTTCACTGCAGAATGTAAAGGTTTCAACGTCTT
GCTTTAATAAATCACTTGCTCTAC
```

FIGURE 63
SEQ ID NO: 55
Genbank ID        : NM_000612.2
Unigene ID(#167)  : Hs.349109
Unigene name      :        insulin-like   growth   factor   2   (somatomedin   A) IGF2
>gi|6453816|ref|NM_000612.2|  Homo sapiens insulin-like growth factor 2 (somatom
edin A) (IGF2), mRNA
```
TTCTCCCGCAACCTTCCCTTCGCTCCCTCCCGTCCCCCCCAGCTCCTAGCCTCCGACTCCCTCCCCCCCT
CACGCCCGCCCTCTCGCCTTCGCCGAACCAAAGTGGATTAATTACACGCTTTCTGTTTCTCTCCGTGCTG
```

FIGURE 63 cont'd

```
TTCTCTCCCGCTGTGCGCCTGCCCGCCTCTCGCTGTCCTCTCTCCCCTCGCCCTCTCTTCGGCCCCCC
CTTTCACGTTCACTCTGTCTCTCCCACTATCTCTGCCCCCTCTATCCTTGATACAACAGCTGACCTCAT
TTCCCGATACCTTTTCCCCCCCGAAAAGTACAACATCTGGCCCGCCCCCAGCCCGAAGACAGCCCGTCCTC
CCTGGACAATCAGACGAATTCTCCCCCCCCCCCCAAAAAAAAAAGCCATCCCCCCGCTCTGCCCCGTCGC
ACATTCGGCCCCCGCGACTCGGCCAGAGCGGCGCTGGCAGAGGAGTGTCCGGCAGGAGGGCCAACGCCCG
CTGTTCGGTTTGCGACACGCAGCAGGGAGGTGGGCGGCAGCGTCGCCGGCTTCCAGACACCAATGGGAAT
CCCAATGGGGAAGTCGATGCTGGTGCTTCTCACCTTCTTGGCCTTCGCCTCGTGCTGCATTGCTGCTTAC
CGCCCCAGTGAGACCCTGTGCGGCGGGGAGCTGGTGGACACCCTCCAGTTCGTCTGTGGGGACCGCGGCT
TCTACTTCAGCAGGCCCGCAAGCCGTGTGAGCCGTCGCAGCCGTGGCATCGTTGAGGAGTGCTGTTTCCG
CAGCTGTGACCTGGCCCTCCTGGAGACGTACTGTGCTACCCCCGCCAAGTCCGAGAGGGACGTGTCGACC
CCTCCGACCGTGCTTCCGGACAACTTCCCCAGATACCCCGTGGGCAAGTTCTTCAATATGACACCTGGA
AGCAGTCCACCCAGCGCCTGCGCAGGGCCTGCCTGCCCTCCTGCGTGCCCGCCGGGGTCACGTGCTCGC
CAAGGAGCTCGAGGCGTTCAGGGAGGCCAAACGTCACCGTCCCCTGATTGCTCTACCCACCCAAGACCCC
GCCCACGGGGGCGCCCCCCAGAGATGGCCAGCAATCGGAAGTGAGCAAAACTGCCGCAAGTCTGCAGCC
CGGCGCCACCATCCTGCAGCCTCCTCCTGACCACGGACGTTTCCATCAGGTTCCATCCGAAAATCTCTC
GGTTCCACGTCCCCCTGGGGCTTCTCCTGACCCAGTCCCCGTGCCCCGCCTCCCCGAAACAGGCTACTCT
CCTCGGCCCCTCCATCGGGCTGAGGAAGCACAGCAGCATCTTCAAACATGTACAAAATCGATTGGCTTT
AAACACCCTTCACATACCCTCCCCCC
```

FIGURE 64
SEQ ID NO: 58
Genbank ID : NM_002652.1
Unigene ID(#167) : Hs.99949
Unigene name : prolactin-induced protein PIP
>gi|4505820|ref|NM_002652.1| Homo sapiens prolactin-induced protein (PIP), mRNA
```
CTTCTCTGGGACACATTGCCTTCTGTTTTCTCCAGCATGCGCTTGCTCCAGCTCCTGTTCAGGGCCAGCC
CTGCCACCCTGCTCCTGGTTCTCTGCCTGCAGTTGGGGGCCAACAAAGCTCAGGACAACACTCGGAAGAT
CATAATAAAGAATTTTGACATTCCCAAGTCAGTACGTCCAAATGACGAAGTCACTGCAGTGCTTGCAGTT
CAAACAGAATTGAAAGAATGCATGGTGGTTAAAACTTACCTCATTAGCAGCATCCCTCTACAAGGTGCAT
TTAACTATAAGTATACTGCCTGCCTATGTGACGACAATCCAAAAACCTTCTACTGGGACTTTTACACCAA
CAGAACTGTGCAAATTGCAGCCGTCGTTGATGTTATTCGGGAATTAGGCATCTGCCCTGATGATGCTGCT
GTAATCCCCATCAAAAACAACCGGTTTTATACTATTGAAATCCTAAAGGTAGAATAATGGAAGCCCTGTC
TGTTTGCCACACCCAGGTGATTTCCTCTAAAGAAACTTGGCTGGAATTTCTGCTGTGGTCTATAAAATAA
ACTTCTTAACATGCTT
```

FIGURE 65
SEQ ID NO: 57
Genbank ID : NM_005823.2
Unigene ID(#167) : Hs.408488
Unigene name : mesothelin MSLN
>gi|7108357|ref|NM_005823.2| Homo sapiens mesothelin (MSLN), transcript variant
1, mRNA
```
TGGCCACTCCCGTCTGCTGTGACGCGCGGACAGAGAGCTACCGGTGGACCCACGGTGCCTCCCTCCCTGG
GATCTACACAGACCATGGCCTTGCCAACGGCTCGACCCCTGTTGGGGTCCTGTGGGACCCCCGCCCTCGG
CAGCCTCCTGTTCCTGCTCTTCAGCCTCGGATGGGTGCAGCCCTCGAGGACCCTGGCTGGAGAGACAGGG
CAGGAGGCTGCACCCCTGGACGGAGTCCTGGCCAACCCACCTAACATTTCCAGCCTCTCCCCTCGCCAAC
TCCTTGGCTTCCCGTGTGCGGAGGTGTCCGGCCTGAGCACGGACGGTGTCCGGGAGCTGGCTGTGGCCTT
GGCACAGAAGAATGTCAAGCTCTCAACAGAGCAGCTGCGCTGTCTGGCTCACCGGCTCTCTGAGCCCCCC
GAGGACCTGGACGCCCTCCCATTGGACCTGCTGCTATTCCTCAACCCAGATGCGTTCTCGGGGCCCCAGG
CCTGCACCCGTTTCTTCTCCCGCATCACGAAGGCCAATGTGGACCTGCTCCCGAGGGGGGCTCCCGAGCG
ACAGCGGCTGCTGCCTGCGGCTCTGGCCTGCTGGGTGTGCGGGGTCTCTGCTGAGCGAGGCTGATGTG
CGGGCTCTGGGAGGCCTGGCTTGCGACCTGCCTGGGCGCTTTGTGGCCGAGTCGGCCGAAGTGCTGCTAC
CCCGGCTGGTGAGCTGCCCGGGACCCCTGGACCAGGACCAGCAGGAGGCAGCCAGGCGGCTCTGCAGGG
CGGGGGACCCCCCTACGGCCCCCCGTCGACATGGTCTGTCTCCACGATGGACGCTCTGCGGGCCTGCTG
CCCGTGCTGGGCCAGCCCATCATCCGCAGCATCCCGCAGGGCATCGTGGCCGCGTGGCGGCAACGCTCCT
CTCGGGACCCATCCTGGCGGCAGCCTGAACGGACCATCCTCCGGCCGCGGTTCCGGCGGGAAGTGGAGAA
```

FIGURE 65 cont'd

```
GACAGCCTGTCCTTCAGGCAAGAAGGCCCGCGAGATAGACGAGAGCCTCATCTTCTACAAGAAGTGGGAG
CTGGAAGCCTGCGTGGATGCGGCCCTGCTGGCCACCCAGATGGACCGCGTGAACGCCATCCCCTTCACCT
ACGAGCAGCTGGACGTCCTAAAGCATAAACTGGATGAGCTCTACCCACAAGGTTACCCCGAGTCTGTGAT
CCAGCACCTGGGCTACCTCTTCCTCAAGATGAGCCCTGAGGACATTCGCAAGTGGAATGTGACGTCCCTG
GAGACCCTGAAGGCTTTGCTTGAAGTCAACAAAGGGCACGAAATGAGTCCTCAGGTGGCCACCCTGATCG
ACCGCTTTGTGAAGGGAAGGGGCCAGCTAGACAAAGACACCCTAGACACCCTGACCGCCTTCTACCCTGG
GTACCTGTGCTCCCTCAGCCCCGAGGAGCTGAGCTCCGTGCCCCCAGCAGCATCTGGGCGGTCAGGCCC
CAGGACCTGGACACGTGTGACCCAAGGCAGCTGGACGTCCTCTATCCCAAGGCCCGCCTTGCTTTCCAGA
ACATGAACGGGTCCGAATACTTCGTGAAGATCCAGTCCTTCCTGGGTGGGGCCCCACGGAGGATTTGAA
GGCGCTCAGTCAGCAGAATGTGAGCATGGACTTGGCCACGTTCATGAAGCTGCGGACGGATGCGGTGCTG
CCGTTGACTGTGGCTGAGGTGCAGAAACTTCTGGGACCCCACGTGGAGGGCCTGAAGGCGGAGGAGCGGC
ACCGCCGGTGCGGGACTGGATCCTACGGCAGCGGCAGGACGACCTGGACACGCTGGGGCTGGGGCTACA
GGGCGGCATCCCCAACGGCTACCTGGTCCTAGACCTCAGCGTGCAAGAGGCCCTCTCGGGGACGCCCTGC
CTCCTAGGACCTGGACCTGTTCTCACCGTCCTGGCACTGCTCCTAGCCTCCACCCTGGCCTGAGGGCCCC
ACTCCCTTGCTGGCCCCAGCCCTGCTGGGATCCCCGCCTGGCCAGGAGCAGGCACGGGTGATCCCCGTT
CCACCCCAAGAGAACTCGCGCTCAGTAAACGGGAACATGCCCCCTGCAGACACGT
```

FIGURE 66
SEQ ID NO: 58
Genbank ID        : AI889739
Unigene ID(#167)  : Hs.78344
Unigene name      :    myosin,   heavy   polypeptide   11,   smooth   muscle
        MYH11
>gi|5594903|gb|AI889739.1|AI889739 wo17e08.x1 NCI_CGAP_Pan1 Homo sapiens cDNA c
lone IMAGE:2455622 3' similar to gb:D10667 MYOSIN HEAVY CHAIN, SMOOTH MUSCLE IS
OFORM (HUMAN);, mRNA sequence

```
AGCGGCCGCCTTCTCCTCGTACTGCTGGGTGAGGTTCTCGATCTCCTTCTGGAACCTCTTCTTCCCCTCT
TCCAGAGCTTCCACGGTGCTGGCAAAGTCCTGCAGCTTCTTCTTCGAGTCGGAGAGCTGGATGTTGAGAG
TGGAGATGTGGCGCTCCAGGTTCTGCTTGGCCTCCATCTCCTCGTCCAGCTGGTCTTGCAGGCTGTTCCG
CTCCTCCTCCAGCTGGCGCAGCTTCGTAGACACGTTGAGCTTCTGCCGGGTTCTTCTTGAAGCAGCTCC
TGGGTGTCCTGGAGCTGGGAACTGAGGGACGCCACGTCCTTGGCCAGCTTAATGGCCTTCCCCTCGGCCT
CGTTAAGCATCCCTGTGACGCTCTCAGCTTCATTCTGCAGCTTGTGGACTTTGTCATTGAGCTCCGCCCG
GGCCCGCTCCCCATCGCTGCACTTGGACTGCAGCTCCTGCACCTGCGCCTCCAGCTTCTTCTTCTTATGT
TCCACCTCCTGCTTGGGCCTGCCCAGGACCCGCAGCTCCCCGCCAGGTCTGCGTTCTCTTTCTCCAGCG
TCTGCTTATTCTTGTCTGGTTCGCCTTGGCCCTCTTTTGACTGCTCAGCTGCTCTGTGAGCTNCTNCACC
GNNCTGTCGTGTTTCTGCCTCATCTCCTGGACCTGAGCCTCATGGGAACGCGTCTCTTCATTCAGGGCCC
CTCTTCAGCACCGTCACCTCCTGCTCCCTCTTGGC
```

FIGURE 67
SEQ ID NO: 59
Genbank ID        : J03778.1
Unigene ID(#167)  : Hs.101174
Unigene name      :    microtubule-associated protein tau  MAPT
>gi|338684|gb|J03778.1|HUMTAUA Human microtubule-associated protein tau mRNA, c
omplete cds

```
CCGCCTCTGTCGACTATCAGGTGAACTTTGAACCAGGATGGCTGAGCCCCGCCAGGAGTTCGAAGTGATG
GAAGATCACGCTGGGACGTACGGGTTGGGGGACAGGAAAGATCAGGGGGGCTACACCATGCACCAAGACC
AAGAGGGTGACACGGACGCTGGCCTGAAAGCTGAAGAAGCAGGCATTGGAGACACCCCCAGCCTGGAAGA
CGAAGCTGCTGGTCACGTGACCCAAGCTCGCATGGTCAGTAAAAGCAAAGACGGGACTGGAAGCGATGAC
AAAAAAGCCAAGGGGGCTGATGGTAAAACGAAGATCGCCACACCGCGGGGAGCAGCCCCTCCAGGCCAGA
AGGGCCAGGCCAACGCCACCAGGATTCCAGCAAAAACCCCGCCCGCTCCAAAGACACCACCCAGCTCTGG
TGAACCTCCAAAATCAGGGGATCGCAGCGGCTACAGCAGCCCGGCTCCCCAGGCACTCCCGGCAGCCGC
TCCCGCACCCCGTCCCTTCCAACCCCACCCACCCGGGAGCCCAAGAAGGTGGCAGTGGTCCGTACTCCAC
CCAAGTCGCCGTCTTCCGCCAAGAGCCGCCTGCAGACAGCCCCCGTGCCCATGCCAGACCTGAAGAATGT
CAAGTCCAAGATCGGCTCCACTGAGAACCTGAAGCACCAGCCGGGAGGCGGGAAGGTGCAAATAGTCTAC
```

FIGURE 67 cont'd

AAACCAGTTGACCTGAGCAAGGTGACCTCCAAGTGTGGCTCATTAGGCAACATCCATCATAAACCAGGAG
GTGGCCAGGTGGAAGTAAAATCTGAGAAGCTTGACTTCAAGGACAGAGTCCAGTCGAAGATTGGGTCCCT
GGACAATATCACCCACGTCCCTGGCGGAGGAAATAAAAAGATTGAAACCCACAAGCTGACCTTCCGCGAG
AACGCCAAAGCCAAGACAGACCACGGGGCGGAGATCGTGTACAAGTCGCCAGTGGTGTCTGGGGACACGT
CTCCACGGCATCTCAGCAATGTCTCCTCCACCGGCAGCATCGACATGGTAGACTCGCCCCAGCTCGCCAC
GCTAGCTGACGAGGTGTCTGCCTCCCTGGCCAAGCAGGGTTTGTGATCAGGCCCCTGG

FIGURE 68
SEQ ID NO: 60
Genbank ID       : NM_002275.1
Unigene ID(#167) : Hs.80342
Unigene name     :       keratin 15  KRT15
>gi|4504914|ref|NM_002275.1| Homo sapiens keratin 15 (KRT15), mRNA
GGTACCTCCTGCCAGCACCTCTTGGGTTTGCTGAGAACTCACGGGCTCCAGCTACCTGGCCATGACCACC
ACATTTCTGCAAACTTCTTCCTCCACCTTTGGGGGTGGCTCAACCCGAGGGGGTTCCCTCCTGGCTGGGG
GAGGTGGCTTTGGTGGGGGGAGTCTCTCTGGGGGAGGTGGAAGCCGAAGTATCTCAGCTTCTTCTGCTAG
GTTTGTCTCTTCAGGGTCAGGAGGAGGATATGGGGGTGGCATGAGGGTCTGTGGCTTTGGTGGAGGGGCT
GGTAGTGTTTTCGGTGGAGGCTTTGGAGGGGGCGTTGGTGGGGGTTTTGGTGGTGGCTTTGGTGGTGGCG
ATGGTGGTCTCCTCTCTGGCAATGAGAAAATTACCATGCAGAACCTCAATGACCGCCTGGCCTCCTACCT
GGACAAGGTACGTGCCCTGGAGGAGGCCAATGCTGACCTGGAGGTGAAGATCCATGACTGGTACCAGAAG
CAGACCCCAGCCAGCCCAGAATGCGACTACAGCCAATACTTCAAGACCATTGAAGAGCTCCGGGACAAGA
TCATGGCCACCACCATCGACAACTCCCGGGTCATCCTGGAGATCGACAATGCCAGGCTGGCTGCGGACGA
CTTCAGGCTCAAGTATGAGAATGAGCTGGCCCTGCGCCAGGGCGTTGAGGCTGACATCAACGGCTTGCGC
CGAGTCCTGGATGAGCTGACCCTGGCCAGGACTGACCTGGAGATGCAGATCGAGGGCCTGAATGAGGAGC
TAGCCTACCTGAAGAAGAACCACGAAGAGGAGATGAAGGAGTTCAGCAGCCAGCTGGCCGGCCAGGTCAA
TGTGGAGATGGACGCAGCACCGGGTGTGGACCTGACCCGTGTGCTGGCAGAGATGAGGGAGCAGTACGAG
GCCATGGCGGAGAAGAACCGCCGGGATGTCGAGGCCTGGTTCTTCAGCAAGACTGAGGAGCTGAACAAAG
AGGTGGCCTCCAACACAGAAATGATCCAGACCAGCAAGACGGAGATCACAGACCTGAGACGCACGATGCA
GGAGCTGGAGATCGAGCTGCAGTCCCAGCTCAGCATGAAAGCTGGCTGGAGAACTCACTGGCCGAGACA
GAGTGCCGCTATGCCACGCAGCTGCAGCAGATCCAGGGGCTCATTGGTGGCCTGGAGGCCCAGCTGAGTG
AGCTCCGATGCGAGATGGAGGCTCAGAACCAGGAGTACAAGATGCTGCTTGACATAAAGACACGGCTGGA
GCAGGAGATCGCTACTTACCGCAGCCTGCTCGAGGGCCAGGATGCCAAGATGGCTGGCATTGGCATCAGG
GAAGCCTCTTCAGGAGGTGGTGGTAGCAGCAGCAATTTCCACATCAATGTAGAAGAGTCAGTGGATGGAC
AGGTGGTTTCTTCCCACAAGAGAGAAATCTAAGTGTCTATTGCAGGAGAAACGTCCCTTGCCACTCCCCA
CTCTCATCAGGCCAAGTGGAGGACTGGCCAGAGGGCCTGCACATGCAAACTCCAGTCCCTGCCTTCAGAG
AGCTGAAAAGGGTCCCTCGGTCTTTTATTTCAGGGCTTTGCATGCGCTCTATTCCCCCTCTGCCTCTCCC
CACCTTCTTTGGAGCAAGGAGATGCAGCTGTATTGTGTAACAAGCTCATTTGTACAGTGTCTGTTCATGT
AATAAAGAATTACTTTTCCTTTTGCAAAT

FIGURE 69
SEQ ID NO: 61
Genbank ID       : NM_001394.2
Unigene ID(#167) : Hs.417962
Unigene name     :       dual specificity phosphatase 4       DUSP4
>gi|12707552|ref|NM_001394.2| Homo sapiens dual specificity phosphatase 4
(DUSP
4), mRNA
CCCCCTCCGCTCTGCTGCGCCGCCCGGCTGGGCCCCGAGGCCGCTCCGACTGCTATGTGACCGCGAGGCT
GCGGGAGGAAGGGGACAGGGAAGAAGAGGCTCTCCCGCGGGAGCCCTTGAGGACCAAGTTTGCGGCCACT
TCTGCAGGCGTCCCTTCTTAGCTCTCGCCTGCCCCTTTCTGCAGCCTAGGCGGCCCAGGTTCTCTTCTCT
TCCTCGCGCGCCCAGCCGCCTCGGTTCCGGCGACCATGGTGACGATGGAGGAGCTGCGGAGATGGACT
GCAGTGTGCTCAAAAGGCTGATGAACCGGGACGAGAATGGCGGCGGCGCGGGCGGCAGCGGCAGCCACGG
CACCCTGGGGCTGCCGAGCGGCGGCAAGTGCCTGCTGGACTGCAGACCGTTCCTGGCGCACAGCGCG
GGCTACATCCTAGGTTCGGTCAACGTGCGCTGTAACACCCATCGCGGCGGGGCTAAGGGCTCCGTGA
GCCTGGAGCAGATCCTGCCCCGCCGAGGAGGAGGTACGCGCCCGCTTGCGCTCCGGCCTCTACTCGGCGGT
CATCGTCTACGACGAGCGCAGCCCGCGCGCCGAGAGCCTCCGCGAGGACAGCACCGTGTCGCTGGTGGTG
CAGGCGCTGCGCCGCAACGCCGAGCGCACCGACATCTGCCTGCTCAAAGGCGGCTATGAGAGGTTTCCT
CCGAGTACCCAGAATTCTGTTCTAAAACCAAGGCCCTGGCAGCCATCCCACCCCCGGTTCCCCCCAGCGC

FIGURE 69 cont'd

```
CACAGAGCCCTTGGACCTGGGCTGCAGCTCCTGTGGGACCCCACTACACGACCAGGGGGGTCCTGTGGAG
ATCCTTCCCTTCCTCTACCTCGGCAGTGCCTACCATGCTGCCCGGAGAGACATGCTGGACGCCCTGGGCA
TCACGGCTCTGTTGAATGTCTCCTCGGACTGCCCAAACCACTTTGAAGGACACTATCAGTACAAGTGCAT
CCCAGTGGAAGATAACCACAAGGCCGACATCAGCTCCTGGTTCATGGAAGCCATAGAGTACATCGATGCC
GTGAAGGACTGCCGTGGGCGCGTGCTGGTGCACTGCCAGGCGGGCATCTCGCGGTCGGCCACCATCTGCC
TGGCCTACCTGATGATGAAGAAACGGGTGAGGCTGGAGGAGGCCTTCGAGTTCGTTAAGCAGCGCCGCAG
CATCATCTCGCCCAACTTCAGCTTCATGGGGCAGCTGCTGCAGTTCGAGTCCCAGGTGCTGGCCACGTCC
TGTGCTGCGGAGGCTGCTAGCCCCTCGGGACCCCTGCGGGAGCGGGGCAAGACCCCGCCACCCCCACCT
CGCAGTTCGTCTTCAGCTTTCCGGTCTCCGTGGGCGTGCACTCGGCCCCCAGCAGCCTGCCCTACCTGCA
CAGCCCCATCACCACCTCTCCCAGCTGTTAGAGCCGCCCTGGGGGCCCCAGAACCAGAGCTGGCTCCCAG
CAAGGGTAGGACGGGCCGCATGCGGCAGAAAGTTGGGACTGAGCAGCTGGGAGCAGGCGACCGAGCTCCT
TCCCCATCATTTCTCCTTGGCCAACGACGAGGCCAGCCAGAATGGCAATAAGGACTCCGAATACATAATA
AAAGCAAACAGAACACTCCAACTTAGAGCAATAACCGGTGCCGCAGCAGCCAGGGAAGACCTTGGTTTGG
TTTATGTGTCAGTTTCACTTTTCCGATAGAAATTTCTTACCTCATTTTTTTAAGCAGTAAGGCTTGAAGT
GATGAAACCCACAGATCCTAGCAAATGTGCCCAACCAGCTTTACTAAAGGGGGAGGAAGGGAGGGCAAAG
GGATGAGAAGACAAGTTTCCCAGAAGTGCCTGGTTCTGGGTACTTGTCCCTTTGTTGTCGTTGTTGTAGT
TAAAGGAATTTCATTTTTAAAAGAAATCTTCGAAGGTGTGGTTTTCATTTCTCAGTCACCAACAGATGAA
TAATTATGCTTAATAATAAAGTATTTATTAAGACTTTCTTCAGAGTATGAAAGTACAAAAAGTCTAGTTA
CAGTGGATTTAGAATATATTTATGTTGATGTCAAACAGCTGAGCACCGTAGCATGCAGATGTCAAGGCAG
TTAGGAAGTAAATGGTGTCTTGTAGATATGTCAAGGTAGCATGATGAGCAACTTGAGTTTGTTGCCACT
GAGAAGCAGGCGGGTTGGGTGGGAGGAGGAAGAAAGGGAAGAATTAGGTTTGAATTGCTTTTTAAAAAAA
AAAGAAAAGAAAAAGACAGCATCTCACTATGTTGCCAAGGCTCATCTTGAGAAGCAGGCGGGTTGGGTGG
GAGGAGGAAGAAAGGGAAGAATTAGGTTTGAATTGCTTTTTTAAAAAAAAA
```

FIGURE 70
SEQ ID NO: 62
Genbank ID       : NM_005441.1
Unigene ID(#167) : Hs.75238
Unigene name     :       chromatin      assembly      factor     1,     subunit      B      (p60)
        CHAF1B
>gi|4885104|ref|NM_005441.1|   Homo    sapiens    chromatin    assembly    factor    1,
subunit
B  (p60)  (CHAF1B), mRNA

```
TCTTGTCTTGAAGAAGTAGAACGGTGCCCGAGAAACGTTTTTCCCCTTCGAGACTCAGGAGGATGAAAGT
CATCACTTGTGAAATAGCCTGGCACAACAAGGAGCCCGTGTACAGCCTGGACTTCCAGCATGGGACGGCT
GGGAGGATCCACAGACTGGCGTCTGCCGGCGTGGACACCAATGTCAGGATCTGGAAGGTAGAAAAGGGAC
CAGATGGAAAAGCCATCGTGGAATTTTTGTCCAATCTTGCTCGTCATACCAAAGCCGTCAATGTTGTGCG
TTTTTCTCCAACTGGGGAAATTTTAGCATCGGGAGGAGATGATGCTGTCATCCTATTGTGGAAGGTGAAT
GATAACAAGGAGCCGGAGCAGATCGCTTTTCAGGATGAGGACGAGGCCCAGCTGAACAAGGAGAACTGGA
CGGTTGTGAAGACTCTGCGGGGCCACTTAGAAGATGTGTATGATATTTGCTGGGCAACTGATGGGAATTT
AATGGCTTCTGCCTCTGTGGATAACACAGCCATCATATGGGATGTCAGCAAAGGACAAAAGATATCAATT
TTTAATGAACATAAAAGTTATGTCCAAGGAGTAACCTGGGACCCTTTGGGTCAATATGTTGCTACTCTGA
GCTGTGACAGGGTGCTGCGAGTATACAGTATACAGAAGAAGCGTGTGGCTTTCAATGTTTCGAAGATGCT
GTCTGGAATAGGGGCTGAAGGAGAGGCAAGAAGCTACCGGATGTTTCACGACGACAGCATGAAGTCTTTC
TTCCGTAGACTGAGTTTCACTCCCGACGGATCTTTGCTTCTCACGCCAGCTGGATGTGTGGAATCTGGTG
AAAATGTAATGAATACCACTTATGTTTTCTCCAGGAAGAATCTTAAAAGGCCCATCGCTCATCTTCCATG
TCCTGGAAAAGCCACTCTTGCTGTTCGCTGCTGCTGTCCGGTCTACTTTGAACTGAGGCCAGTGGTGGAAACA
GGTGTGGAGCTGATGAGTCTGCCCTACCGCCTGGTGTTTGCTGTGGCCTCGGAGGATTCCGTGCTTCTGT
ATGACACCCAGCAGTCCTTCCCTTTTGGTTACGTGTCTAATATACATTACCACACCCTCAGTGACATTTC
ATGGTCCAGCGATGGTGCCTTCCTGGCCATTTCTTCCACGGACGGTTACTGCTCATTTGTGACATTTGAG
AAAGATGAACTTGGAATTCCTTTGAAAGAGAAGCCAGTTTTGAACATGAGAACTCCTGATACAGCAAAGA
AAACCAAGAGTCAGACACATCGAGGGTCTTCGCCAGGACCCAGACCGGTAGAGGGAACCCTGCCAGCAG
AACCCAAGACCCCAGCAGCCCCGGCACGACTCCCCCTCAGGCCAGACAGGCCCCAGCCCCAACAGTCATC
AGGGACCCTCCCTCCATCACTCCTGCTGTCAAAAGCCCCTTGCCGGGGCCTTCGGAGGAGAAGACCCTGC
AGCCCAGTAGTCAAAACACAAAAGCCCACCCATCCCGGAGGGTCACTCTGAACACACTGCAAGCCTGGAG
CAAGACAACACCCCGGAGAATAAACTTAACACCCTTAAAGACGGACACTCCACCAAGTTCTGTACCAACC
AGTGTGATTTCCACCCCTTCTACAGAAGAAATTCAGTCAGAGACGCCTGGAGACGCTCAGGGCAGTCCCC
CAGAGCTAAAGCGGCCCAGACTCGATGAAAACAAAGGAGGCACGGAAAGTCTGGACCCTTGATGGGACCT
CGGCTTCTGCTCGAAGCCTACCAGGCTCCCGGTGTGTGCAGGGAGACGGTAAAGCTGGAGGTGCCTGAGA
CCAGGGCTTCCATGGAGCGGGACACACTGTAAATGGATTTCTATAACAGAAGTGACATGTGTACTGATTT
```

FIGURE 70 cont'd

```
TTCTCCAGAAATATGGATGCTGTTGTATTCAGTATCCATTTTTAACTTGGGACATGAACGTTTTAACATA
GTAAATCCTCTTTTTGATGAGTTTCTGAAACTGGAGCGGTTCAACGTTATCCAGTGTGAAAATCAGTGAG
TCCTCCCTGGCATCCTCGTGAAAGTGCACACACTTCATGGAGGGACTCCTTTTCAATAAGAATTAGGAAG
ATGAGAAAGTAATTTGAGATTTTACTCTGTCGAATTTTAGAGTATTTGAAGTGATTGTTAGATTTCACTT
CTAAGGAGTTGATTGATTAAACTTTGG
```

FIGURE 71
SEQ ID NO: 63
Genbank ID        : AK023134.1
Unigene ID(#167)  : Hs.130675
Unigene name      :          hypothetical gene FLJ13072    FLJ13072
>gi|10434916|dbj|AK023134.1|  Homo    sapiens    cDNA    FLJ13072  fis,   clone
NT2RP3001844

```
AAAAATTACGCGAAGATGCTAAGATACCAGCTTGTGAAGAAAGCCTAAGCCAGACCCCGCCGAGGGTGAC
AGGGACCAGTCCTGCTCAAGACCAGGATCATCCATCCGAGGAACAGGGGGGGCAGGGTTCCTGTAGAGAG
CCAGGTGTTAACCCCTGCCTCTCCCGTCTAGGACGCCTCCAGCAGAAGATGCTGCTTGCCTGCAGAGCCC
CCAGCCTGAGGACACGGGTGCAGAAGGAGGGGCTGAGTCCAAGACGAGCTCAGAAACCAGAAGCCTGAA
ACTTTATCTGGAAACACTGAAGGTGCCTTCATTAGCAGAACTGCACAGCCGCCTCTGAAAGGTACGTCC
ACTCGGCATGGAGGAGTCGGCGTCCCTTACCCAGTTAATAAGATCAATGAATGCGCAGGTCTTTCTTCTT
CTAGCTTCCACCCACAAATAAAATGGTTCCAAAAAGAAGATGTCGTCATCTTAAAGATAAGAATAAGGAA
TGTAAAGGACTACAAGTGTCAGTATTTAAGGGATAGAGTCGTTTTCAGTGCTTGGGTGGGAGACAAATTT
TACCTGGCTGATCTGGAGCTGCGGGGCAACATAAGGAAAGATGACTGCCAATGTGTGATTAGAAACGATG
AACCTGTAATCACTCTGGCCAAAGAGAGAAGGGAGGCATGGTGTCACCTACTCAGACAGAGGAACCCCAA
CGTGGCTTTTGATTTTGATCACTGGGAAGACTGTGAAGAGGACAGCCACTTCCCCAAGGTAGTGAATTCT
AAAAACCTGCCGTACACAGTGACAGAGGTGGTTGAAGACAGTAGCAGCACTTCAGAGGATGACGGCAGTG
AGAGTGAAAGAGAAGGTGAATGACGTCCTCAAGAGCGGCTGGAAGATGTTGAACAAAAATGGATATTGCC
ATGTGACCGACAGTTAAGAAAACAGTCAGTCATAACCAAATCTTTTTCTTTTCTTTTCTTTTTTTTTTTT
TTTTTTTTTTTGAGACAGAGTCTTGCTCTGTCGGCCAGGCTGGAGTGCAGTGGCATGATCTTGGCTCA
CTGCAACCTCTGCCTCACAGGCTCAAGCAATTCTCCTGCCTCAGCCTCCCGAGTAGCTGGGATTACAGGC
ATGTGCCACCATGCCTGACCAATTTTTGTATTTTTAGTAGAGACAGGGTTTCACCATGTTGGACAGGCTG
GTCTCGAACTCCTGACCTCAGGTAATCCTCCCACCTCAGCCTCCCAAAGTGCTGGGATTACAGGTGTGAG
CCACCACACCCGGCCAACCAAATCTTTCTTTACCTCAAGGATAAATGATTACTGTCACCTTGTGGTGCTG
GACTTGATAACGGTGAGAAATTCTTCATTGACTTAAAAATAGGCTGATGATAAGACCATCAAACGAGGGT
GGACACAGAGAAACAGCAGGTGTGGTCTGATTCCGCCGGCTTGTCTGTCCTGTCTGGCGCCTCTCGCCAC
TCACCCTGGCAGAGCAGACATGCATCTGGGTGATGAAATGCACCTGTCTGGAGTCAGTCCATTCATTTTT
TTCACCTAGACCTTTGCTACATTGCTACAAACCTGATCTTACACATATAAATTGAGGTTTCTAATGTACA
CACTTAGACTCAGCAACTGTTGAACCAGCCCTTTCAACCATGAGATAGTGGGATTTAACATAACCATCTA
TGTGAATTGATAGTGTTAGCATTCTTGGATAGTGATAGCTCCTCAGAGTAAGTTGACTTCTGATGAAGAG
ATAGTCCAGGGATAGAAATTGGATTGCTCAGTAAGACCCAGGCCTTTCCGGGGTGAAGCTGCTGGTTCTA
AACAATCCCTTGGACCTGCAGAGTCCTGAGCAAATGGCACAAAGGTTGCTTTTTAGTGGAAATTCACAAG
GGCCTGTGGGGTGCCTGGAGGTGATCTTTGAATGCCTACATGTCGTGAGCCCTGCAGACATTCGCCACCC
CATCTGCATTGTGGCTGCAGCACTGGGGGGGGTCACCAGGTTTAGGGGAGGAGTGTATGTAGTCATGGCC
ACACCCAGAGGCTGGCTTTTGTGCTTTGGGTTCTTTGTTGACTGAAAAAGCGAGAAAGGTGAGCTATTG
GGAAATTAAAAGTCCTGTGCACTCTGTGTCTTGTTTATCAGCTTTGCCTCGGAATGGAAAAGAATTTGGA
TAGAACATGAGTGTTGTGTGACGGCCCCAAGATCTTTATTATTTTTTGTATCAGAAAGCGCCAATGCCC
AGGCTTATGTATGTCCCAGCAGAAGCCACCGCTTGAACTAGAGGTGAACTTTGTCATCAAGCTGTCCTGT
GAGCAGGTCTGGATCACACTCTGGCTGCAGTTTTCTCATCTGTAAAATGAGACATCCCCTCATTGTGTGGC
CTGGCCTTGTCTCAGGGAGCGCCCGCCGAGTGCTGCTGGGTTGGGCAGTTTTTCTGCCCAGTGGCTCTGA
TGGGGGCTCAGAGCCCTGGCCTCCCCTGGGAGGACACGCTGTGCAGCCAGGACAGCTGCCGGGAGTGTGC
CCAGGTCACTGCTATGGCCTTCGCAGGGTGACTGGCAGGTATCAAATCAGCCCATGAAGGAAGATGGTGA
TTTTCCTTTTTGTAGCTAAATTGGGCAGGCTCTTGGGAAGTAGAAAGTTCTGGTGTTTTGCTGGTGAA
GGTTTTGACTGTGGAGCTCTTCTAACACCCATATCAGTGTCTGTTTCTGCATGTGGCTGCTGCCCTGT
TGGTGGAGCTCTGGGGGCAGAGACCAGGCCGCCGTCCAGTGGCGCCCCGTGCGCACCAGCTGCCTGCTGT
TTACACCCAGGTGCGCCGAGTCTCTTTCATACAGCACAGCAAATGATAATAGCTAGTGACAATGTGTTTC
CTGTGCACTCGTGAAAATGCAGGGAGGACAACTGCATGCTTAGATCTGTTTCTTTTTCAGACATTCAAA
TGTTCTAATATCTGAAGCTAACATTTTGTAGGATATAGGATGCTGATTATGTGAACAATTAGTCATTGGT
TTTCTGTACTGCTATGAATATGTCTGATTTCAAGTTTTGGTCAAATATCTAAAATGCAAGGTGAAAGTGC
CTTTGTCTCTATGCTTCTAAAATCGCTCATGCTTAGTTGTGGATGGATGTCTTCCGCAGTGTATCATCA
ATAAAATTTCACTGTTTTCACAG
```

FIGURE 72
SEQ ID NO: 64
Genbank ID         : AI791225
Unigene ID(#167)   : Hs.444098
Unigene name       :       Similar to IAP-associated factor VIAF1; phosducin-like 2 (LOC377689), mRNA
>gi|5338941|gb|AI791225.1|AI791225 oe18e03.y5 NCI_CGAP_Ov2 Homo sapiens cDNA cl
one IMAGE:1386268, mRNA sequence
CTACTACTAAATTCGCGGCCGCGTCGACTTTTTTTTTTTTGCCATACCAATAGCTGGTTTTAATTTTTTT
AGAGGAAATACTATAGTTTAAAAAAAGAGTTCCAAAATATTTAACAGAATTTCCAGCAATTATTATTTCT
AAAATGTAAAGATTTGAAACATAATTTATACAAAACTAAAAACCAGAAGGATTCATTCTTGCTTTTCCTT
TTCTTAAAGAAATCCAGACAATTTGTCACAAGAAAGTTCAGCATGTGATAGCAGCTGCAGCCTCAGTCAC
CCTTGGAATCGCTGTCCCTCCTCATGGGGACAGAGCTCTGCACTGAAGACAGCAATACACCTTCAATCGG
CTTCTTAGGGTTTTCCTCCAAGTCCGTCTTAACTGCTCTAGATTCAGACAGTTTCCACCCCAACTCATCT
CTGGTCAGGTTCATGCCGCCAAACACCAGAGGACCGATCAACTGAGCCTTGATGTCTCCTTCCAAGTAAA
CAAATACCATGGGCAGATTCCTATCAGGATAATTGNGTATGCG

FIGURE 73
SEQ ID NO: 65
Genbank ID         : AF176013.1
Unigene ID(#167)   : Hs.260720
Unigene name       :      J domain containing protein 1 JDP1
>gi|5815354|gb|AF176013.1|AF176013 Homo sapiens J domain containing protein 1 i
soform b (JDP1) mRNA, complete cds
CAGATTTAAAGAGTTTCTTCCTGTTAATTCGAAGCTCACTGTGCCTCTTGTTTCCGAGGGAAGAAGGACT
GATTAAGTCATCTAAATGGATGCAATACTGAATTACAGGTCAGAAGATACTGAAGATTACTACACATTAC
TGGGATGTGATGAACTATCTTCGGTTGAACAAATCCTGGCAGAATTTAAAGTCAGAGCTCTGGAATGTCA
CCCAGACAAGCATCCTGAAAACCCCAAAGCTGTGGAGACTTTTCAGAAACTGCAGAAGGCAAAGGAGATT
CTGACCAATGAAGAGAGTCGAGCCCGCTATGACCACTGGCGAAGGAGCCAGATGTCGATGCCATTCCAGC
AGTGGGAAGCTTTGAATGACTCAGTGAAGACGGTGGGTTTCTCGCTGGGTGCGACGTGAATTTGTGAAGC
TCAGGATGCCCATGGATTAGACTCATGTAGTAGCTTAAAGAGTCATTAGGCGATAGGAGGGAGAAAACCA
AGAAGTTAGCAGAGTCTGGATATAATTCAGTGTCCGTAAATCCCATGAAGAGAAGCTCATCAGAATAAAG
GCAATGAATTTGTGCCAGAAGAGCCTGTGACTACATTTCTTTCAATCTCTTTGGCTGTTTGTTTCAGTAT
ACACACTCCCTGTTATTGCTTACTATTTTATGAGCTCTAATAAATGTACTTCTCAAGTTGCTCATGAAAA
AAA

FIGURE 74
SEQ ID NO: 66
Genbank ID         : NM_018123.1
Unigene ID(#167)   : acc_NM_018123.1
Unigene name       :
>gi|8922484|ref|NM_018123.1|  Homo  sapiens  hypothetical  protein  FLJ10517 (FLJ105
17), mRNA
GCAAACATACTTTAATAAGTTAAAGAAAATAACAAAAACAGTACAGCAAAGATACTGGGCAATGAAAGAA
AGAAACATACAATTTCAAAGGTATAACAAACTGAGGCATTCTGTAATATACATTCAGGCTATTTTTAGGG
GAAAGAAAGCTAGAAGACATTTAAAAATGATGCATATAGCCGCAACTCTCATTCAGAGGAGATTTAGAAC
TCTAATGATGAGAAGAAGATTCCTCTCTCTCAAGAAAACTGCTATTTTGATTCAGAGAAAATATCGGGCA
CATCTTTGTACAAAGCATCACTTACAGTTCCTTCAGGTACAAAATGCAGTTATTAAAATCCAGTCATCAT
ACAGAAGATGGATGATAAGGAAAAGGATGCGAGAGATGCACAGGGCTGCTACTTTCATCCAGTCTACTTT
CAGAATGCACAGATTACATATGAGATATCAGGCTTTGAAACAGGCCTCCGTTGTGATCCAACAGCAATAC
CAAGCAAATAGAGCTGCAAAACTGCAGAGGCAGCATTATCTCAGACAAAGACACTCTGCTGTGATCCTTC
AGGCTGCATTCAGGGGTATGAAAACTAGAAGACATTTGAAGAGTATGCATTCCTCTGCAACCCTTATTCA
GAGTAGGTTTAGATCATTACTGGTGAGGAGAAGATTCATTTCCCTCAAAAAAGCTACTATTTTGTTCAG
AGGAAATATCGAGCCACCATTTGTGCCAAACATAAATTGTACCAATTCTTGCACTTAAGAAAGGCAGCCA

FIGURE 74 cont'd

```
TTACAATACAGTCATCTTACAGAAGACTGATGGTAAAGAAGAAGTTACAAGAAATGCAAAGGGCTGCAGT
TCTCATTCAGGCTACTTTCAGGATGCACAGAAAAAAAAATATATTACATTTCAGACTTGGAAACATGCTT
CAATTCTAATTCAGCAACATTATCGAACATATAGAGCTGCAAAATTGCAAAGAGAAAATTATATCAGACA
ATGGCATTCTGCTGTGGTTATTCAGGCTGCATATAAAGGAATGAAAGCAAGACAACTTTTAAGGGAAAAA
CACAAAGCTTCTATTGTAATACAAGGCACCTACAGAATGTATAGGCAGTATTGTTTCTACCAAAAGCTTC
AGTGGGCTACAAAAATCATACAAGAAAAATATAGAGCAAATAAAAAGAAACAGAAAGTATTTCAACACAA
TGAACTTAAGAAAGAGACTTGTGTTCAGGCAGGTTTTCAGGACATGAACATAAAAAAACAGATTCAGGAA
CAGCACCAGGCTGCCATTATTATTCAGAAGCATTGTAAAGCCTTTAAAATAAGGAAGCATTATCTCCACA
TTAGAGCAACAGTAGTTTCTATTCAAAGAAGATACAGAAAACTAACTGCAGTGCGTACCCAAGCAGTTAT
TTGTATACAGTCTTATTACAGAGGCTTTAAAGTACGAAAGGATATTCAAAATATGCACCGGGCTGCCACA
CTAATTCAGTCATTCTATCGAATGCACAGGGCCAAAGTTGATTATGAAACAAAGAAAACTGCAATTGTGG
TTATACAGAATTATTATAGGTTGTATGTTAGAGTAAAAACAGAAAGAAAAAACTTTTTAGCAGTTCAGAA
ATCTGTACGAACTATTCAGGCTGCTTTTAGAGGCATGAAAGTTAGACAAAAATTGAAAAATGTATCAGAG
GAAAAGATGGCAGCCATTGTTAACCAATCTGCACTCTGCTGTTACAGAAGTAAAACTCAGTATGAAGCTG
TTCAAAGTGAAGGTGTTATGATTCAAGAGTGGTATAAAGCTTCTGGCCTTGCTTGTTCACAGGAAGCAGA
GTATCATTCTCAAAGTAGGGCTGCAGTAACAATTCAAAAAGCTTTTTGTAGAATGGTCACAAGAAAACTG
GAAACACAGAAATGTGCTGCCCTACGGATTCAGTTCTTCCTTCAGATGGCTGTGTATCGGAGAAGATTTG
TTCAGCAGAAAAGAGCTGCTATCACTTTACAGCATTATTTTAGGACGTGGCAAACCAGAAAACAGTTTTT
ACTATATAGAAAAGCAGCAGTGGTTTTACAAAATCACTACAGAGCATTTCTGTCTGCAAAACATCAAAGA
CAAGTCTATTTACAGATCAGAAGCAGTGTTATCATTATTCAAGCTAGAAGTAAAGGATTTATACAGAAAC
GGAAGTTTCAGGAAATTAAAAATAGCACCATAAAAATTCAGGCTATGTGGAGGAGATATAGAGCCAAGAA
ATATTTATGTAAAGTGAAAGCTGCCTGCAAGATTCAAGCCTGGTATAGATGTTGGAGAGCACACAAAGAA
TATCTAGCTATATTAAAAGCTGTTAAAATTATTCAAGGTTGCTTCTATACCAAACTAGAGAGAACACGGT
TTTTGAATGTGAGAGCATCAGCAATTATCATTCAGAGAAATGGAGAGCTATACTTCCTGCAAAGATAGC
TCATGAACACTTCTTAATGATAAAAGACATCGAGCTGCTTGTTTGATCCAAGCACATTATAGAGGATAT
AAAGGAAGGCAGGTCTTTCTTCGGCAGAAATCTGCTGCTTTGATCATACAAAAATATATACGAGCCAGGG
AGGCTGGAAAGCATGAAAGGATAAAATATATTGAATTTAAAAAAATCTACAGTTATCCTACAAGCACTGGT
GCGTGGTTGGCTAGTACGAAAAAGATTTTTAGAACAGAGAGCCAAAATTCGACTTCTTCACTTCACTGCA
GCTGCATATTATCACCTGAATGCTGTTAGAATTCAAAGAGCCTATAAACTTTACCTGGCTGTGAAGAATG
CTAACAAGCAGGTTAATTCAGTCATCTGTATTCAGAGATGGTTTCGAGCAAGATTACAAGAAAAGAGATT
TATTCAGAAATATCATAGCATCAAAAAGATTGAGCATGAAGGTCAAGAATGTCTGAGCCAGCGAAATAGG
GCTGCATCAGTAATACAGAAAGCAGTGCGCCATTTTCTCCTCCGTAAAAAGCAGGAAAAATTCACTAGTG
GAATCATTAAAATTCAGGCATTATGGAGAGGCTATTCTTGGAGGAAGAAAAATGATTGTACAAAAATTAA
AGCTATACGACTAAGTCTTCAAGTTGTTAATAGGGAGATTCGAGAAGAAAACAAACTCTACAAAAGAACT
GCACTTGCACTTCATTACCTTTTGACATATAAGCACCTTTCTGCCATTCTTGAGGCCTTAAAACACCTAG
AGGTAGTTACTAGATTGTCTCCACTTTGTTGTGAGAACATGGCCCAGAGTGGAGCAATTTCTAAAATATT
TGTTTTGATCCGAAGTTGTAATCGCAGTATTCCTTGTATGGAAGTCATCAGATATGCTGTGCAAGTCTTG
CTTAATGTATCTAAGTATGAGAAAACTACTTCAGCAGTTTATGATGTAGAAAATTGTATAGATATACTAT
TGGAGCTTTTGCAGATATACCGAGAAAAGCCTGGTAATAAAGTTGCAGACAAAGGCGGAAGCATTTTTAC
AAAAACTTGTTGTTTGTTGGCTATTTTACTGAAGACAACAAATAGAGCCTCTGATGTACGAAGTAGGTCC
AAAGTTGTTGACCGTATTTACAGTCTCTACAAACTTACAGCTCATAAACATAAAATGAATACTGAAAGAA
TACTTTACAAGCAAAAGAAGAATTCTTCTATAAGCATTCCTTTTATCCCAGAAACACCTGTAAGGACCAG
AATAGTTTCAAGACTTAAGCCAGATTGGGTTTTGAGAAGAGATAACATGGAAGAAATCACAAATCCCCTG
CAAGCTATTCAAATGGTGATGGATACGCTTGGCATTCCTTATTAGTAAATGTAAACATTTTCAGTATGTA
TAGTGTAAAGAAATATTAAAGCCAATCATGAGTACGT
```

FIGURE 75

SEQ ID NO: 67
Genbank ID        : N58363
Unigene ID(#167)  : Hs.8739
Unigene name      :      signal transducer and activator of transcription 3
interacting protein 1    STATIP1
>gi|1202253|gb|N58363.1|N58363 yv69g03.s1 Soares fetal liver spleen 1NFLS Homo
sapiens cDNA clone IMAGE:248020 3', mRNA sequence
```
CCACCACCATTTAGTAATAGCCTGGGGTAACAAGGGCTGCGTCACGGACTGCCACTTTTGCCATCCTGCT
CAGAGCAGGGCCATGCCTAACCCGTATCTGGGGATTGCTTCAGATATTATGAATCGCTTCAATATTATGA
ATTACTACAATTCATAATAATTGCTTCAGATATTATGAATTACAATATGGTTCAAAGGTGCTTTANAGAT
GAAGACACAAATGTGTNAACACATATTG
```

FIGURE 76
SEQ ID NO: 68
Genbank ID      : AW665096
Unigene ID(#167) : Hs.15299
Unigene name    :      HMBA-inducible    HIS1
>gi|7457641|gb|AW665096.1|AW665096   hi99d03.x1   Soares_NFL_T_GBC_S1   Homo sapiens
cDNA  clone  IMAGE:2980421  3'  similar  to  TR:O94992  O94992  HIS1  PROTEIN.
;contains
  MER22.b1 MER22 repetitive element ;, mRNA sequence
TAAGAAAAACCCATTTTTTTCCTTAAGGACTTACTAGCCAAAATTTCTTAAACTTCGAGGACTCTACTAG
CCATGGCCGAGCCATTCTTGTCAGAATATCAACACCAGCCTCAAACTAGCAACTGTACAGGTGCTGCTGC
TGTCCAGGAAGAGCTGAACCCTGAGCGCCCCCAGGCGCGGAGGAGCGGGTGCCCGAGGAGGACAGTAGG
TGGCAATCGAGAGCGTTCCCCCAGTTGGGTGGCCGTCCGGGCCGGAGGGGAAGGGAGCCTGGAATCCC
AACCACCTCCCTTGCAGACCCAGGCCTGTCCAGAATCTAGCTGCCTGAGAGAGGGCGAGAAGGGCCAGAA
TGGGGACGACTCGTCCGCTGGCGGCGACTTCCCGCCGCCGGCAGAAGTGGAACCGACGCCCGAGGCCGAG
CTGCTCGCCCAGCCTTGTCATGACTCCGAGGCCAGTAAGTTGGGGGCTCCTGCCGCANGGGGCGAAGAGG
AGTGGGGACAGCAGCAGAGACAGCTGGGGAAGAAAAAACATAGGAGACGCCCGTCCAAGAAGAAGCGGCA
TTG

FIGURE 77
SEQ ID NO: 69
Genbank ID      : AK001166.1
Unigene ID(#167) : Hs.421337
Unigene name    :      HBxAg transactivated protein 1      XTP1
>gi|7022248|dbj|AK001166.1|  Homo  sapiens  cDNA  FLJ10304  fis,  clone
NT2RM2000192
AAACAAAGAGATGCCACCCCTGTGTGATGGCTTTGGTACCCGAACACTGATGGTTCAGACATTTTCCCGT
TGCATCTTGTGTTCCAAGGATGAAGTGGACTTGGATGAGTTATTAGCTGCTAGATTGGTAACGTTTCTGA
TGGACAATTACCAGGAAATTCTGAAAGTCCCTTTGGCCTTGCAGACCTCTATAGAGGAGCGTGTGGCTCA
TCTACGAAGAGTCCAGATAAAATACCCAGGAGCTGATATGGATATCACTTTATCTGCTCCATCATTTTGC
CGTCAAATTAGTCCAGAGGAATTTGAATATCAAAGATCATATGGCTCTCAGGAACCTCTGGCAGCCTTGT
TGGAGGAAGTCATAACAGATGCCAAACTCTCCAACAAAGAGAAAAAGAAGAAACTGAAGCAGTTTCAGAA
ATCCTATCCTGAAGTCTATCAAGAACGATTTCCTACACCAGAAAGTGCAGCACTTCTGTTTCCTGAAAAA
CCCAAACCGAAACCACAGCTGCTAATGTGGGCACTAAAGAAGCCTTTCCAACCATTTCAAAGAACTAGAA
GTTTTCGAATGTAATAATACTTCCACAGCAACAGGTGCTAGAGACCACTGTTGTTGTTTTGAGTGAATGG
TGGTTAGGAGAAAGACTTTGGTGGTGGAAGAAAGAAAAGCATAAAACAAAGACTACTGAAATATAGATAA
AGATTGCCTTAGTTTTTAAAAATGTTTGGCCATTAGTATTTTTATAAAACTCAATGCTAGTTTTAAGTGT
ATAAATTGGTTAAAATTTATGAGTCAAATATATAGTGATAATGTTAACATGTTTGTAATTGCTACAGAAT
TTAAGGGTATTTTTATCTCTGTGCTTTCTTTTTCATGGTGTTTATTAAATAATTGTGTATATACATCCTA
GCTACTGATATCTTTATTATAGCCTTAAGACTTAATTTTAAGTCTTAAAAATAGCCTGTATACTTGAATA
AGAAAGACACTGGGTACTGTTACTGTGATGCTATTGACTTAGTAGCCAATTATCATTTCTCCTGTATAAA
TTCCAGTTTTTATTGCTGCACATAAATTTTTTAATGTCTTATATTGTGATAGCTATGTCTTTTATTGCAG
ATTTATTGGATGTTATGACAGATTTTACTAAAGCTAGTGTTTTTATAACATATATATTAGTTGATGTTTA
CCTATAAGTGGAGTAGATTTTCATCTGCCTGCAATGGTATAATTTCAGTCTTAGCTAAAAATGGAAAGTT
GAACTGGATAAATTCTTTGGGTACCCTTAGACCTCTGATTCTAAGTCAAATGCAAATGGGTTAAATAAAA
TGAGACTACTTCCTTTATAAATATATTTTCATCCTTTTGAAAGTAAGTGAAATGTAAATAAACTTATTTT
TTTTAAAAATG

FIGURE 78
SEQ ID NO: 70
Genbank ID      : NM_004636.1
Unigene ID(#167) : Hs.82222
Unigene name    :      sema  domain,  immunoglobulin  domain  (Ig),  short
basic domain, secreted, (semaphorin) 3B    SEMA3B
>gi|4759091|ref|NM_004636.1|  Homo  sapiens  sema  domain,  immunoglobulin
domain (I FIGURE 78 cont'd g), short basic domain, secreted, (semaphorin) 3B (SEMA3B), mRNA
TCTGTGATTGTGGCCAGGCGGGGCACCCTCGGAGGGGAGGGTTCGGAAGTGGAATGCGACCCCCCAGCCT
CTTTCCCCTAGGGGCTGTAATCTGATCCCTGGGGACTCCCCCCCTAGCCTCCCGCCCTCGCCCTCACTGC
TGACTCCTCTTCCAGATCCTGGGGCAGAGTCCAGGGCAGCTCAAGGCTCCTCCACACACACACCCGCTGA
ACCCTGAGCACCCTGAGCTGCTGAGATGGGGCGGGCCGGGCTGCCGCCGTGATCCCGGGCCTGGCCCTG
CTCTGGGCAGTGGGGCTGGGGAGTGCCGCCCCAGCCCCCACGCCTTCGGCTCTCCTTCCAAGAGCTCC
AGGCCTGGCATGGTCTCCAGACTTTCAGCCTGGAGCGAACCTGCTGCTACCAGGCCTTGCTGGTGGATGA
GGAGCGTGGACGCCTGTTTGTGGGTGCCGAGAACCATGTGGCCTCCCTCAACCTGGACAACATCAGCAAG
CGGGCCAAGAAGCTGGCCTGGCCGGCCCCTGTGGAATGGCGAGAGGAGTGCAACTGGGCAGGGAAGGACA
TTGGTACTGAGTGCATGAACTTCGTGAAGTTGCTGCATGCCTACAACCGCACCCATTTGCTGGCCTGTGG
CACGGGAGCCTTCCACCCAACCTGTGCCTTTGTGGAAGTGGGCCACCGGGCAGAGGAGCCCGTCCTCCGG
CTGGACCCAGGAAGGATAGAGGATGGCAAGGGGAAGAGTCCTTATGACCCCAGGCATCGGGCTGCCTCCG
TGCTGGTGGGGGAGGAGCTATACTCAGGGGTGGCAGCAGACCTCATGGGACGAGACTTTACCATCTTTCG
CAGCCTAGGGCAACGTCCAAGTCTCCGAACAGAGCCACACGACTCCCGCTGGCTCAATGAGCCCAAGTTT
GTCAAGGTATTTTGGATCCCGGAGAGCGAGAACCCAGACGACGACAAAATCTACTTCTTCTTTCGTGAGA
CGGCGGTAGAGGCGGCGCCGGCACTGGGACGCCTGTCCGTGTCCCGCGTTGGCCAGATCTGCCGGAACGA
CGTGGGCGGCCAGCGCAGCCTGGTCAACAAGTGGACGACGTTCCTGAAGGCGCGGCTGGTGTGCTCGGTG
CCCGGCGTCGAGGGCGACACCCACTTCGATCAGCTCCAGGATGTGTTTCTGTTGTCCTCGCGGGACCACC
GGACCCCGCTGCTCTATGCCGTCTTCTCCACGTCCAGCAGCATCTTCCAGGGCTCTGCGGTGTGCGTGTA
CAGCATGAACGACGTGCGCCGGGCCTTCTTGGGACCCTTTGCACACAAGGAGGGGCCCATGCACCAGTGG
GTGTCATACCAGGGTCGCGTCCCCTACCCGCGGCCAGGCATGTGCCCCAGCAAGACCTTTGGCACCTTCA
GTTCCACCAAGGACTTCCCAGACGATGTCATCCAGTTTGCGCGGAACCACCCCCTCATGTACAACTCTGT
CCTGCCCACTGGGGGGCGCCCTCTTTTCCTACAAGTTGGAGCCAATTACACCTTCACTCAAATTGCCGCG
GACCGGGTTGCAGCCGCTGACGGACACTATGACGTCCTCTTCATTGGCACAGACGTTGGCACGGTGCTGA
AGGTGATCTCGGTCCCCAAGGGCAGTAGGCCCAGCGCAGAGGGGCTGCTCCTGGAGGAGCTGCACGTGTT
TGAGGACTCGCCGCTGTCACCAGCATGCAAATTTCTTCCAAGAGGCACCAGCTGTACGTAGCCTCGCGG
AGCGCGGTGGCCCAGATCGCGTTGCACCGCTGCGCTGCCCACGGCCGCGTCTGCACCGAATGCTGTCTGG
CGCGTGACCCCTACTGCGCCTGGGACGGGGTCGCGTGCACGCGCTTCCAGCCCAGTGCCAAGAGGCGGTT
CCGGCGGCAAGACGTAAGGAATGGCGACCCCAGCACGTTGTGCTCCGGAGACTCGTCTCGTCCCGCGCTG
CTGGAACACAAGGTGTTCGGCGTGGAGGGCAGCAGCGCCTTTCTGGAGTGTGAGCCCCGCTCGCTGCAGG
CGCGCGTGGAGTGGACTTTCCAGCGCGCAGGGGTGACAGCCCACACCCAGGTGCTGGCAGAGGAGCGCAC
CGAGCGCACCGCCCGGGGACTACTGCTGCGCAGGCTGCGGCGCCGGGACTCGGGCGTGTACTTGTGCGCC
GCCGTCGAGCAGGGCTTTACGCAACCGCTGCGTCGCCTGTCGCTGCACGTGTTGAGTGCTACGCAGGCCG
AACGACTGGCGCGGGCCGAGGAGGCTGCGCCCGCCGCGCCGCCGGGCCCCAAACTCTGGTACCGGGACTT
TCTGCAGCTGGTGGAGCCGGGCGGAGGTGGCAGCGCGAACTCCCTGCGCATGTGCCGCCCGCAGCCTGCG
CTGCAGTCACTGCCCCTGGAGTCGCGGAGAAAGGGCCGTAACCGGAGGACCCACGCCCCTGAGCCTCGCG
CTGAGCGGGGGCCGCGCAGCGCAACGCACTGGTGACCAGACTGTCCCCACGCCGGGAACCAAGCAGGAGA
CGACAGGCGAGAGAGGGAGCCAGACAGACCCTGAAAAGAAGGACGGGTTGGGGCCGGGCACATTGGGGTC
ACCGGCCGATGGAGACACCAACCGACAGGCCCTGGCTGAGGGCAGCTGCGCGGGCTTATTTATTAACAGG
ATAACCCTTGAATGTAGCAGCCCCGGGAGGGCGGCACAGGTCGGGCGCAGGATTCAGCCGGAGGGAAGGG
ACGGGGAAGCCGAGCTCCAGAGCAACGACCAGGGCCGAGGAGGTGCCTGGAGTGCCCACCCTGGGAGACA
GACCCCACCTCCTTGGGTAGTGAGCAGTGAGCAGAAAGCTGTGAACAGGCTGGGCTGCTGGAGGTGGGGC
GAGGCAGGCCGACTGTACTAAAGTAACGCAATAAACGCATTATCAGCCA

FIGURE 79
SEQ ID NO: 71
Genbank ID       : NM_004490.1
Unigene ID(#167) : Hs.411881
Unigene name     :       growth factor receptor-bound protein 14    GRB14
>gi|4758477|ref|NM_004490.1| Homo sapiens growth factor receptor-bound
protein
14 (GRB14), mRNA
CGGATGAGGGTCAGGGCTGCGCGGACCCCTATCCCGCCTGCGTCCTCCCGGCAAGCCCAGCGGGAGCGCC
CGCTCGGCTGGGTCCCCGCCTCCAGCGCGCCGGGCCGCCCAGACCCTGGGCTCAGCCTCGCGCCCCGGT
GCCCACCTGAGGAGGCGGCGGTCCCGGCCTCGCGTCCCGGATGGGACGGCGCGGGAGCAATGCCAGTGGC
CCCGAGCGCCCCCGGCCACGCGCGGGGCCGGCCAGCCGCTCTCGCGCCCCTCCCCGCCCCCCTCCGCGCCTT
GCCTCGCCGCCCGCGCCCCACCCACCGGCCGCTCCTCCCCTCTCCCACCCTCCTCCTCCGCCCCCTC
CCCTCCCCCGCCGCCTCGCAGATAGCTCGGCCGCGCGTCTCAGCCGCCGGGGCCCCGAGCGCAGGCGGCG
AGGCCACCACACCTGCAGAGCGCTCGGGCTGCCTAGGCGGCACCTCGCCTCCCGCCGCGCAAACCCCTTC
TCCCCACGCGCCGAGTCTCCCATGACGCCCGAGCCCCCCGGCCGGCGACAATGACCACTTCCCTGCAAGA FIGURE 79 cont'd

```
TGGGCAGAGCGCCGCGAGCAGGGCGGCTGCCCGGGATTCGCCGCTGGCCGCCCAGGTGTGTGGCGCTGCC
CAGGGGAGGGGCGACGCCCACGACCTGGCGCCGGCCCCCTGGCTGCACGCGCGAGCGCTCCTGCCCCTTC
CGGACGGGACCCGCGGCTGTGCTGCAGACAGGAGAAAAAAGAAAGATCTTGATGTTCCGGAAATGCCATC
TATTCCAAACCCTTTTCCTGAGCTATGCTGTTCTCCAATTACATCTGTGTTGTCAGCAGACCTATTTCCC
AAAGCAAATTCAAGGAAAAAACAGGTGATTAAAGTATACAGTGAAGATGAAACCAGCAGGGCTTTAGATG
TACCCAGTGACATAACGGCTCGAGATGTTTGTCAGCTGTTGATCCTGAAGAATCATTACATTGATGACCA
CAGCTGGACCCTTTTTGAGCACCTGCCTCACATAGGTGTAGAAAGAACAATAGAAGACCACGAACTGGTG
ATTGAAGTGCTATCCAACTGGGGGATAGAAGAAGAAAACAAACTATACTTTAGAAAAAATTATGCCAAAT
ATGAGTTCTTTAAAAACCCAATGTATTTTTTCCAGAGCATATGGTATCTTTTGCAACTGAAACCAATGG
TGAAATATCCCCCACACAGATTTTGCAGATGTTTCTGAGTTCAAGCACATATCCTGAAATTCATGGTTTC
TTACATGCGAAAGAACAGGGAAAGAAGTCTTGGAAAAAAATTTACTTTTTTCTAAGAAGATCTGGTTTAT
ATTTTTCTACTAAAGGAACATCAAAGGAACCGCGGCATTTGCAGTTTTTCAGCGAATTTGGCAATAGTGA
TATTTATGTGTCACTGGCAGGCAAAAAAAAACATGGAGCACCGACTAACTATGGATTCTGCTTTAAGCCT
AACAAAGCGGGAGGGCCCCGAGACCTGAAAATGCTCTGTGCAGAAGAAGAGCAGAGTAGGACGTGCTGGG
TGACCGCGATTAGATTGCTTAAGTATGGCATGCAGCTGTACCAGAATTATATGCATCCATATCAAGGTAG
AAGTGGCTGCAGTTCACAGAGCATATCACCTATGAGAAGTATATCAGAGAATTCCCTGGTAGCAATGGAC
TTCTCAGGCCAGAAAAGCAGAGTTATAGAAAATCCCACTGAGCCCTTTCAGTTGCGGTTGAAGAAGGAC
TCGCTTGGAGGAAAAAAGGATGTTTACGCCTGGGCACTCACGGTAGCCCCACTGCCTCTTCACAGAGCTC
TGCCACAAACATGGCTATCCACCGGTCCCAGCCATGGTTTCACCACAAAATTTCTAGAGATGAGGCTCAG
CGATTGATTATTCAGCAAGGACTTGTGGATGGAGTTTTCTTGGTACGGGATAGTCAGAGTAACCCCAAAA
CTTTCGTACTGTCAATGAGTCATGGACAAAAAATAAAGCACTTTCAAATTATACCAGTAGAAGATGACGG
TGAAATGTTCCACACACTGGATGATGGCCACACAAGATTTACAGATCTAATACAGCTGGTGGAGTTCTAT
CAACTCAATAAGGGCGTTCTTCCTTGCAAGTTGAAACATTATTGTGCTAGGATTGCTCTCTAGACAAGCC
AGAAGTGACTTATTAAACTATTGAAGGAAAAGGACTCAAGAAAAATAATAAAAGACCATAAATAAGGGCG
AAAACATTATCATGTGAAAAGAATGTATTTCACCTGCAAGTTACAAAAAAATAGTTTGTGCATTGCAAAT
AAGCAAAGACTTGGATTGACTTTACATTCATCATTTAAAATTCATTAGTTAAAATTAAACCTTAGG
```

FIGURE 80
SEQ ID NO: 72
Genbank ID      : NM_002407.1
Unigene ID(#167) : Hs.97644
Unigene name    :       secretoglobin, family 2A, member 1  SCGB2A1
>gi|4505170|ref|NM_002407.1| Homo sapiens secretoglobin, family 2A, member 1 (S
CGB2A1), mRNA

```
CCTCCACAGCAACTTCCTTGATCCCTGCCACGCACGACTGAACACAGACAGCAGCCGCCTCGCCATGAAG
CTGCTGATGGTCCTCATGCTGGCGGCCCTCCTCCTGCACTGCTATGCAGATTCTGGCTGCAAACTCCTGG
AGGACATGGTTGAAAAGACCATCAATTCCGACATATCTATACCTGAATACAAAGAGCTTCTTCAAGAGTT
CATAGACAGTGATGCCGCTGCAGAGGCTATGGGGAAATTCAAGCAGTGTTTCCTCAACCAGTCACATAGA
ACTCTGAAAAACTTTGGACTGATGATGCATACAGTGTACGACAGCATTTGGTGTAATATGAAGAGTAATT
AACTTTACCCAAGGCGTTTGGCTCAGAGGGCTACAGACTATGGCCAGAACTCATCTGTTGATTGCTAGAA
ACCACTTTTCTTTCTTGTGTTGTCTTTTTATGTGGAAACTGCTAGACAACTGTTGAAACCTCAAATTCAT
TTCCATTTCAATAACTAACTGCAAATC
```

FIGURE 81
SEQ ID NO: 73
Genbank ID      : NM_002036.1
Unigene ID(#167) : Hs.183
Unigene name    :       Duffy blood group FY
>gi|4503818|ref|NM_002036.1| Homo sapiens Duffy blood group (FY), mRNA

```
GGGCCTGAACCAAACGGTGCCATGGGGAACTGTCTGCACAGGGTGAGTATGGGGCCAGGCCCCAGAGTCC
CTTATCCCTATGCCCCTCATTTCCCCTGCTGTTTGCCCCTCAGTCTTTTATATCTCTTCCTTTTCCTCCTC
ATCTTTTCTCCCTTCCCGCTTTTTTCCTCTTCCTTCAAAGTCTTTTTCCTTCTCTCCTTCCTATGCTAGC
CTCCTAGCTCCCTCTTGTGTCCCTCCCTTTGCCTTTGAGTCAGTTCCATCCTGGTCTCTTGGTGCCTTTC
CTTCTGACCTTGCACTGCTCCTCCAGCCCCAGCTGCCCTGGCTTCCCAGGACTGTTCCTGCTCCGGCTC
TTCAGGCTCCCTGCTTTGTCCTTTTCCACTGTCCGCACTGCATCTGACTCCTGCAGAGACCTTGTTCTCC
CACCCGACCTTCCTCTCTGTCCTCCCCTCCCACCTGCCCCTCAATTCCCAGGAGACTCTTCCGGTGTAAC
TCTGATGGCCTCCTCTGGGTATGTCCTCCAGGCGGAGCTCTCCCCCTCAACTGAGAACTCAAGTCAGCTG
```

FIGURE 81 cont'd

```
GACTTCGAAGATGTATGGAATTCTTCCTATGGTGTGAATGATTCCTTCCCAGATGGAGACTATGATGCCA
ACCTGGAAGCAGCTGCCCCCTGCCACTCCTGTAACCTGCTGGATGACTCTGCACTGCCCTTCTTCATCCT
CACCAGTGTCCTGGGTATCCTAGCTAGCAGCACTGTCCTCTTCATGCTTTTCAGACCTCTCTTCCGCTGG
CAGCTCTGCCCTGGCTGGCCTGTCCTGGCACAGCTGGCTGTGGGCAGTGCCCTCTTCAGCATTGTGGTGC
CCGTCTTGGCCCCAGGGCTAGGTAGCACTCGCAGCTCTGCCCTGTGTAGCCTGGGCTACTGTGTCTGGTA
TGGCTCAGCCTTTGCCCAGGCTTTGCTGCTAGGGTGCCATGCCTCCCTGGGCCACAGACTGGGTGCAGGC
CAGGTCCCAGGCCTCACCCTGGGGCTCACTGTGGGAATTTGGGGAGTGGCTGCCCTACTGACACTGCCTG
TCACCCTGGCCAGTGGTGCTTCTGGTGGACTCTGCACCCTGATATACAGCACGGAGCTGAAGGCTTTGCA
GGCCACACACACTGTAGCCTGTCTTGCCATCTTTGTCTTGTTGCCATTGGGTTTGTTTGGAGCCAAGGGG
CTGAAGAAGGCATTGGGTATGGGGCCAGGCCCCTGGATGAATATCCTGTGGGCCTGGTTTATTTTCTGGT
GGCCTCATGGGGTGGTTCTAGGACTGGATTTCCTGGTGAGGTCCAAGCTGTTGCTGTTGTCAACATGTCT
GGCCCAGCAGGCTCTGGACCTGCTGCTGAACCTGGCAGAAGCCCTGGCAATTTTGCACTGTGTGGCTACG
CCCCTGCTCCTCGCCCTATTCTGCCACCAGGCCACCCGCACCCTCTTGCCCTCTCTGCCCCTCCCTGAAG
GATGGTCTTCTCATCTGGACACCCTTGGAAGCAAATCCTAGTTCTCTTCCCACCTGTCAACCTGAATTAA
AGTCTACACTGCCTTTGTG
```

FIGURE 82
SEQ ID NO: 74
Genbank ID         : AW242720
Unigene ID(#167)   : Hs.388347
Unigene name       :      MRNA; cDNA DKFZp686J0156 (from clone DKFZp686J0156)

>gi|6576565|gb|AW242720.1|AW242720 xm90c07.x1 NCI_CGAP_Kid11 Homo sapiens cDNA
clone IMAGE:2691468 3', mRNA sequence
```
TAAAAAAGAAAACAATGTTTATTAGGATATTCTGGGGTGAGAGGATGGCCAAAGGGACTATGTACATTCT
GTAGTGCTTGAGCAATAGGCTAACAGAAAATTCGAACATCACAAAACCACTTCCAAAGTCCATATTGCAA
AACTTGTACTTCTACAGGAGATGTTCTTCCAAGGGTGTTGGCAATAAAGGCTGTTGCAAAACAGCTATGT
GAGGCAGCCATGTGGGAGTGACCCAGGAGAATGCTCCGGTGTCCTCTGGAAAGCAGATACACAGGACGA
TGGACAAATGTGTCATCTTCTACCAGTGGGAAGCTCAGTAAACACACAATATAACATGGGAGACCCGCCC
GAAGCCTAACTGGAGGCTTCTCAACAAAGCTCAGTCGACCCCTCACCCCTGTTCCGAGGAGACTGGGTGT
CTGAACCCCTCACTCANGAATGAATTCTAAAAATACCCTAAAAATCAGAAGCCGCCTTCTACTCTACCGT
GCTATAAACCTGCATGAAACAGAACGAACATAAGCTGAAACACACCCTCGGGTTAAGAGTGAAAAATGCA
ACACCATC
```

FIGURE 83
SEQ ID NO: 75
Genbank ID         : NM_024636.1
Unigene ID(#167)   : Hs.44208
Unigene name       :      likely   ortholog   of   mouse   tumor   necrosis-alpha-
induced adipose-related protein         FLJ23153
>gi|13375867|ref|NM_024636.1| Homo sapiens tumor necrosis factor, alpha-induced
 protein 9 (TNFAIP9), mRNA
```
GCTGAGCTGCAGGCGCGGCGAAACTTCCCTCTACCCGCCCGGCCCGCGGCGCGCACCGTTGGCGCTGGAC
GCTTCCTCCTTGGAAGCGCCCTCTCCCTCAGTCATGGAGAAACTTGTATAGATGCACTTCCTCTTACTA
TGAATTCTTCAGAAAAGCAAGAGACTGTATGTATTTTGGAACTGGTGATTTGGAAGATCACTGGGATT
GAAAATGCTCCAGTGTGGTTATTCTGTTGTTTTTGGAAGTCGAAACCCCCAGAAGACCACCCTACTGCCC
AGTGGTGCAGAAGTCTTGAGCTATTCAGAAGCAGCCAAGAAGTCTGACATCATAATCATAGCAATCCACA
GAGAGCATTATGATTTTCTCACAGAATTAACTGAGGTTCTCAATGGAAAAATATTGGTAGACATCAGCAA
CAACCTCAAAATCAATCAATATCCAGAATCTAATGCAGAGTACCTTGCTCATTTGGTGCCAGGAGCCCAC
GTGGTAAAAGCATTTAACACCATCTCAGCCTGGGCTCTCCAGTCAGGAGCACTGGATGCAAGTCGGCAGG
TGTTTGTGTGTGGAAATGACAGCAAAGCCAAGCAAAGAGTGATGGATATTGTTCGTAATCTTGGACTTAC
TCCAATGGATCAAGGATCACTCATGGCAGCCAAAGAAATTGAAAAGTACCCCCTGCAGCTATTTCCAATG
TGGAGGTTCCCCTTCTATTTGTCTGCTGTGCTGTGTGTCTTCTTGTTTTTCTATTGTGTTATAAGAGACG
TAATCTACCCTTATGTTTATGAAAAGAAAGATAATACATTTCGTATGGCTATTTCCATTCCAAATCGTAT
CTTTCCAATAACAGCACCTTACACTGCTTGCTTTGGTTTACCTCCCTGGTGTTATTGCTGCCATTCTACA
ACTGTACCGAGGCACAAAATACCGTCGATTCCCAGACTGGCTTGACCACTGGATGCTTTGCCGAAAGCAG
```

FIGURE 83 cont'd

```
CTTGGCTTGGTAGCTCTGGGATTTGCCTTCCTTCATGTCCTCTACACACTTGTGATTCCTATTCGATATT
ATGTACGATGGAGATTGGGAAACTTAACCGTTACCCAGGCAATACTCAAGAAGGAGAATCCATTTAGCAC
CTCCTCAGCCTGGCTCAGTGATTCATATGTGGCTTTGGGAATACTTGGGTTTTTTCTGTTTGTACTCTTG
GGGAATCACTTCTTTGCCATCTGTTAGCAATGCAGTCAACTGGAGAGAGTTCCGATTTGTCCAGTCCAAA
CTGGGTTATTTGACCCTGATCTTGTGTACAGCCCACACCCTGGTGTACGGTGGGAAGAGATTCCTCAGCC
CTTCAAATCTCAGATGGTATCTTCCTGCAGCCTACGTGTTAGGGCTTATCATTCCTTGCACTGTGCTGGT
GATCAAGTTTGTCCTAATCATGCCATGTGTAGACAACACCCTTACAAGGATCCGCCAGGGCTGGGAAAGG
AACTCAAAACACTAGAAAAAGCATTGAATGGAAAATCAATATTTAAAACAAAGTTCAATTTAGCTGGATT
TCTGAACTATGGTTTTGAATGTTTAAAGAAGAATGATGGGTACAGTTAGGAAAGTTTTTTTCTTACACCG
TGACTGAGGGAAACATTGCTTGTCTTTGAGAAATTGACTGACATACTGGAAGAGAACACCATTTTATCTC
AGGTTAGTGAAGAATCAGTGCAGGTCCCTGACTCTTATTTTCCCAGAGGCCATGGAGCTGAGATTGAGAC
TAGCCTTGTGGTTTCACACTAAAGAGTTTCCTTGTTATGGGCAACATGCATGACCTAATGTCTTGCAAAA
TCCAATAGAAGTATTGCAGCTTCCTTCTCTGGCTCAAGGGCTGAGTTAAGTGAAAGGAAAAACAGCACAA
TGGTGACCACTGATAAAGGCTTTATTAGGTATATCTGAGGAAGTGGGTCACATGAAATGTAAAAAGGGAA
TGAGGTTTTTGTTGTTTTTGGAAGTAAAGGCAAACATAAATATTACCATGATGAATTCTAGTGAAATGA
CCCCTTGACTTTGCTTTTCTTAATACAGATATTTACTGAGAGGAACTATTTTTATAACACAAGAAAAATT
TACAATTGATTAAAAGTATCCATGTCTTGGATACATACGTATCTATAGAGCTGGCATGTAATTCTTCCTC
TATAAAGAATAGGTATAGGAAAGACTGAATAAAAATGGAGGGATATCCCCTTGGATTTCACTTGCATTGT
GCAATAAGCAAAGAAGGGTTGATAAAAGTTCTTGATCAAAAAGTTCAAAGAAACCAGAATTTTAGACAGC
AAGCTAAATAAATATTGTAAAATTGCACTATATAGGTTAAGTATTATTTAGGTATTATAATATGCTTTG
TAAATTTTATATTCCAAATATTGCTCAATATTTTTCATCTATTAAATTAATTTCTAGTGTAAAAAAAAAA
AAAAAAAAAAA
```

FIGURE 84
SEQ ID NO: 76
Genbank ID        : BE514414
Unigene ID(#167)  : Hs.103305
Unigene name      :      MRNA; cDNA DKFZp434B0425 (from clone DKFZp434B0425)

>gi|9721627|gb|BE514414.1|BE514414 601315624F1 NIH_MGC_8 Homo sapiens cDNA clon
e IMAGE:3634421 5', mRNA sequence
```
ACTTACGGCTAGGTACGAGGCTGGGTGGTGGTCCATGGCTTCGTTGAGGGCCATCCATATGCCAGCTGGG
GGCCAGCCCACAGTGGCCATATGGCTGCAGCAGGAATGGTGCCCACCTCGGCGAATTGAAGGGCTAAGAG
TCCCAGATAGCTAGGCCAGAGCTGGAAGCAGACAGTAAGGGGAAGAGCTGCTCCCACAGGAGAGGGAGAG
ATTCCAGCTCACTGCGCAGCCTGGGAGGAGGCGTGGATCCTGGCACGCTGAGCCTCAGGCACCAGCCTCC
CTGTGCTCGACAGCAAAGTCTTGACTCCTTCCTGCTGAGCACTGTGCTACCTTCACTGCTCCAAAGCCAG
ACTAACAGCTCTCCAAGCCCTTGGGGTGACTCGGCTTCCAGGAGCTGTTGGAGAAATGAGGATGTCTGTC
CCTGTCTGCCTGGGCAGGCCAGATTCCTCCCCAGCAGCCGGGTCTCTCCAGACCCTGATTCGGTGCCTTT
CTGTTTACCAGCTACTTCAATCCCAAAGTTTGAATCTGCAGATACCTTACTCCCAGCCACTTTGCCTTCT
TACTGTGNTGTGTGTTTTCCTGGTGCTTCAAGAGCGTGTGCAGGGCAAGTGCCGTCACTGGGAACTGCA
CCAGATGCTCAGACTTGGTTGTCTTATGTTTACCANTAAATAAAGTAGACTTTTTACACCAAACCAACAT
CCAAAAAAAAACCCGGGGGCAAAATGGGGGGGGGACAAAGGGG
```

FIGURE 85
SEQ ID NO: 77
Genbank ID        : NM_003318.1
Unigene ID(#167)  : Hs.169840
Unigene name      :      TTK protein kinase        TTK
>gi|4507718|ref|NM_003318.1| Homo sapiens TTK protein kinase (TTK), mRNA
```
GGAATTCCTTTTTTTTTTTTTTGAGATGGAGTTTCACTCTTGTTGGCCAGGCTGGAGTGCAATGGCACA
ATCTCAGCTTACTGCAACCTCCGCCTCCCGGGTTCAAGCGATTCTCCTGCCTCAGCCTCTCAAGTAGCTG
GGATTACAGGCATGTGCCACCACCCCTGGCTAACTAATTTCTTTTCTATTTAGTAGAGATGGGGTTTCAC
CATGTTGGTCAGGCTGGTCTTGAACTCCTGACCTCAGGTGATCCACTTGCCTTGGCCTCCCAAAGTGCTA
GGATTACAGCCGTGAAACTGTGCCTGGCTGATTCTTTTTTTGTTGTTGGATTTTTGAAACAGGGTCTCCC
```

FIGURE 85 cont'd

```
TTGGTCGCCCAGGCTGGAGTGCAGTGGTGCGATCTTGGCTCACTATAACCTCCACCTCCTGGTTTCAAGT
GATCCTCCCACTTTAGCCTCCTGAGTAGCTGTGATTACAGGCGTGCACCACCACACCCGGCTAATTTTTG
TATTTTTATTAGAGACAGGGTTTCACCATGTTGGCCAGGCTGTTCTCAAACTCCTGGACTCAAGGGATCC
GCCTGCCTCCACTTCCCAAAGTCCCGAGATTACAGGTGTGAGTCACCATGCCTGACCTTATAATTCTTAA
GTCATTTTTTCTGGTCCATTTCTTCCTTAGGGTCCTCACAACAAATCTGCATTAGGCGGTACAATAATCC
TTAACTTCATGATTCACAAAAGGAAGATGAAGTGATTCATGATTTAGAAAGGGGAAGTAGTAAGCCCACT
GCACACTCCTGGATGATGATCCTAAATCCAGATACAGTAAAAATGGGGTATGGGAAGGTAGAATACAAAA
TTTGGTTTAAATTAATTATCTAAATATCTAAAAACATTTTTGGATACATTGTTGATGTGAATGTAAGACT
GTACAGACTTCCTAGAAAACAGTTTGGGTTCCATCTTTTCATTTCCCCAGTGCAGTTTTCTGTAGAAATG
GAATCCGAGGATTTAAGTGGCAGAGAATTGACAATTGATTCCATAATGAACAAAGTGAGAGACATTAAAA
ATAAGTTTAAAAATGAAGACCTTACTGATGAACTAAGCTTGAATAAAATTTCTGCTGATACTACAGATAA
CTCGGGAACTGTTAACCAAATTATGATGATGGCAAACAACCCAGAGGACTGGTTGAGTTTGTTGCTCAAA
CTAGAGAAAAACAGTGTTCCGCTAAGTGATGCTCTTTTAAATAAATTGATTGGTCGTTACAGTCAAGCAA
TTGAAGCGCTTCCCCCAGATAAATATGGCCAAAATGAGAGTTTTGCTAGAATTCAAGTGAGATTTGCTGA
ATTAAAAGCTATTCAAGAGCCAGATGATGCACGTGACTACTTTCAAATGGCCAGAGCAAACTGCAAGAAA
TTTGCTTTTGTTCATATATCTTTTGCACAATTTGAACTGTCACAAGGTAATGTCAAAAAAAGTAAACAAC
TTCTTCAAAAAGCTGTAGAACGTGGAGCAGTACCACTAGAAATGCTGGAAATTGCCCTGCGGAATTTAAA
CCTCCAAAAAAAGCAGCTGCTTTCAGAGGAGGAAAAGAAGAATTTATCAGCATCTACGGTATTAACTGCC
CAAGAATCATTTTCCGGTTCACTTGGGCATTTACAGAATAGGAACAACAGTTGTGATTCCAGAGGACAGA
CTACTAAAGCCAGGTTTTTATATGGAGAGAACATGCCACCACAAGATGCAGAAATAGGTTACCGGAATTC
ATTGAGACAAACTAACAAAACTAAACAGTCATGCCCATTTGGAAGAGTCCCAGTTAACCTTCTAAATAGC
CCAGATTGTGATGTGAAGACAGATGATTCAGTTGTACCTTGTTTTATGAAAAGACAAACCTCTAGATCAG
AATGCCGAGATTTGGTTGTGCCTGGATCTAAACCAAGTGGAAATGATTCCTGTGAATTAAGAAATTTAAA
GTCTGTTCAAAATAGTCATTTCAAGGAACCTCTGGTGTCAGATGAAAAGAGTTCTGAACTTATTATTACT
GATTCAATAACCCTGAAGAATAAAACGGAATCAAGTCTTCTAGCTAAATTAGAAGAAACTAAAGAGTATC
AAGAACCAGAGGTTCCAGAGAGTAACCAGAAACAGTGGCAAGCTAAGAGAAAGTTCAGAGTGTATTAACCA
GAATCCTGCTGCATCTTCAAATCACTGGCAGATTCCGGAGTTAGCCCGAAAAGTTAATACAGAGCAGAAA
CATACCACTTTTGAGCAACCTGTCTTTTCAGTTTCAAAACAGTCACCACCAATATCAACATCTAAATGGT
TTGACCCAAAATCTATTTGTAAGACACCAAGCAGCAATACCTTGGATGATTACATGAGCTGTTTTAGAAC
TCCAGTTGTAAAGAATGACTTTCCACCTGCTTGTCAGTTGTCAACACCTTATGGCCAACCTGCCTGTTTC
CAGCAGCAACAGCATCAAATACTTGCCACTCCACTTCAAAATTTACAGGTTTTAGCATCTTCTTCAGCAA
ATGAATGCATTTCGGTTAAAGGAAGAATTTATTCCATATTAAAGCAGATAGGAAGTGGAGGTTCAAGCAA
GGTATTTCAGGTGTTAAATGAAAAGAAACAGATATATGCTATAAAATATGTGAACTTAGAAGAAGCAGAT
AACCAAACTCTTGATAGTTACCGGAACGAAATAGCTTATTTGAATAAACTACAACAACACAGTGATAAGA
TCATCCGACTTTATGATTATGAAATCACGGACCAGTACATCTACATGGTAATGGAGTGTGGAAATATTGA
TCTTAATAGTTGGCTTAAAAAGAAAAAATCCATTGATCCATGGGAACGCAAGAGTTACTGGAAAAATATG
TTAGAGGCAGTTCACACAATCCATCAACATGGCATTGTTCACAGTGATCTTAAACCAGCTAACTTTCTGA
TAGTTGATGGAATGCTAAAGCTAATTGATTTTGGGATTGCAAACCAAATGCAACCAGATACAACAAGTGT
TGTTAAAGATTCTCAGGTTGGCACAGTTAATTATATGCCACCAGAAGCAATCAAAGATATGTCTTCCTCC
AGAGAGAATGGGAAATCTAAGTCAAAGATAAGCCCCAAAAGTGATGTTTGGTCCTTAGGATGTATTTTGT
ACTATATGACTTACGGGAAAACACCATTTCAGCAGATAATTAATCAGATTTCTAAATTACATGCCATAAT
TGATCCTAATCATGAAATTGAATTTCCCGATATTCCAGAGAAAGATCTTCAAGATGTGTTAAAGTGTTGT
TTAAAAAGGGACCCAAAACAGAGGATATCCATTCCTGAGCTCCTGGCTCATCCATATGTTCAAATTCAAA
CTCATCCAGTTAACCAAATGGCCAAGGGAACCACTGAAGAAATGAAATATGTTCTGGGCCAACTTGTTGG
TCTGAATTCTCCTAACTCCATTTTGAAAGCTGCTAAAACTTTATATGAACACTATAGTGGTGGTGAAAGT
CATAATTCTTCATCCTCCAAGACTTTTGAAAAAAAAGGGGAAAAAAATGATTTGCAGTTATTCGTAATG
TCAGATAGGAGGTATAAAATATATTGGACTGTTATACTCTTGAATCCCTGTGGAAATCTACATTTGAAGA
CAACATCACTCTGAAGTGTTATCAGCAAAAAAAATTCAGTGAGATTATCTTTAAAAGAAAACTGTAAAAA
TAGCAACCACTTATGGCACTGTATATATTGTAGACTTGTTTTCTCTGTTTTATGCTCTTGTGTAATCTAC
TTGACATCATTTTACTCTTGGAATAGTGGGTGGATAGCAAGTATATTCTAAAAAACTTTGTAAATAAAGT
TTTGTGGCTAAAATGA
```

FIGURE 86
SEQ ID NO: 78
Genbank ID     : NM_001853.1
Unigene ID(#167) : Hs.126248
Unigene name   :      collagen, type IX, alpha 3    COL9A3
>gi|4502966|ref|NM_001853.1| Homo sapiens collagen, type IX, alpha 3
(COL9A3),
mRNA FIGURE 86 cont'd

```
ATGGCCGGGCCGCGCGCGTGCGCGCCGCTCCTGCTCCTGCTCCTCCTCGGGCAGCTTCTGGCGGCCGCCG
GGGCGCAGAGAGTGGGACTCCCCGGCCCCCCGGCCCCCAGGGCGCCCTGGGAAGCCCGGCCAGGACGG
CATTGACGGAGAAGCTGGTCCTCCAGGTCTGCCTGGTCCCCGGGACCAAAGGGGGCCCCAGGAAAGCCG
GGGAAACCAGGAGAGGCTGGGCTGCCGGGACTGCCGGGTGTGGATGGTCTGACTGGACGAGATGGACCCC
CTGGACCCAAGGGTGCCCCTGGGGAACGGGGAAGTCTGGGACCCCCGGGGCCGCCCGGGCTGGGGGGCAA
AGGCCTCCCTGGACCCCCGGAGAGGCAGGAGTGAGCGGCCCCCAGGTGGGATCGGCCTCCGCGGCCCC
CCGGGACCTCCTGGACTCCCCGGCCTCCCTGGTCCCCAGGACCTCCCGGACCCCCTGGACACCCAGGAG
TCCTCCCTGAAGGCGCTACTGACCTTCAGTGCCCAAGTATCTGCCCGCCAGGTCCCCAGGGCCCCCTGG
AATGCCAGGGTTCAAGGGACCCACTGGCTACAAAGGCGAGCAGGGGGAAGTCGGCAAGGACGGCGAGAAG
GGTGACCCTGGCCCCCTGGGCCCGCCGGCCTCCCGGGCAGCGTGGGGCTGCAGGGCCCCGGGGATTAC
GAGGACTGCCAGGGCCACTCGGGCCCCTGGGGACCGGGGTCCCATTGGGTTCCGAGGGCCGCCTGGGAT
CCCAGGAGCGCCTGGGAAAGCGGGTGACCGAGGCGAGAGGGGCCCAGAAGGGGTTCCGCGGCCCCAAGGGT
GACCTCGGCAGACCTGGTCCCAAGGGAACCCCCGGAGTGGCCGGGCCAAGCGGAGAGCCGGGCATGCCAG
GCAAGGACGGCCAGAATGGCGTGCCAGGACTCGATGGCCAGAAGGGAGAGGCTGGTCGCAACGGTGCTCC
GGGAGAGAAGGGCCCCAACGGGCTGCCGGGCCTCCCTGGACGAGCGGGGTCCAAAGGCGAGAAGGGAGAA
CGGGGCAGAGCTGGGGAGCTGGGTGAGGCCGGCCCCTCTGGAGAGCCAGGCGTCCCTGGAGATGCTGGCA
TGCCTGGGGAGCGCGGTGAGGCTGGCCACCGGGGCTCAGCGGGGGCCCTCGGCCCACAAGGCCCTCCCGG
AGCCCCTGGTGTCCGAGGCTTCCAGGGCCAGAAGGGCAGCATGGGAGACCCCGGCCTTCCAGGCCCCCAG
GGCCTCCGAGGTGACGTGGGCGACCGGGTCCGGGAGGTGCCGAAGGCCCTAAGGGAGACCAGGGTATTG
CAGGTTCCGACGGTCTTCCTGGGGATAAAGGAGAACTGGGTCCCAGCGGCCTGGTCGGACCCAAAGGAGA
GTCTGGCAGTCGAGGGGAGCTGGGCCCCAAAGGCACCCAGGGTCCCAACGGCACCAGCGGTGTTCAGGGT
GTCCCCGGGCCCCCGGTCCTCTGGGCCTGCAGGGCGTCCCGGGTGTTCCTGGCATCACGGGGAAGCCGG
GAGTTCCGGGGAAGGAGGCCAGCGAGCAGCGCATCAGGGAGCTGTGTGGGGGATGATCAGCGAACAAAT
TGCACAGTTAGCCGCGCACCTAAGGAAGCCTTTGGCACCCGGGTCCATTGGTCGGCCCGGTCCAGCTGGC
CCCCCTGGGCCCCAGGACCCCCAGGCTCCATTGGTCACCCTGGCGCTCGAGGACCCCCCGGATACCGCG
GTCCCACTGGGGAGCTGGGAGACCCCGGGCCCAGAGGAAACCAGGGTGACAGAGGAGACAAAGGCGCGGC
AGGAGCAGGGCTGGACGGGCCTGAAGGAGACCAGGGGCCCCAAGGACCCCAAGGCGTGCCCGGCACCAGC
AAGGACGGCCAGGACGGTGCTCCCGGCGAGCCTGGGCCTCCCGGAGATCCTGGGCTTCCAGGTGCCATTG
GGGCCCAGGGGACACCGGGGATCTGCGACACCTCAGCCTGCCAAGGAGCCGTGTTAGGAGGGGTCGGGGA
GAAATCAGGCTCTCGAAGCTCATAAAATTCAACGTGAGGAAGCAAGTGACAAGGACGCCCGAAGCACAGT
GGACGGTCATGAAGGAGCGGGGGTGTGGCAGGCGGGTGACGTCCAGGAGAGGGAGCGCCCCTGGCTGCCC
CTCGGCCGCCGACTGGACGCGTGGGCCTTGCCAGCGAGCACCCTCATTGGGCTGTCGCCTGACAGCATAC
CTCAAAAGGCCCTAGCTAATAAACCTGTAAGCCCAGCATTTGAGAGAAGGTAGGGTGTGTATATATAAAA
GGTTGTGTACAACTCCACGAGGTGAAAAATATTCAGTAACTTGTTTGCATAGCATTTGTGTAAAGACTAT
GATCTCATCCCAATAAATGATATATTAAATCTTCAGATTAATGACTGGCTACAGAGTAACAAAAAATAA
ACAATTTAATGTACAGTAAATTCTCTCCCA
```

FIGURE 87
SEQ ID NO: 79
Genbank ID     : NM_013296.1
Unigene ID(#167) : Hs.278338
Unigene name   :     G-protein  signalling  modulator  2  (AGS3-like,  C. elegans)    GPSM2
>gi|9558734|ref|NM_013296.1| Homo sapiens LGN protein (LGN), mRNA

```
GGCACGAGGAAGAATCAGGAGCTTAGGATGTATTAACACCAACTCATTAATATACTAACCGGACAATGTT
CTACAAACAATTCTACATTGTAAAGGACTGGATTGGCACAAAATAAAATAATTTTATTTTATTCAGCTTA
TAATATGACTCGATGGAGGAAAATTTGATAAGCATGAGAGAAGACCATTCTTTTCATGTTCGTTACAGAA
TGGAAGCTTCTTGCCTAGAGCTGGCCTTGGAAGGGAACGTCTATGTAAATCAGGAGACTGCCGCGCTGG
CGTGTCATTCTTTGAAGCTGCAGTTCAAGTTGGAACTGAAGACCTAAAAACACTTAGCGCTATTTACAGC
CAGTTGGGCAATGCTTATTTCTATTTGCATGATTATGCCAAAGCATTAGAATATCACCATCATGATTTAA
CCCTTGCAAGGACTATTGGAGACCAGCTGGGGGAAGCGAAAGCTAGTGGTAATCTGGGAAACACCTTAAA
AGTTCTTGGGAATTTTGACGAAGCCATAGTTTGTTGTCAGCGACACCTAGATATTTCCAGAGAGCTTAAT
GACAAGGTGGGAGAAGCAAGAGCACTTTACAATCTTGGGAATGTGTATCATGCCAAAGGGAAAAGTTTTG
GTTGCCCTGGTCCCCAGGATGTAGGAGAATTTCCAGAAGAAGTGAGAGATGCTCTGCAGGCAGCCGTGGA
TTTTTATGAGGAAAACCTATCATTAGTGACTGCTTTGGGTGACCGAGCGGCACAAGGACGTGCCTTTGGA
AATCTTGGAAACACACATTACCTCCTTGGCAACTTCAGGGATGCAGTTATAGCTCATGAGCAGCGTCTCC
TTATTGCAAAAGAATTTGGAGATAAAGCAGCTGAAAGAAGAGCATATAGCAACCTTGGAAATGCATATAT
ATTTCTTGGTGAATTTGAAACTGCCTCGGAATACTACAAGAAGACACTACTGTTGGCCCGACAGCTTAAA
GACCGAGCTGTAGAAGCACAGTCTTGTTACAGTCTTGGAAATACATATACTTTACTTCAAGACTATGAAA
AGGCCATTGATTATCATCTGAAGCACTTAGCAATTGCTCAAGAGCTGAATGATAGAATTGGTGAAGGAAG
```

FIGURE 87 cont'd

```
AGCATGTTGGAGCTTAGGAAATGCATACACAGCACTAGGAAATCATGATCAAGCAATGCATTTTGCTGAA
AAGCACTTGGAAATTTCAAGAGAGGTTGGGGATAAAAGTGGTGAACTAACAGCACGACTTAATCTCTCAG
ACCTTCAAATGGTTCTTGGTCTGAGCTACAGCACAAATAACTCCATAATGTCTGAAAATACTGAAATTGA
TAGCAGTTTGAATGGTGTACTCCCCAAGTTGGGACGCCGGCATAGTATGGAAAATATGGAACTTATGAAG
TTAACACCAGAAAAGGTACAGAACTGGAACAGTGAAATTCTTGCTAAGCAAAAACCTCTTATTGCCAAAC
CTTCTGCAAAGCTACTCTTTGTCAACAGACTGAAGGGGAAAAAATACAAAACGAATTCCTCCACTAAAGT
TCTCCAAGATGCCAGTAATTCTATTGACCACCGAATTCCAAATTCTCAGAGGAAAATCAGTGCAGATACT
ATTGGAGATGAAGGGTTCTTTGACTTATTAAGCCGATTTCAAAGCAATAGGATGGATGATCAGAGATGTT
GCTTACAAGAAAAGAACTGCCATACAGCTTCAACAACAACTTCTTCCACTCCCCCTAAAATGATGCTAAA
AACATCATCTGTTCCTGTGGTATCCCCCAACACGGATGAGTTTTTAGATCTTCTTGCCAGCTCACAGAGT
CGCCGTCTGGATGACCAGAGGGCTAGTTTCAGTAATTTGCCAGGGCTTCGTCTAACACAAAACAGCCAGT
CGGTACTTAGCCACCTGATGACTAATGACAACAAAGAGGCTGATGAAGATTTCTTTGACATCCTTGTAAA
ATGTCAAGGATCCAGATTAGATGATCAAAGATGTGCTCCACCACCTGCTACCACAAAGGGTCCGACAGTA
CCAGATGAAGACTTTTTCAGCCTTATTTACGGTCCCAGGGAAAGAGAATGGATGAACAGAGAGTTCTTT
TACAAAGAGATCAAAACAGAGACACTGACTTTGGGCTAAAGGACTTTTTGCAAAATAATGCTTTGTTGGA
GTTTAAAAATTCAGGGAAAAAATCGGCAGACCATTAGTTACTATGGATTTATTTTTTTCCTTTCAAACA
CGGTAAGGAAACAATCTATTACTTTTTTCCTTAAAAGGAGAATTTATAGCACTGTAATACAGCTTAAAAT
ATTTTTAGAATGATGTAAATAGTTAA
```

FIGURE 88
SEQ ID NO: 80
```
Genbank ID        : U20350.1
Unigene ID(#167)  : Hs.78913
Unigene name      :       chemokine (C-X3-C motif) receptor 1 CX3CR1
>gi|665580|gb|U20350.1|HSU20350 Human G protein-coupled receptor V28 mRNA,
comp
lete cds
ACTCGTCTCTGGTAAAGTCTGAGCAGGACAGGGTGGCTGACTGGCAGATCCAGAGGTTCCCTTGGCAGTC
CACGCCAGGCCTTCACCATGGATCAGTTCCCTGAATCAGTGACAGAAAACTTTGAGTACGATGATTTGGC
TGAGGCCTGTTATATTGGGGACATCGTGGTCTTTGGGACTGTGTTCCTGTCCATATTCTACTCCGTCATC
TTTGCCATTGGCCTGGTGGGAAATTTGTTGGTAGTGTTTGCCCTCACCAACAGCAAGAAGCCCAAGAGTG
TCACCGACATTTACCTCCTGAACCTGGCCTTGTCTGATCTGCTGTTTGTAGCCACTTTGCCCTTCTGGAC
TCACTATTTGATAAATGAAAAGGGCCTCCACAATGCCATGTGCAAATTCACTACCGCCTTCTTCTTCATC
GGCTTTTTTGGAAGCATATTCTTCATCACCGTCATCAGCATTGATAGGTACCTGGCCATCGTCCTGGCCG
CCAACTCCATGAACAACCGGACCGTGCAGCATGGCGTCACCATCAGCCTAGGCGTCTGGGCAGCAGCCAT
TTTGGTGGCAGCACCCCAGTTCATGTTCACAAAGCAGAAAGAAAATGAATGCCTTGGTGACTACCCCGAG
GTCCTCCAGGAAATCTGGCCCGTGCTCCGCAATGTGGAAACAAATTTTCTTGGCTTCCTACTCCCCCTGC
TCATTATGAGTTATTGCTACTTCAGAATCATCCAGACGCTGTTTTCCTGCAAGAACCACAAGAAAGCCAA
AGCCATTAAACTGATCCTTCTGGTGGTCATCGTGTTTTTCCTCTTCTGGACACCCTACAACGTTATGATT
TTCCTGGAGACGCTTAAGCTCTATGACTTCTTTCCCAGTTGTGACATGAGGAAGGATCTGAGGCTGGCCC
TCAGTGTGACTGAGACGGTTGCATTTAGCCATTGTTGCCTGAATCCTCTCATCTATGCATTTGCTGGGGA
GAAGTTCAGAAGATACCTTTACCACCTGTATGGGAAATGCCTGGCTGTCCTGTGTGGGCGCTCAGTCCAC
GTTGATTTCTCCTCATCTGAATCACAAAGGAGCAGGCATGGAAGTGTTCTGAGCAGCAATTTTACTTACC
ACACGAGTGATGGAGATGCATTGCTCCTTCTCTGAAGGGAATCCCAAAGCCTTGTGTCTACAGAGAACCT
GGAGTTCCTGAACCTGATGCTGACTAGTGAGGAAAGATTTTTGTTGTTATTTCTTACAGGCACAAAATGA
TGGACCCAATGCACACAAAACAACCCTAGAGTGTTGTTGAGAATTGTGCTCAAAATTTGAAGAATGAACA
AATTGAACTCTTTGAATGACAAAGAGTAGACATTTCTCTTACTGCAAATGTCATCAGAACTTTTTGGTTT
GCAGATGACAAAAATTCAACTCGAGACTAGTTTAGTTAAATGAGGGTGGTGAATATTGTTCATATTGTGGC
ACAAGCAAAAGGGTGTCTGAGCCCTCAAAGTGAGGGGAAACCAGGGCCTGAGCCAAGCTAGAATTCCCTC
TCTCTGACTCTCAAATCTTTTAGTCATTATAGATCCCCCAGACTTTACATGACACAGCTTTATCACCAGA
GAGGGACTGACACCCATGTTTCTCTGGCCCCAAGGGAAAATTCCCAGGGAAGTGCTCTGATAGGCCAAGT
TTGTATCAGGTGCCCATCCCTGGAAGGTGCTGTTATCCATGGGGAAGGGATATATAAGATGGAAGCTTCC
AGTCCAATCTCATGGAGAAGCAGAAATACATATTTCCAAGAAGTTGGATGGGTGGTACTATTCTGATTA
CACAAAACAAATGCCACACATCACCCTTACCATGTGCCTGATCCAGCCTCTCCCCTGATTACACCAGCCT
CGTCTTCATTAAGCCCTCTTCCATCATGTCCCAAACCTGCAAGGGCTCCCCACTGCCTACTGCATCGAG
TCAAAACTCAAATGCTTGGCTTCTCATACGTCCACCATGGGGTCCTACCAATAGATTCCCCATTGCCTCC
TCCTTCCCAAAGGACTCCACCCATCCTATCAGCCTGTCTCTTCCATATGACCTCATGCATCTCCACCTGC
TCCCAGGCCAGTAAGGGAAATAGAAAAACCCTGCCCCCAAATAAGAAGGGATGGATTCCAACCCCAACTC
CAGTAGCTTGGGACAAATCAAGCTTCAGTTTCCTGGTCTGTAGAAGAGGGATAAGGTACCTTTCACATAG
AGATCATCCTTTCCAGCATGAGGAACTAGCCACCAACTCTTGCAGGTCTCAACCCTTTTGTCTGCCTCTT
```

FIGURE 88 cont'd

```
AGACTTCTGCTTTCCACACCTGCACTGCTGTGCTGTGCCCAAGTTGTGGTGCTGACAAAGCTTGGAAGAG
CCTGCAGGTGCCTTGGCCGCGTGCATAGCCCAGACACAGAAGAGGCTGGTTCTTACGATGGCACCCAGTG
AGCACTCCCAAGTCTACAGAGTGATAGCCTTCCGTAACCCAACTCTCCTGGACTGCCTTGAATATCCCCT
CCCAGTCACCTTGTGCAAGCCCCTGCCCATCTGGGAAAATACCCCATCATTCATGCTACTGCCAACCTGG
GGAGCCAGGGCTATGGGAGCAGCTTTTTTTTCCCCCCTAGAAACGTTTGGAACAATGTAAAACTTTAAAG
CTCGAAAACAATTGTAATAATGCTAAAGAAAAAGTCATCCAATCTAACCACATCAATATTGTCATTCCTG
TATTCACCCGTCCAGACCTTGTTCACACTCTCACATGTTTAGAGTTGCAATCGTAATGTACAGATGGTTT
TATAATCTGATTTGTTTTCCTCTTAACGTTAGACCACAAATAGTGCTCGCTTTCTATGTAGTTTGGTAAT
TATCATTTTAGAAGACTCTACCAGACTGTGTATTCATTGAAGTCAGATGTGGTAACTGTTAAATTGCTGT
GTATCTGATAGCTCTTTGGCAGTCTATATGTTTGTATAATGAATGAGAGAATAAGTCATGTTCCTTCAAG
ATCATGTACCCCAATTTACTTGCCATTACTCAATTGATAAACATTTAACTTGTTTCCAATGTTTAGCAAA
TACATATTTTATAGAACTTC
```

FIGURE 89
SEQ ID NO: 81

```
Genbank ID        : AF326731.1
Unigene ID(#167)  : Hs.234545
Unigene name      :      cell division cycle associated 1    CDCA1
>gi|12667400|gb|AF326731.1|AF326731 Homo sapiens NUF2R mRNA, complete cds
GGCACGAGGGCAAGTTTGAAAAGTGATGACGGTTGACGTTTGCTGATTTTTGACTTTGCTTGTAGCTGCT
CCCCGAACTCGCCGTCTTCCTGTCGGCGGCCGGCACTGTAGATTAACAGGAAACTTCCAAGATGGAAACT
TTGTCTTTCCCCAGATATAATGTAGCTGAGATTGTGATTCATATTCGCAATAAGATCTTAACAGGAGCTG
ATGGTAAAAACCTCACCAAGAATGATCTTTATCCAAATCCAAAGCCTGAAGTCTTGCACATGATCTACAT
GAGAGCCTTACAAATAGTATATGGAATTCGACTGGAACATTTTTACATGATGCCAGTGAACTCTGAAGTC
ATGTATCCACATTTAATGGAAGGCTTCTTACCATTCAGCAATTTAGTTACTCATCTGGACTCATTTTTGC
CTATCTGCCGGGTGAATGACTTTGAGACTGCTGATATTCTATGTCCAAAAGCAAACGGACAAGTCGGTT
TTTAAGTGGCATTATCAACTTTATTCACTTCAGAGAAGCATGCCGTGAAACGTATATGGAATTTCTTTGG
CAATATAAATCCTCTGCGGACAAAATGCAACAGTTAAACGCCGCACACCAGGAGGCATTAATGAAACTGG
AGAGACTTGATTCTGTTCCAGTTGAAGAGCAAGAAGAGTTCAAGCAGCTTTCAGATGGTATTCAGGAGCT
ACAACAATCACTAAATCAGGATTTTCATCAAAAAACGATAGTGCTGCAAGAGGGAAATTCCCAAAAGAAG
TCAAATATTTCAGAGAAAACCAAGCGTTTGAATGAACTAAAATTGTTGGTGGTTTCTTTGAAAGAAATAC
AAGAGAGTTTGAAAACAAAAATTGTGGATTCTCCAGAGAAGTTAAAGAATTATAAAGAAAAAATGAAAGA
TACGGTCCAGAAGCTTAAAAATGCCAGACAAGAAGTGGTGGAGAAATATGAAATCTATGGAGACTCAGTT
GACTGCCTGCCTTCATGTCAGTTGGAAGTGCAGTTATATCAAAAGAAAATACAGGACCTTTCAGATAATA
GGGAAAAATTAGCCAGTATCTTAAAGGAGAGCCTGAACTTGGAGGACCAAATTGAGAGTGATGAGTCAGA
ACTGAAGAAATTGAAGACTGAAGAAAATTCGTTCAAAAGACTGATGATTGTGAAGAAGGAAAAACTTGCC
ACAGCACAATTCAAAATAAATAAGAAGCATGAAGATGTTAAGCAATACAAACGCACAGTAATTGAGGATT
GCAATAAAGTTCAAGAAAAAAGAGGTGCTGTCTATGAACGAGTAACCACAATTAATCAAGAAATCCAAAA
AATTAAACTTGGAATTCAACAACTAAAAGATGCTGCTGAAAGGGAGAAACTGAAGTCCCAGGAAATATTT
CTAAACTTGAAAACTGCTTTGGAGAAATACCACGACGGTATTGAAAAGGCAGCAGAGGACTCCTATGCTA
AGATAGATGAGAAGACAGCTGAACTGAAGAGGAAGATGTTCAAAATGTCAACCTGATTAACAAAATTACA
TGTCTTTTTGTAAATGGCTTGCCATCTTTTAATTTTCTATTTAGAAAGAAAAGTTGAAGCGAATGGAAGT
ATCAGAAGTACCAAATAATGTTGGCTTCATCAGTTTTTATACACTCTCATAAGTAGTTAATAAGATGAAT
TTAATGTAGGCTTTTATTAATTTATAATTAAAATAACTTGTGCAGCTATTCATGTCTCTACTCTGCCCCT
TGTTGTAAATAGTTTGAGTAAAACAAAACTAGTTACCTTTGAAATATATATATTTTTTTCTGTTAAAAAA
AAAAAAAAAAAAAAA
```

FIGURE 90
SEQ ID NO: 82

```
Genbank ID        : AF208967.1
Unigene ID(#167)  : Hs.201776
Unigene name      :        paternally expressed 3    PEG3
>gi|11494019|gb|AF208967.1|AF208967 Homo sapiens Kruppel-type zinc finger
prote
in (PEG3) mRNA, alternative splice form 1, complete cds
GTTTGGGAGGCGCGGGAGATGTCCACCCTGGGCTGGTGGCGCCGCCGGGCGCCGGGCGCCATGAGGGTGC
```

FIGURE 90 cont'd

```
GCTAGGCGGCTGTTCGTGCCCGAGGCTGCGCAGCACTGAGGTGAGCTTTGCCTTCTTGATCTTCCGTCCT
TCTTGGAGACGACTGGCGAGAGGAAGAGGGACTAGGTCCAAACGCTAGGTGGCTGGGTCCAGATACCTGT
GTTTTGACTCTGTTCCTGTGGATAGCTGCTTGGTCTGAAGTTCCAGAAAGGATCCTGTTCCCAGACAGGT
CCCTGAGTACTGACGGTCACAGGCTGCCGCGTCTTTCCTGTTGACTCATGTTTGGTTCCTCCAGTGAAAA
TTTTACTTAGAGAAATGCTGCCTCCAAAGCACTTGTCTGCCACCAAACCTAAGAAGTCCTGGGCCCAAA
TCTGTATGAGCTAGACAGTGACTTGACTAAGGAGCCGGATGTCATCATAGGAGAAGGTCCAACTGACTCT
GAGTTTTTTCATCAGAGGTTTCGGAACCTAATCTATGTGAATTTGTTGGGCCTCGGAAGACCCTGATCA
AACTCCGAAACCTCTGCCTCGATTGGTTGCAGCCGGAGACCCGCACCAAGGAGGAGATCATCGAGCTCTT
GGTCCTTGAGCAGTACCTGACCATCATCCCTGAAAAGCTCAAGCCTTGGGTGCGAGCAAAAAAGCCGGAG
AACTGTGAGAAGCTCGTCACTCTGCTGGAGAATTACAAGGAGATGTACCAACCAGAAGACGACAACAACA
GTGACGTGACCAGCGACGACGACATGACCCGGAACAGAAGAGAGTCCTCACCACCTCACTCAGTCCATTC
TTTCAGTGACCGGGACTGGGACCGGAGGGGCAGAAGCAGAGACATGGAGCCACGAGACCGCTGGTCCCAC
ACCAGGAACCCAAGAAGCAGGATGCCTCCGCGGGATCTTTCCCTTCCTGTGGTGGCGAAAACAAGCTTTG
AAATGGACAGAGAGGACGACAGGGACTCCAGGGCTTATGAGTCCCGATCTCAGGATGCTGAATCATACCA
AAATGTGGTGGACCTCGCTGAGGACAGGAAACCTCACAACACAATCCAGGACAACATGGAAAACTACAGG
AAGCTGCTCTCCCTCGTGCAGCTTGCTGAAGACGATGGCCACTCCCACATGACGCAGGGCCACTCATCAA
GATCCAAGAGAAGTGCCTACCCAAGCACCAGTCGAGGTCTAAAAACTATGCCTGAAGCCAAAAAATCAAC
CCACCGGCGGGGATTTGTGAAGATGAATCTTCCCACGGAGTGATAATGGAAAAATTCATCAAGGATGTG
TCACGCAGTTCCAAATCGGGAAGAGCAAGGGAGTCAAGCGACCGGTCACAGAGATTCCCCAGAATGTCAG
ATGATAACTGGAAGGACATTTCATTGAACAAGAGGGAGTCAGTGATCCAGCAGCGGGTTTATGAAGGGAA
TGCATTTAGGGGAGGCTTTAGGTTTAATTCAACCCTTGTTTCCAGAAAGAGAGTTCTTGAAAGAAAGAGG
CGCTATCATTTTGACACAGATGGGAAGGGCTCGATTCACGATCAAAAAGGCTGTCCCAGGAAGAAGCCCT
TTGAATGTGGTAGTGAGATGAGAAAAGCCATGAGCGTGAGCAGCCTGAGCAGCCTCAGCTCCCCCTCCTT
TACCGAGTCACAGCCAATTGATTTGGGGCAATGCCATATGTATGTGATGAGTGTGGGAGGTCGTTCAGT
GTCATCTCAGAATTTGTTGAGCACCAGATCATGCATACTAGAGAGAACCTCTATGAGTATGGTGAGTCCT
TTATCCACAGTGTGGCTGTCAGTGAAGTTCAGAAAAGTCAGGTTGGAGGGAAACGTTTTGAATGTAAGGA
CTGTGGAGAGACCTTCAATAAGAGTGCCGCCTTGGCTGAACATCGGAAGATTCATGCTAGAGGTTATCTT
GTGGAATGTAAGAATCAGGAATGTGAGGAAGCCTTCATGCCTAGCCCCACCTTTAGTGAGCTTCAGAAAA
TATATGGCAAAGACAAATTCTACGAGTGCAGGGTGTGTAAGGAAACCTTCCTTCATAGTTCTGCCCTGAT
TGAGCACCAGAAAATCCACTTTGGGGATGACAAAGATAATGAGCGTGAACATGAACGTGAACGTGAACGT
GAGCGCGGGGAAACCTTTAGGCCCAGCCCAGCCCTTAATGAGTTTCAGAAAATGTATGGTAAAGAGAAA
TGTACGAATGTAAGGTGTGTGGGGAGACTTTCCTTCATAGCTCATCCCTGAAAGAACATCAGAAAATCCA
TACTAGAGGGAACCCATTTGAAAACAAGGGTAAAGTGTGTGAGGAAACCTTTATTCCTGGTCAGTCCCTT
AAAAGGCGTCAGAAAACTTACAATAAGGAGAAGCTCTGTGACTTTACAGATGGCCGGGATGCCTTCATGC
AAAGCTCAGAGCTCAGTGAGCATCAGAAAATTCATTCTCGAAAGAACCTCTTTGAAGGCAGAGGGTATGA
GAAATCTGTCATTCATAGTGGGCCATTCACTGAATCTCAGAAGAGTCATACTATAACAAGACCTCTTGAA
AGTGATGAGGACGAAAAGGCGTTCACCATTAGCTCTAACCCCTATGAAAACCAGAAGATTCCCACTAAGG
AAAATGTCTATGAGGCAAAATCATATGAGAGGTCTGTTATTCATAGCTTAGCCTCTGTGGAAGCTCAGAA
AAGTCACAGTGTAGCAGGGCCCAGTAAACCAAAAGTAATGGCAGAGTCTACCATTCAGAGCTTCGATGCT
ATCAACCATCAGAGAGTTCGTGCTGGAGGGAACACCTCTGAAGGAAGGGAATACAGTAGGTCTGTTATCC
ATAGCTTAGTGGCTTCCAAACCTCCAAGAAGTCACAATGGAAATGAATTGGTGGAATCTAATGAGAAGGG
AGAATCCTCCATTTATATCTCAGACCTTAATGATAAGCGACAGAAGATTCCTGCCAGAGAGAACCCTTGT
GAAGGGGGCAGTAAGAATCGCAACTATGAAGACTCTGTCATACAGAGTGTATTCCGTGCCAAACCTCAGA
AAAGTGTTCCTGGAGAGGGATCTGGTGAGTTTAAGAAGGATGGCGAATTCTCTGTTCCCAGCTCAAATGT
CCGTGAATACCAGAAGGCTCGTGCTAAAAAGAAATACATTGAGCATAGGAGCAATGAGACCTCTGTAATT
CACTCTCTGCCTTTTGGTGAACAAACATTTCGCCCTCGAGGGATGCTCTATGAATGTCAGGAGTGTGGGG
AGTGCTTTGCTCATAGCTCTGACCTCACTGAGCACCAGAAGATTCATGATAGGGAGAAGCCCTCTGGAAG
CAGAAACTATGAATGGTCTGTCATTCGCAGCTTGGCCCCTACTGACCCTCAAACAAGTTACGCCCAAGAG
CAGTATGCTAAAGAGCAAGCGCGGAACAAATGTAAGGACTTCAGACAATTTTTTGCTACCAGCGAAGACC
TCAACACAAACCAGAAAATCTATGACCAAGAGAAGTCTCATGGCGAGGAGTCTCAAGGCGAGAATACTGA
TGGGGAGGAGACCCACAGCGGAGGAGACCCATGGTCAGGAGACAATTGAAGACCCTGTCATTCAAGGCTCA
GACATGGAAGACCCTCAGAAGGATGACCCTGATGACAAAATCTATGAATGTGAGGACTGTGGCCTGGGCT
TTGTGGATCTCACAGACCTCACAGACCATCAGAAAGTCCACAGCAGGAAGTGCCTGGTTGACAGTCGGGA
GTACACACATTCTGTAATTCACACCCATTCCATCAGCGAGTATCAGAGAGATTACACTGGAGAGCAGCTG
TATGAATGTCCAAAGTGTGGGGAATCTTTTATTCATAGCTCATTCCTTTTCGAGCATCAGAGAATCCATG
AACAAGACCAGTTGTATTCCATGAAGGGGTGTGATGATGGTTTTATTGCCCTCTTGCCCATGAAGCCACG
GAGGAATCGTGCTGCAGAGAGGAATCCTGCTCTTGCTGGGTCGGCCATTCGATGCCTTTTGTGTGGACAA
GGCTTCATTCATAGCTCTGCCCTTAATGAGCATATGAGACTTCATAGGGAAGATGATTTACTGGAGCAGA
GCCAGATGGCTGAGGAAGCTATCATTCCAGGCTTAGCCCTCACTGAGTTTCAGAGAAGTCAGACCGAAGA
GAGACTCTTTGAATGTGCAGTCTGTGGAGAATCTTTCGTCAACCCAGCAGAACTTGCAGATCACGTAACT
GTTCATAAGAATGAGCCCTATGAGTACGGGTCCTCCTATACTCACACCTCATTTCTTACTGAGCCCCTCA
```

FIGURE 90 cont'd

```
AAGGAGCTATACCATTCTATGAATGCAAGGATTGTGGTAAGTCCTTTATTCATAGCACAGTCCTCACTAA
ACATAAGGAGCTTCATCTGGAAGAAGAAGAAGAAGATGAAGCAGCAGCAGCTGCAGCAGCAGCAGCCCAG
GAAGTTGAAGCCAATGTCCATGTTCCACAAGTAGTTCTGAGGATTCAGGGCTTAAACGTAGAGGCTGCTG
AGCCAGAAGTGGAGGCTGCCGAGCCAGAAGTGGAGGCTGCTGAGCCAGAAGTGGAGGCTGCTGAGCCAAA
CGGAGAGGCTGAAGGGCCAGATGGAGAGGCTGCAGAGCCCATTGGAGAGGCTGGACAGCCAAATGGAGAG
GCCGAGCAGCCAAATGGGGATGCTGATGAGCCAGATGGTGCAGGTATTGAAGACCCAGAAGAAAGAGCTG
AAGAGCCAGAGGGAAAAGCTGAAGAGCCAGAGGGAGATGCCGACGAGCCTGACGGTGTGGGAATTGAAGA
CCCAGAAGAAGGTGAAGATCAAGAGATTCAGGTAGAAGAACCATACTATGACTGCCATGAATGCACAGAA
ACCTTCACTTCCAGCACAGCATTCAGTGAACACCTGAAAACTCATGCCAGCATGATCATATTTGAGCCTG
CAAATGCCTTTGGGGAGTGCTCAGGCTACATCGAACGTGCCAGCACCAGCACAGGTGGTGCCAATCAAGC
TGATGAGAAGTACTTCAAATGTGACGTCTGTGGGCAGCTCTTCAATGACCGCCTGTCCCTCGCCAGACAC
CAGAATACCCACACTGGCTGAGGGCATGGGGTAAAGGTTAGAAAACCTTCACCTAGGACTTGACCCTTAC
CAAACCACAGAGAATCCAAACCAATCCATGATAATGTCAGTAGGAGACTTAACCTTAGTGTGTTACACAC
CTGACTTAACATCTCTAAACTCAGATTGAAAAGAGACCGAATGTGCAGATTCCACAGTCTTAAGCTTTCC
CCTTCAGATGTCAGTGTCTGCATGTGGGAAAGCCATAGCACACATCTTACCTTTCCAAGTAATCAGATTG
AGAAAACCCTATGAGTATTCCAGACTACAGAGTTTGCCCAAATCAACTGTAAATGACACTTGTGTAACGT
ATATATAGTGTTTCATGAGGTGTATATAAAATAGCAAATTATGACAGAACAGTGATCACATATATTTGGA
TTTATATGATATACAGTTACAGTTTACTCTGCAGAGGTACCTTACCTGGTATTCTTTGAATTTTTTTTTT
TTTTGGAGGAGGAAGAGAGCAACAAATTTGATTATATTTTAAGTGTCTTAGATCCTGAGAAAGATTTAT
TGTGCATTATTTGAACCCTGTCAATATCTTTTTGAGTAATTGTTTTGTTTCTTACCCTTAAATAGTCTTG
TGAAGCTGTAGGCATGATAGATAACATGGCTTTTACTCCTTACTGTTTGAAAAGATAAGTACTTTAGCTT
CTTTCTGCAGCCATTTCATCTGCGCCAACACTTTGGAACCTAATACTGTGTAAGGCTTTACAATATACGG
ATTGGCTTTTTGTGACCCAGATTGATTGGTTGCCACATGTTATGTTTGTTGAAGTGGTTCTCATGCAAAA
ATATTACACATTTGTGTTCTGGGTTTTTTTTTTTTAACCAACTCAATATGTGTTTGATGATAGTGAAT
TGATAAAACCCGAAGCTTTTCCCTGTAAATCTTACATCTTTGCCTTTAAAGAATGGGTTACAACCATCAC
TAGATCACAGTAGTGCCTAATGAAGGTTGAGAACCGTAGGAGAGGCTCTCATGCTGTAAATAATGTTGCA
GGCTAATAACCTTTCATCACTTCCTTTGTGCGCTTCCTGCCTTAAGTGACAAGTAGCAACATGGCTTGGG
TCCCCTGTGCAGCATCAGCTTATGCTGCCACAAGTCAGTTTGCACCCTAGGTGCCCAGGAGCTAGTATCC
TTAGATCTTTCTATCGCTAACTTAATTCTCTTCGTTATTTATCTGACCCTCTAACTCCATGTCTAACTTG
C
```

FIGURE 91
SEQ ID NO: 83
Genbank ID      : BE966146
Unigene ID(#167) : acc_BE966146
Unigene name    :
>gi|11771248|gb|BE966146.2|BE966146   601660074R1   NIH_MGC_71   Homo   sapiens
cDNA cl
one IMAGE:3905635 3', mRNA sequence

```
TTTTTTTTTTTTTTTAAACAAATGCTCACTTTAATCACAATTCTAAATTAATTATTTTCACATTAATATA
GATTTTTCCATAAACCAACGAAAAACTGGAGGTTATTATACATTTTTAAACAGCTAACATGGATTTGGAA
AATTTTTTATTAAAAATTGGATCAGAAGCTAGTTGGAAATTCTCAATGGTGAAATATAAAATATTCATTA
CAATTGGTGTTTTCAAAGTAAATTCAGATCTAAGCTTCCTGGAAAAGCTGGTACTATCTCATATCATAAT
AGGGATGACTAAGTACTTGGACAACTACTTTCTAAAGAACTTAACAAAAAGTGGACTACTTGAAGATTAC
ATTTACAACAGAAAGGGCTAACATTCTCTGGCAGAGCTCTCATTTTATCATGAAATGGTGGGACAATCAG
GAACACGTGGATGAGGGGTATCAAGAAAAGGGGCATTTCAAAATATTTCCACTTTAATTAAAGGTTTGGA
CAATGAAGATTTCATAAAAGGGTCTTTAAATACTATTTTCTAGAGAATAACCATCTAAATCGGAGACTAT
ATGCCATAAAACGGGAACCATTTGAGGGGGTAACAATAATTCTAAGTTGGTACTATAAAAAGATTGGGCT
AAAATACAAAACATCTTGGCCGATACACCGGGCAACGTAGCCTAAAGTAGGCCACAAGAATTCCAGAAAG
GGCTCCCGAAAGAAACTACAGAAGGTCCCCCCTGGCCAGATACAACCGCACACTTAAGCCAGGGCGCGAA
CCAAAACCAGCTCAAAGGGGACCACGTGGCAACGAAAAACCGCTGTGGCGCGAGACCCGGTGCACGAGAC
ACAAGCGAGAAAGCGTCCCCAAGCGAGGTGTAAAAGCAAAACATATAAAAAACAACCTAGAGGTGAAACG
AGAAGCACAAGCGCATCTGGGAAGAGCGCATAGGAGGAGAGAAGTACATAAAAACACAGATAAAAACG
AAACAGGCAGGGTAGCACAAAACAGCACACCCAGCGCGAGGCAGAGAACACGAACGGGTCAACG
```

FIGURE 92
SEQ ID NO: 84
Genbank ID      : BG165011

FIGURE 92 cont'd

Unigene ID(#167) : Hs.528654
Unigene name       :        hypothetical protein FLJ11029 FLJ11029
>gi|12671714|gb|BG165011.1|BG165011   602343875F1   NIH_MGC_89   Homo   sapiens cDNA cl
one IMAGE:4454010 5', mRNA sequence
AAAAAAAAAAGTCCTGTGGAAATCATATAGACAAACATTTGCAAAGCTGCTACTGCCATTGTACCAGTGT
TAAACTGTGTTCTACCTTGCATCTTTTACTGATTTTTATGACAGATTTTATATTGGTAACCATTCGAGAA
CTCTGTAAGTGCTATGGCTTCCTTAAACTACGATTTATCATATGCTCCCAGTGTTTACTTTGAGACTGAA
TGGCAACCAGAGAATGTAAACAACCAAGGTGCATCTGGTTATGTTTTAAAATAAAGATTAATAAAAGTTA
AGGTAAAAGGTCTGTGTCTGAACCTATGCATTTTTTCACCTCTGAGGAGGATACTAATACCTAATGAGAA
AAGCTGAAATGTGTGGGCCGCGGGTGGCGGGTGCGCTACATGGCGCTAATGGATACTCTCAGACAGCTTG
AGGGGAGGGCGCGCAGGCAGGTCAGAAATCGAGCCTGGAGGCTCGGACAAGAATTCGGAGTTACCCAGGG
GCGTGGGACCCTAAGCGAGTGGAGTGGAACACCCTTGATTCTCGTGAGTGGAGAGGTGTCACCAAAAATA
TTGAGNCCGGGGCGGACTATTAGGACAGAACTACCATGATCATATCCACGAGGTGCTAAACTGGTGCGAC
AAGGGTCTGAAGGCGCAGTAAATCAGAGGCGTGGTAACACCCCGCTAAGGAGTGGGCCGTAAGTGTCCTG
GCGCCTGGGATGTCCAGAGAAGATTCGGGGGGCCAATAAGGGCAAGTAACCCAGGATTCTGGCAGGCAA
CACTAACTTCAGTTCGAACCGGGTTCCCCGGTGGCGGTTACAACACAAGCCC

FIGURE 93
SEQ ID NO: 85
Genbank ID          : NM_006101.1
Unigene ID(#167)   : Hs.414407
Unigene name       :        kinetochore associated 2        KNTC2
>gi|5174456|ref|NM_006101.1| Homo sapiens kinetochore associated 2 (KNTC2), mRN
A
CTCGAGCCACGAAGGCCCCGCTGTCCTGTCTAGCAGATACTTGCACGGTTTACAGAAATTCGGTCCCTGG
GTCGTGTCAGGAAACTGGAAAAAAGGTCATAAGCATGAAGCGCAGTTCAGTTTCCAGCGGTGGTGCTGGC
CGCCTCTCCATGCAGGAGTTAAGATCCCAGGATGTAAATAAACAAGGCCTCTATACCCCTCAAACCAAAG
AGAAACCAACCTTTGGAAAGTTGAGTATAAACAAACCGACATCTGAAAGAAAAGTCTCGCTATTTGGCAA
AAGAACTAGTGGACATGGATCCCGGAATAGTCAACTTGGTATATTTTCCAGTTCTGAGAAAATCAAGGAC
CCGAGACCACTTAATGACAAAGCATTCATTCAGCAGTGTATTCGACAACTCTGTGAGTTTCTTACAGAAA
ATGGTTATGCACATAATGTGTCCATGAAATCTCTACAAGCTCCCTCTGTTAAAGACTTCCTGAAGATCTT
CACATTTCTTTATGGCTTCCTGTGCCCCTCATACGAACTTCCTGACACAAAGTTTGAAGAAGAGGTTCCA
AGAATCTTTAAAGACCTTGGGTATCCTTTTGCACTATCCAAAAGCTCCATGTACACAGTGGGGCTCCTC
ATACATGGCCTCACATTGTGGCAGCCTTAGTTTGGCTAATAGACTGCATCAAGATACATACTGCCATGAA
AGAAAGCTCACCTTTATTTGATGATGGGCAGCCTTGGGGAGAAGAAACTGAAGATGGAATTATGCATAAT
AAGTTGTTTTTGGACTACACCATAAAATGCTATGAGAGTTTTATGAGTGGTGCCGACAGCTTTGATGAGA
TGAATGCAGAGCTGCAGTCAAAACTGAAGGATTTATTTAATGTGGATGCTTTTAAGCTGGAATCATTAGA
AGCAAAAAACAGAGCATTGAATGAACAGATTGCAAGATTGGAACAAGAAAGAGAAAAAGAACCGAATCGT
CTAGAGTCGTTGAGAAAACTGAAGGCTTCCTTACAAGGAGATGTTCAAAAGTATCAGGCATACATGAGCA
ATTTGGAGTCTCATTCAGCCATTCTTGACCAGAAATTAAATGGTCTCAATGAGGAAATTGCTAGAGTAGA
ACTAGAATGTGAAACAATAAAACAGGAGAACACTCGACTACAGAATATCATTGACAACCAGAAGTACTCA
GTTGCAGACATTGAGCGAATAAATCATGAAAGAAATGAATTTGCCAGACTATTAATAAATTAACCAAGG
ACCTGGAAGCTGAACAACAGAAGTTGTGGAATGAGGAGTTAAAATATGCCAGAGGCAAAGAAGCGATTGA
AACACAATTAGCAGAGTATCACAAATTGGCTAGAAAATTAAAACTTATTCCTAAAGGTGCTGAGAATTCC
AAAGGTTATGACTTTGAAATTAAGTTTAATCCCGAGGCTGGTGCCAACTGCCTTGTCAAATACAGGGCTC
AAGTTTATGTACCTCTTAAGGAACTCCTGAATGAAACTGAAGAAGAAATTAATAAAGCCCTAAATAAAAA
AATGGGTTTGGAGGATACTTTAGAACAATTGAATGCAATGATAACAGAAAGCAAGAGAAGTGTGAGAACT
CTGAAAGAAGAAGTTCAAAAGCTGGATGATCTTTACCAACAAAAAATTAAGGAAGCAGAGGAAGAGGATG
AAAAATGTGCCAGTGAGCTTGAGTCCTTGGAGAAACACAAGCACCTGCTAGAAAGTACTGTTAACCAGGG
GCTCAGTGAAGCTATGAATGAATTAGATGCTGTTCAGCGGGAATACCAACTAGTTGTGCAAACCACGACT
GAAGAAAGACGAAAAGTGGGAAATAACTTGCAACGTCTGTTAGAGATGGTTGCTACACATGTTGGGTCTG
TAGAGAAACATCTTGAGGAGCAGATTGCTAAAGTTGATAGAGAATATGAAGAATGCATGTCAGAAGATCT
CTCGGAAAATATTAAAGAGATTAGAGATAAGTATGAGAAGAAAGCTACTCTAATTAAGTCTTCTGAAGAA
TGAAGATAAAATGTTGATCATGTATATATATCCATAGTGAATAAAATTGTCTCAGTAAAAAAAAAAAAAA
AAAAAAAAAAAAAAAAAAAAAAAAAAAAAAAAAAAAAAAAAAAAAAAAAA

FIGURE 94
SEQ ID NO: 86
Genbank ID          : AI360875
Unigene ID(#167)    : Hs.432638
Unigene name        :       SRY (sex determining region Y)-box 11     SOX11
>gi|4112496|gb|AI360875.1|AI360875 qy01c03.x1 NCI_CGAP_Brn23 Homo sapiens cDNA
clone IMAGE:2010724 3', mRNA sequence
AAATAAAAGGGATGCGTATCAGAGTGTAAGAACTGGAAATTACTTCCACAGTTTAAAGAATTAATAAGAG
AATGCTGGTTCAATTTCTTAAAGATGGAAAGCTTACCAAAATGCCATCAGAGTCTGTGAACTACTTATAA
TAAACAGCAGGATCCCCACTGGCTAGGCTGCCGTGCACACAGCACCCACCCGCCACCCCCAGGTTACCAT
TTTAAGATATTCTGTCAATGCTTAGTTAAAAATAAGACTTACTTAAGAGACCAACAAAAAAAATCAATT
AAACTTTTATTGAAGACTATCCAGTGGCAAGAATACCATGTGTATTATACTATGTTTTAGACACTCAATA
AAGAATTCATTAAGATGATTCTCACAACGCACTCATCAAAACAGCCTTAAATATTGTTAAAAAGCGCATT
GAAGCGCCTGTCCTGAGTTCTAACAGGTTTTAAATTTAGAT

FIGURE 95
SEQ ID NO: 87
Genbank ID          : D90427.1
Unigene ID(#167)    : Hs.512643
Unigene name        :       alpha-2-glycoprotein 1, zinc  AZGP1
>gi|220150|dbj|D90427.1|HUMZA2G    Homo    sapiens    mRNA    for    zinc-alpha2-
glycoprotein
precursor, complete cds
GCAAGAATGGTGCCTGTCCTGCTGTCTCTGCTGCTGCTTCTGGGTCCTGCTGTCCCCCAGGAGAACCAAG
ATGGTCGTTACTCTCTGACCTATATCTACACTGGGCTGTCCAAGCATGTTGAAGACGTCCCCGCGTTTCA
GGCCCTTGGCTCACTCAATGACCTCCAGTTCTTTAGATACAACAGTAAAGACAGGAAGTCTCAGCCCATG
GGACTCTGGAGACAGGTGGAAGGAATGGAGGATTGGAAGCAGGACAGCCAACTTCAGAAGGCCAGGGAGG
ACATCTTTATGGAGACCCTGAAAGACATTGTGGAGTATTACAACGACAGTAACGGGTCTCACGTATTGCA
GGGAAGGTTTGGTTGTGAGATCGAGAATAACAGAAGCAGCGGAGCATTCTGGAAATATTACTATGATGGA
AAGGACTACATTGAATTCAACAAAGAAATCCCAGCCTGGGTCCCCTTCGACCCAGCAGCCCAGATAACCA
AGCAGAAGTGGGAGGCAGAACCAGTCTACGTGCAGCGGGCCAAGGCTTACCTGGAGGAGGAGTGCCCTGC
GACTCTGCGGAAATACCTGAAATACAGCAAAAATATCCTGGACCGGCAAGATCCTCCCTCTGTGGTGGTC
ACCAGCCACCAGGCCCCAGGAGAAAAGAAGAAACTGAAGTGCCTGGCCTACGACTTCTACCCAGGGAAAA
TTGATGTGCACTGGACTCGGGCCGGCGAGGTGCAGGAGCCTGAGTTACGGGGAGATGTTCTTCACAATGG
AAATGGCACTTACCAGTCCTGGGTGGTGGTGGCAGTGCCCCCGCAGGACACAGCCCCCTACTCCTGCCAC
GTGCAGCACAGCAGCCTGGCCCAGCCCCTCGTGGTGCCCTGGGAGGCCAGCTAGGAAGCAAGGGTTGGAG
GCAATGTGGGATCTCAGACCCAGTAGCTGCCCTTCCTGATGTGGGAGCTGAACCACAGAAATCACA
GTCAATGGATCCACAAGGCCTGAGGAGCAGTGTGGGGGGACAGACAGGAGGTGGATTGGAGACCGAAGA
CTGGGATGCCTGTCTTGAGTAGACTTGGACCCAAAAAATCATCTCACCTTGAGCCCACCCCCACCCCATT
GTCTAATCTGTAGAAGCTAATAAATAATCATCCCTCCTTGCCTAGC

FIGURE 96
SEQ ID NO: 88
Genbank ID          : NM_003832.1
Unigene ID(#167)    : acc_NM_003832.1
Unigene name        :
>gi|4502934|ref|NM_003832.1|    Homo    sapiens    phosphoserine    phosphatase-like
(PSPHL
), mRNA
AAGCCACAGGCTCCCTGGCTGGCGTCAGCTAAAGTGGCTGTTGGGTGTCCGCAGGCTTCTGCCTGGCCGC
CGCCGCCTATAAGCTACCAGGAGGAGCTTTACGACTTCCCGTCCTGCGGGAAGTGGCGGGCACGATCGCA
AGGTAGCGCAGAAGCTTCTCAATGGCCAGCGCCAGCTGCAGCCCCGGCGGCGCACTCGCCTCACCTGAGC
CTGGGAGGAAATTCTTCCAAGGATGATCTCCCACTCAGAGCTGAGGAAGCTTTTCTACTCAGCAGATGC
TGTGTGTTTTGATGTTGACAGCACGGTCATCAGTGAAGAAGGAATCGGATGCTTTCATTGGATTTGGAGG
AAATGTGATCAGGCAACAAGTCAAGGATAACGCCAAATGGTATATCACTGATTTTGTAGAGCTGCTGGGA
GAACCGGAAGAATAACATCCATTGTCATACAGCTCCAAACAACTTCAGATGAATTTTTACAAGTTACACA
GATTGATACTGTTTGCTTACAATTGCCTATTACAACTTGCTATAAAAAGTTGGTACAGATGATCTGCACT FIGURE 96 cont'd GTCAAGTAAACTACAGTTAGGAATCCTCAAAGATTGGTTTGTTTGTTTTTAACTGTAGTTCCAGTATTAT
ATGATCACTATCGATTTCCTGGAGAGTTTTGTAATCTGAATTCTTTATGTATATTCCTAGCTATATTTCA
TACAAAGTGTTTTAAGAGTGGAGAGTCAATTAAACACCTTTACTCTTAGGAATATAGATTCGGCAGCCTT
CAGTGAATATTGGTTTTTTTCCCTTTGGTATGTCAATAAAAGTTTATCCATGTGTCAGAAAAAAAAAAA

FIGURE 97
SEQ ID NO: 89
Genbank ID         : AW964972
Unigene ID(#167)   : Hs.361171
Unigene name       :         placenta-specific 9      PLAC9
>gi|8154808|gb|AW964972.1|AW964972  EST377045  MAGE  resequences,  MAGI  Homo sapien
s cDNA, mRNA sequence
GACCAGAATAGCTTTTATTTCACATGAAGCTAAGGAAGGAAGTCGAGAGGACAGGGCTGGTTCTGTGGGC
GCTGCCTGGCAGGTGCACCACCTCCAACTGCTGGGCTCCAGCTCCAGGGCTCAAAAGCCATCTCCGAAAA
GGTCGGGAGCGGGGCTGAAGGGTCCCGGGGGCAGGTTCCAGGCCAGCTCCTCCAGCAGGCCCAACAGGCC
TTTCACCTCTGTCCCCAGGTGATCCACGGTCTTCTCTACCATCTCCTCCATGACATCTAGACGGCGTTGC
ACAGCCATGTGTCTGTCACACGCTGTGCTCTGAGCTGAGTCTCCTCGCGGAGGGCTGAAGGGTTCGGCAG
CGGCCAAAGAGCCCGCGGCGCGGAGCAGGGCCAGTCCGGTCAGCGCGCAGAGCATGGGCCGCATGGTGCC
GCTCGTGCCTAATTCCTGTCACCCGGGGGATCCACTAGTTCTAGAGCGGCCGCCACCGCGGTGGAGCTCC
AATTCGCCCTATAGTGAGTCGTATTACGCGCGCTTACTGGCCGGTGT

FIGURE 98
SEQ ID NO: 90
Genbank ID         : AK024132.1
Unigene ID(#167)   : Hs.387057
Unigene            :         hypothetical protein FLJ13710 FLJ13710
>gi|10436438|dbj|AK024132.1|  Homo  sapiens  cDNA  FLJ14070  fis,  clone HEMBB1001619
CATGTCCAGAAGCAATCCACAGTTTGAGAAACCAAGTTTGGGTAAGATTTCTGGGGTCCATTGCTGGTTT
ACAGGGATAATCAGACAGACTATTTGAAATCTATCAGGATGATGATGATTTCTGTCAGGCCTGATGGGGC
TCAGCTCATGAATAGCATGGGGGTTCTGGGATCAGCTCCCTGGGACAGGGCAGGCCTGGAGGGGTCACCT
GTAAAAAGTTGGTAAGCAGGGCATTGTCACCAGGCTTCCTCTTCCATGTCAATGGAGTCTGGAGGCAGA
GTTGGAATCCAGCTCTGCACCTTTTTGCTGTGCACCCTCAGGCGGGTCAGCAACCTCTCTGAACACACAC
CCAGTCTACAAAATAGAAGAAAAACCCTATAAGGTGGTTTTTGGCAGGGGAGAGGACATGGGAAGAGATT
GAATAAATTAGTTGTCCATCCTAGCATAGAGCCCAGAACAAGGCACTGAAAAGACTTCTTAAATTTTTTT
GTCCAACAACATCTTGGACAGTTCTCATTTATGTCAACATGCCTGGTCCTGATTTTGTTGGTCATATTTG
CATGTCATATTTTAAACCATGAAGCATAATAACCAACTAAGTAAGAAAGCCCTGGCAAAAAAGCTGAGAG
GTCTGGTGCAGTGGATCACGCCTGTGATCCCAGCACGTTTGGAAGCCGAGGTGGGCAGATTGCTTGAGCC
CAGGAGTTCGAGACCAGCCTGGACAAAATGGCAAAACCCCATCTCTGCTAAAAGTACAAAAAGCAGCTGG
GATGTGGTGGCACTCACCTGTAATCCCAGGTACTCAAGAGACTAAGACACGAGAATCACTTGAACCCAGGA
GACACAGGGTGCAGTGAGCCTCCTGCACTCCAGCCTGGGTGACAGAGTGAGACTCTGTCTCCAAAAAAAA
AAAAAAAAAAAAAAAATTGCTGAGAAAGCCCTAATTGTTGTTGTTGTTGTTGTTGTTGTTGTTGTTGTT
ATTGCTGAAATGGGGTCTCGCTATGTTGCCCAGGCTGGTCTTGAACTCCTGGGCTCAAGCAATCCTCCTG
CCTCAGCCTCCCAAAACGTTGGGATTACAGGCATGAGCCACCTCACCCAGCCCCTTGTAGTTTTAACTG
TGTTCTACAGTAACCCTAGAATTTGCCTCCTTATTTCTATTAAAATGAGACATACTTGAACAATATTCA
GTCAAAATAGAAATATATACAGTCAAAAGCAACTGCCACATAATTGCCAAAACTTGGAAGCAACCAAGAA
GTCCTTCAGTAGGTGGATAGACAAAAACTAATGGAATATTATTTAGGGCTAGAAATAAATGAGCCATCAC
GTCACAAAGAGACATGGAGAAACCTTCCATGCATATTACTAAGTGAAAGAGGCCACTCTGAAAAGACTAC
CTATTGTTTGATTCCAACTATATGACATTCTAGAAAAGTTAAAACTATGGAGACAGTAAAAAGGTCAGTG
GTTGCCAGGGGCTGGGAGGACAGAGGGATGAAAAGGTGGAACAGGGAGGATTTCAGGCGGTGAAACTAC
TCTGTGTGATATTACACTGGCGGATGCATGTCACTGTGCACTTGTCCAGACCCACAGAATGTGCACTCCG
AAGTGTGAACCCTCGTATGGACTATGAACTCTAAGCAATAATGACATGTCCGTGTAGGGTCATCAGTTAC
ACATGTACCAGTCTGATGTGGGATGATGGTAGTAAGGGACCCTGTGCCTGTGTGGTGGGAGGAGGTGTGT
GGGAACTCTGTACTTCTACTCACTTTTGCTGTGAACCTAAAACTGCTCTAAAAAAAAAAAAAAGCCT

FIGURE 99
SEQ ID NO: 91
Genbank ID         : BE614410
Unigene ID(#167)   : Hs.434886
Unigene name       :         cell division cycle associated 5      CDCA5
>gi|9896007|gb|BE614410.1|BE614410 601504111T1 NIH_MGC_71 Homo sapiens cDNA clo
ne IMAGE:3905666 3', mRNA sequence
GCGATCTTATCAAGCTTTTTGGGAGGTATAAAACAAAATCCCCATTTTTTCCTTGGATTTAGTTCCTCAG
GAACAGAGAACTTTGCAATTGATGATCTCAACTCTGCATCATCTGGTGACTCCTGATTCTGCAGGACTAA
GACATTTCCCAAGAGTTCTGCTGCATCAGCCAGTGAGGACAAGAGTTCTTCAGTGCGGTTCAGCTCAAGG
ACACCTAGGCTTCCCCAGCAGGGGGCTTGCTTGCAGGTCTGACAAACCACAGAGCGTTGAGCAGATGGCC
TGGGACTCCAGACCTGGCAGAGGGTTTTATTAGGGCCCGCCTGGCCTGCACCGTTTCATCCAAGTACCC
TGACCCAGCACTCATCTTCCCTGGCATTCTCTGTTATCCACCAGCTCCTCTGCACACCTCAGCGTCTACT
TCCACGAACTTCTAAACATCAAAAGGTACAATGGCCAGGGTGCGGCAGGAGAGTCGGGGGCAGGGCAGCC
TTCAAATCCACACTATTGAATCCACACGATGGAAAGAAGAGAACAGATGGGGAAGTTCTCCAGAGATCAT
GAGATGCATCCAGGCAGTGTTCTCATGTGAGAGGATAGGGAGGCCAAAAACTAAAATTGCTATCAGCCCC
CGCCGCTGTCTGGTACGCGAGGAAACTTTCCGAGGACTTTACAAGCATAGTTGCAAAATGCTAGTAGGTC
TGGGACTCTTCAACTTTCTCTTCTAGGGCCACAGTAGACTCCGGTGTACTGCCTTTCTGGCCGCACCTGG
GTATGGGTGACAAGAGGGCCCCCTTCCGACCCTGCGCAAGTGTCAGACTCCAGCGTGGGCCCTTGCACCG
GACTGCCACAAGCCTGAAGCAAAAAATCCGTACTTGTTGCCCACCTGAATGCCTTGCTCAGCGCAGGCCT
ACACCTGGCTTCCACATTTACGGACCACTAAAACTTTATTGCAACCTTGTTGACCCAGGTCTATTACACA
CCAGGAATCCTTCAGAAGCCCCATTCGCCTCACATGGACACACTCGGTAACCAGCGGGCGGCACAACCTC
TCCAG

FIGURE 100
SEQ ID NO: 92
Genbank ID         : U78168.1
Unigene ID(#167)   : Hs.8578
Unigene name       :         Rap1 guanine-nucleotide-exchange factor directly
activated by cAMP EPAC
>gi|4079648|gb|U78168.1|HSU78168 Homo sapiens cAMP-regulated guanine nucleotide
 exchange factor I (cAMP-GEFI) mRNA, complete cds
GGATCCCCTTATCAAAGCTGATGGGGGTCGCTGGGGACCCCCAGCCTTTTGCTAGAGCCTGCACGGCTG
TGGGAGCTTGAAAAGAAACATGAAGGTGGGCTGGCCAGGTGAGAGCTGCTGGCAGGTGGGCCTGGCTGTG
GAGGATAGCCCAGCTCTGGGAGCACCGCGGGTGGGAGCCCTCCCTGACGTGGTGCCGGAGGGGACACTAC
TCAACATGGTGTTGAGAAGGATGCACCGGCCCCGAAGCTGCTCCTACCAGCTGCTGCTGGAGCACCAGCA
TCCGAGCTGCATCCAGGGGCTGCGCTGGACACCACTCACCAACAGCGAGGAGTCCCTGGATTTCAGCGAG
AGCCTGGAGCAGGCCTCCACAGAGCGGGTGCTCAGGGCTGGGAGGCAGCTGCATCAGCATCTACTGGCCA
CCTGCCCAAACCTCATCCGAGACCGGAAGTACCACCTTAGGCTCTATCGGCAGTGCTGCTCTGGCCGGGA
GCTGGTGGATGGGATCTTGGCCCTGGGACTTGGGGTCCATTCCCGGAGCCAAGTTGTGGGAATCTGCCAG
GTGCTGCTGGATGAAGGTGCCCTCTGCCATGTGAAACACGACTGGGCCTTCCAGGACCGAGATGCCCAAT
TCTACCGGTTCCCCGGGCCCGAGCCCGAGCCCGTGGGAACTCATGAGATGGAGGAGGAGTTGGCCGAAGC
TGTGGCCCTGCTCTCCCAGCGGGGGCCTGACGCCCTGCTCACTGTGGCACTTCGAAAGCCCCCAGGTCAG
CGCACGGATGAAGAGCTGGACCTCATCTTTGAGGAGCTGCTGCACATCAAGGCTGTGGCCCACCTCTCCA
ACTCGGTGAAGCGAGAATTAGCGGCTGTTCTGCTCTTTGAACCACACAGCAAGGCAGGGACCGTGTTGTT
CAGCCAGGGGACAAGGGCACTTCGTGGTACATTATCTGGAAGGGATCTGTCAACGTGGTGACCCATGGC
AAGGGGCTGGTGACCACCCTGCATGAGGGAGATGATTTGGACAGCTGGCTCTGGTGAATGATGCACCCC
GGGCAGCCACCATCATCCTGCGAGAATACAACTGTCATTTCCTGCGTGTGGACAAGCAGGACTTCAACCG
TATCATCAAGGATGTGGAGGCAAAGACCATGCGGCTGGAAGAACATGGCAAAGTGGTGCTGGTGCTGGAG
AGAGCCTCTCAGGGCGCCGGCCCTTCCCGACCCCCAACCCCAGGCAGGAACCGGTATACAGTGATGTCTG
GCACTCCAGATAAGATCCTAGAGCTTCTGTTGGAGGCCATGGGACTAGATTCCAGTGCTCATGACCCAAA
AGAAACATTCCTCAGCGACTTCCTCCTGACCCACAGGGTCTTCATGCCCAGCGCCCAACTCTGCGCTGCC
CTTCTGCACCACTTCCATGTGGAGCCTGCGGGTGGCAGCGAGCAGGAGCGCAGCACCTACGTCTGCAACA
AGAGGCAGCAGATCTTGCGGCTGGTCAGCCAGTGGGTGGCCCTGTATGGCTCCATGCTCCACACTGACCC
TGTGGCCACCAGCTTCCTCCACAAACTCTCAGACCTGGTGGGCAGGGACACCCGACTCAGCAACCTGCTG
AGGGAGCAGTGGCCAGAGAGGCGGCGATGCCACAGGTTGGAGAATGGCTGTGGGAATGCATCTCCTCAGA FIGURE 100 cont'd TGAAGGCCCGGAACTTGCCTGTTTGGCTCCCCAACCAGGACGAGCCCCTTCCTGGCAGCAGCTGTGCCAT
CCAAGTTGGGGATAAAGTCCCCTATGACATCTGCCGGCCAGACCACTCAGTGTTGACCCTGCAGCTGCCT
GTGACAGCCTCCGTGAGAGAGGTGATGGCAGCGTTGGCCCAGGAGGATGGCTGGACCAAGGGGCAGGTGC
TGGTGAAGGTCAATTCTGCAGGTGATGCCATTGGCCTGCAGCCAGATGCCCGTGGTGTGGCCACATCTCT
GGGGCTCAATGAGCGTCTCTTTGTTGTCAACCCACAGGAAGTGCATGAGCTGATCCCACACCCTGACCAG
CTGGGGCCCACTGTGGGCTCTGCTGAGGGGCTGGACCTGGTGAGTGCCAAGGACCTGGCAGGCCAGCTGA
CGGACCACGACTGGAGCCTCTTCAACAGTATCCACCAGGTGGAGCTGATCCACTATGTGCTGGGCCCCCA
GCATCTGCGGGATGTCACCACCGCCAACCTGGAGCGCTTCATGCGCCGCTTCAATGAGCTGCAGTACTGG
GTGGCCACCGAGCTGTGTCTCTGCCCCGTGCCCGGCCCCGGGCCCAGCTGCTCAAAAAGTTCATTAAGC
TGGCGGCCCACCTCAAGGAGCAGAAGAATGTCAATTCCTTCTTTGCCGTCATGTTTGGCCTCAGCAACTC
GCCCATCAGCCGCCTAGCCCACACCTGGGAGCGGCTGCCTCACAAAGTCCGGAAGCTGTACTCCGCCCTC
GAGAGGCTGCTGGATCCCTCATGGAACCACCGGGTATACCGACTGGCCCTCGCCAAGCTCTCCCCTCCTG
TCATCCCCTTCATGCCCCTTCTTCTCAAAGACATGACCTTCATTCATGAGGGAAACCACACACTAGTGGA
GAATCTCATCAACTTTGAGAAGATGAGAATGATGGCCAGAGCCGCGCGGATGCTGCACCACTGCCGAAGC
CACAACCCTGTGCCTCTCTCACCACTCAGAAGCCGAGTTTCCCACCTCCACGAGGACAGCCAGGTGGCGA
GGATTTCCACATGCTCGGAGCAGTCCCTGAGCACCCGGAGTCCAGCCAGCACCTGGGCTTATGTCCAGCA
GCTGAAGGTCATTGACAACAGCGGGAACTCTCCCGCCTGTCCCGAGAGCTGGAGCCATGAGGAGGGGCT
GGGACTGGAGCTGGAGCAGGCACTTGCAGCCGGGAAAGCCAGGGTGTGCCGGGCCAAGATACTCACAGGC
TGGCCACAGCTGGGCAAGGCTCTCCGTGGAGTGGACTCGAGTCCCTGGAGCAGGCAGTGTGGAGGCAGCC
ATCCCCTGTGATGACTGGCAGCTAAGGAGGACCTCGGAGTGGACCAAAGCCAGGAATAACGAATGACCAA
GGGCCAAGGAAGGGAGGACAGAGAGGCCCCAGGAGTGGGTGGAGAGTGGAGTGCGCTGGGACGTTGTGTG
CAATAGAGAGGTCTCCACACCAGATGTCTTCCAGATTCTGTGCCTCTGGCTTTGTTGTCCAGCCAGGCCT
GCAGTTTATTTTCACAGTGGACAGAGAGAGAGAGAGGCTGCATGTGTGTACCGTGTGTGGCAAGGGCA
GGGCCTTGGCCTGGGCAGGGCCCCTGCTTTCTTTCCACAGCTTTCTTCCAACAGCAGGCAGTGGGGCT
GCGGGCCTGAAAAAAAAAAAAAAAAAAAAAAAAA FIGURE 101
SEQ ID NO: 93
Genbank ID    : AB020683.1
Unigene ID(#167) : Hs.301011
Unigene name  :        jumonji domain containing 2B   JMJD2B
>gi|4240240|dbj|AB020683.1|AB020683 Homo sapiens mRNA for KIAA0876 protein,
par
tial cds
GCCGGCTTCAATCACGGGTTCAACTGCGCAGAATCTACCAACTTCGCCACCCTGCGGTGGATTGACTACG
GCAAAGTGGCCACTCAGTGCACGTGCCGGAAGGACATGGTCAAGATCTCCATGGACGTGTTCGTGCGCAT
CCTGCAGCCCGAGCGCTACGAGCTGTGGAAGCAGGGCAAGGACCTCACGGTGCTGGACCACACGCGGCCC
ACGGCGCTCACCAGCCCCGAGCTGAGCTCCTGGAGTGCGTCCCGGGCCTCGCTGAAGGCCAAGCTCCTCC
GCAGGTCTCACCGGAAACGGAGCCAGCCCAAGAAGCCGAAGCCCGAAGACCCCAAGTTCCCTGGGGAGGG
TACGGCTGGGGCAGCGCTCCTAGAGGAGGCTGGGGGCAGCGTGAAGGAGGAGGCTGGGCCGGAGGTTGAC
CCCGAGGAGGAGGAGGAGGAGCCGCAGCCACTGCCACACGGCCGGGAGGCCGAGGGCGCAGAAGAGGACG
GGAGGGGCAAGCTGCGGCCAACCAAGGCCAAGAGCGAGCGGAAGAAGAAGAGCTTCGGCCTGCTGCCCCC
ACAGCTGCCGCCCCGCCTGCTCACTTCCCCTCAGAGGAGGCGCTGTGGCTGCCATCCCCACTGGAGCCC
CCGGTGCTGGGCCCAGGCCCTGCAGCCATGGAGGAGAGCCCCTGCCGGCACCCCTTAATGTCGTGCCCC
CTGAGGTGCCCAGTGAGGAGCTAGAGGCCAAGCCTCGGCCCATCATCCCCATGCTGTACGTGGTGCCGCG
GCCGGGCAAGGCAGCCTTCAACCAGGAGCACGTGTCCTGCCAGCAGGCCTTTGAGCACTTTGCCCAGAAG
GGTCCGACCTGGAAGGAACCAGTTTCCCCCATGGAGCTGACGGGGCCAGAGGACGGTGCAGCCAGCAGTG
GGGCAGGTCGCATGGAGACCAAAGCCCCGGGCCGGAGAGGGGCAGGCACCGTCCACATTTTCCAAATTGAA
GATGGAGATCAAGAAGAGCCGGCCGCCATCCCCTGGGCGGCCGCCCACCCGGTCCCCACTGTCGGTGGTG
AAGCAGGAGGCCTCAAGTGACGAGGAGGCATCCCCTTTCTCCGGGGAGGAAGATGTGAGTGACCCGGACG
CCTTGAGGCCGCTGCTGTCTCTGCAGTGGAAGAACAGGGCGGCCAGCTTCAGGCCGAGAGGAAGTTCAA
CGCAGCGGCTGCGCGCACGGAGCCCTACTGCGCCATCTGCACGCTCTTCTACCCCTACTGCCAGGCCCTA
CAGACTGAGAAGGAGGCACCCATAGCCTCCCTCGGAGAGGGCTGCCCGGCCACATTACCCTCCAAAAGCC
GTCAGAAGACCCGACCGCTCATCCCTGAGATGTGCTTCACCTCTGGCGGTGAGAACACGGAGCCGCTGCC
TGCCAACTCCTACATCGGCGACGACGGGACCAGCCCCTGATCGCCTGCGGCAAGTGCTGCCTGCAGGTC
CATGCCAGTTGCTATGGCATCCGTCCCGAGCTGGTCAATGAAGGCTGGACGTGTTCCCGGTGCGCGGCCC
ACGCCTGGACTGCGGAGTGCTGCCTGTGCAACCTGCAGGAGGTGCGCTGCAGATGACCACCGATAGGAG
GTGGATCCACGTGATCTGTGCCATCGCAGTCCCCGAGGCGCGCTTCCTGAACGTGATTGAGCGCCACCCT
GTGGACATCAGCGCCATCCCCGAGCAGCGGTGGAAGCTGAAATGCGTGTACTGCCGGAAGCGGATGAAGA
AGGTGTCAGGTGCCTGTATCCAGTGCTCCTACGAGCACTGCTCCACGTCCTTCCACGTGACCTGCGCCCA FIGURE 101 cont'd

```
CGCCGCAGGCGTGCTCATGGAGCCGGACGACTGGCCCTATGTGGTCTCCATCACCTGCCTCAAGCACAAG
TCGGGGGGTCACGCTGTCCAACTCCTGAGGGCCGTGTCCCTAGGCCAGGTGGTCATCACCAAGAACCGCA
ACGGGCTGTACTACCGCTGTCGCGTCATCGGTGCCGCCTCGCAGACCTGCTACGAAGTGAACTTCGACGA
TGGCTCCTACAGCGACAACCTGTACCCTGAGAGCATCACGAGTAGGGACTGTGTCCAGCTGGGACCCCCT
TCCGAGGGGGAGCTGGTGGAGCTCCGGTGGACTGACGGCAACCTCTACAAGGCCAAGTTCATCTCCTCCG
TCACCAGCCACATCTACCAGGTGGAGTTTGAGGACGGGTCCCAGCTGACGGTGAAGCGTGGGGACATCTT
CACCCTGGAGGAGGAGCTGCCCAAGAGGGTCCGCTCTCGGCTGTCACTGAGCACGGGGGCACCGCAGGAG
CCCGCCTTCTCGGGGGAGGAGGCCAAGGCCGCCAAGCGCCCGCGTGTGGGCACCCCGCTTGCCACGGAGG
ACTCCGGGCGGAGCCAGGACTACGTGGCCTTCGTGGAGAGCCTCCTGCAGGTGCAGGGCCGGCCCGGAGC
CCCCTTCTAGGACAGCTGGCCGCTCAGGCGACCCTCAGCCCGGCGGGGAGGCCATGGCATGCCCCGGGCG
TTCGCTTGCTGTGAATTCCTGTCCTCGTGTCCCGACCCCCGAGAGGCCACCTCCAAGCCGCGGGTGCCC
CCTAGGGCGACAGGAGCCAGCGGGACGCCGCACGCGGCCCCAGACTCAGGGAGCAGGGCCAGGCGGGCTC
GGGGGCCGGCCAGGGGAGCACCCCACTCAACTACTCAGAATTTTAAACCATGTAAGCTCTCTTCTTCTCG
AAAAGGTGCTACTGCAATGCCCTACTGAGCAACCTTTGAGATTGTCACTTCTGTACATAAACCACCTTTG
TGAGGCTCTTTCTATAAATACATATTGTTTAAAAAAAGCAAGAAAAAAGGAAAACAAAGGAAAATATC
CCCAAAGTTGTTTTCTAGATTTGTGGCTTTAAGAAAAACAAAACAAAACAAACACATTGTTTTTCTCAGA
ACCAGGATTCTCTGAGAGGTCAGAGCATCTCGCTGTTTTTTGTTGTTGTTTTAAAATATTATGATTTGG
CTACAGACCAGGCAGGGAAAGAGACCCGGTAATTGGAGGGTGAGCCTCGGGGGGGAGGGGCAGGACGCCC
CGGTTTCGGCACAGCCCGGTCACTCACGGCCTCGCTCTCGCCTCACCCCGGCTCCTGGGCTTTGATGGTC
TGGTGCCAGTGCCTGTGCCCACTCTGTGCCTGCTGGGAGGAGGCCCAGGCTCTCTGGTGGCCGCCCCTGT
GCACCTGGCCAGGGGAAGCCCGGGGGTCTGGGGCCTCCCTCCGTCTGCGCCCACCTTTGCAGAATAAACT
CTCTCCTGGGGTTTGTCTATCTTTGTTTCTCTCACCCGAGAGAAACGCAGGTGTTCCAGAGGCTTCCTTG
CAGACAAAGCACCCCTGCACCTCCCATGGCTCAGGATGAGGGAGGCCCCCAGGCCCTTCTGGTTGGTAGT
GAGTGTGGACAGCTTCCCAGCTCTTCGGGTACAACCCTGAGCAGGTCGGGGGACACAGGGCCGAGGCAGG
CCTTCGGGGCCCCTTTCGCCTGCTTCCGGGCAGGGACGAGGCCTGGTGTCCTCGCTCCACCCACCCACGC
TGCTGTCACCTGAGGGGAATCTGCTTCTTAGGAGTGGGTTGAGCTGATAGAGAAAAAACGGCCTTCAGCC
CAGGCTGGGAAGCGCCTTCTCCAGGTGCCTCTCCCTCACCAGCTCTGCACCCCTCTGGGGAGCCTTCCCC
ACCTTAGCTGTCTCCTGCCCCAGGGAGGGATGGAGGAGATAATTTGCTTATATTAAAAACAAAAAATGGC
TGAGGCAGGAGTTTGGGACCAGCCTGGGCTATATAGCAAGACCCCATCACTACAAATTTTTTACAAATTA
GCTAGGTGTGGTGGTGCGCACCTGTGGTCCCAGCTACTCGGGAGGCTGTGGTGGGAGGATTGCTTGAGTC
CAGGAGGTTGAGGCTGCAGTCAGCTCAGATTGCACCACTGCACTCCAGCCTGGGCAACAGAGCGAGACCC
TGTCTCC
```

FIGURE 102
SEQ ID NO: 94
Genbank ID           : M29873.1
Unigene ID(#167)     : Hs.415794
Unigene name         :       cytochrome P450, family 2, subfamily B, polypeptide
7 pseudogene         CYP2B7
>gi|181293|gb|M29873.1|HUMCYP2BA Human cytochrome P450-IIB (hIIB3) mRNA, comple
te cds

```
GGAACCATGGAGCTCAGCGTCCTCCTCTTCCTTGCACTCCTCACAGGCCTCTTGCTACTCCTGGTTCAGC
GTCACCCTAACTCCCATGGCACCCTCCCACCAGGGCCCCGCCCTCTGCCCCTTTTGGGGAACCTTCTGCA
GATGGACAGAAGAGGCCTACTCAAATCCTTTCTGAGGTTCCGAGAGAAATATGGGGACGTCTTCACGGTA
CACCTGGGACCGAGGCCCGTGGTCATGCTGTGTGGAGTAGAGGCCATACGGGAGGCCCTGGTGGACAACG
CTGAGGCCTTCTCTGGCCGGGGAAAAATCGTCATCATGGACCCAGTCTACCAGGGATATGGCATGCTCTT
TGCCAATGGAAACCGCTGGAAGGTGCTTCGGCGATTCTCTGTGACCACCATGAGGGACTTCGGGATGGGA
AAGCGGAGTGTGGAGGAGCGGATTCAGGACGAGGCTCAGTGTCTGATAGAGGAACTTCGGAAATCCAAGG
GAGCCCTCGTGGACCCCACCTTCCTCTTCCATTCCATTACCGCCAACATCATCTGCTCCATCATCTTTGG
AAAAACGCTTCCACTACCAAGATCAAGAGTTCCTGAAGACGCTGAACTTGTTCTGCCAGAGTTTCTTACTC
ATCAGCTCTATATCCAGCCAGCTGTTTGAGCTCTTCTCTGGCTTCTTGAAATACTTTCCTGGGGCACACA
GGCAAGTTTACAAAAACCTACAGGAAATCAATGCTTACATTGGCCACAGTGTGGAGAAGCACCGTGAAAC
CCTGGACCCCAGCGCCCCCAGGGACCTCATCGACACCTACCTGCTCCACATGGAAAAAGAGAAATCCAAC
CCACACAGTGAATTCAGCCACCAGAACCTCATCATCAACACGCTCTCGCTCTTCTTTGCTGGCACTGAGA
CCACCAGCACCACTCTCCGCTACGGCTTCCTGCTCATGCTCAAATACCCTCATGTCGCAGAGAGAGTCTA
CAAGGAGATTGAACAGGTGGTTGGCCCACATCGCCCTCCAGCGCTTGATGACCGAGCCAAAATGCCATAC
ACAGAGGCAGTCATCCGTGAGATTCAGAGATTTGCTGACCTTCTCCCCATGGGTGTGCCCCACATTGTCA
CCCAACACACCAGCTTCTGAGGGTACACCATCCCCAAGGACACGGAAGTATTTCTCATCCTGAGCACTGC
TCTCCGTGACCCACACTACTTTGAAAAACCAGACGCCTTCAATCCTGACCACTTTCTGGATGCCAATGGG
```

FIGURE 102 cont'd

```
GCACTGAAAAAGAATGAAGCTTTTATCCCCTTCTCCTTAGGGAAGCGGATTTGTCTTGGTGAAGGCATTG
CCCGTGCGGAATTGTTCCTCTTCTTCACCACCATCCTCCAGAACTTCTCCGTGGCCAGCCCCGTGGCTCC
TGAAGACATCGATCTGACACCCCAGGAGTGTGGTGTGGGCAAAATACCCCCAACATACCAGATCTGCTTC
CTGCCCCGCTGAAGGGCTGAGGGAAGGGGGTCAAAGGATTCCAGGGTCATTCAGTGTCCCCACCTCTGT
AGATAATGGCTCTGACTCCCTGCAACTTCCTGCCTCTGAGAGACCTGCTGCAAGCCAGCTTCCTTCCCTT
CCATGGCACCAGTTGTCTGAGGTCGCAGTGCAAATGAGTGGAGGAGTGAGATTATTGAAAATTATAATAT
ACAAAATTATATATATATATTTTGAGACAGAGTCTCACTCAGTTGCCCAGGCTGGAGTGCAGTGGCGTGA
TCTCGGCTCACTGCAACCTCCACCCCCGGGGTTCAAGAAATTCTCCTGCCTCAGCCTCCCTAGTAGCTGG
GATTACAGGTGTGTGCTACCATGCCTGGCTAATTTTTGTATTTTTAGTAGAGATGGGGTTTCACCGTGTT
GGCCAGGCTGATCTCAAACTCCTGAACTCAAGTGATTCACCCACCTTAGCCTCCCAAAGTGCTGGGATTA
CAGGTGTGAGTCACCATGCCCGGCCATGTATATATATAATTTTAAAAATTAAGATGAAATTCACATAAAA
TAAAATTAGCCATTTTAAAGTGTACAATTTAGTGGTGTGTGGTTCATTCACAAAGCTGTACAACCACCAC
CATCTAGTTCCAAACATTTTCTTTTTTTCTGAGACGGAGTCTCACTCTGTCACCCAGGTTCGAGTTCAGT
GGTCTTGAACTCCTGATGTCAGGTGATTCTCCTAGTTCCAAATGTTTTCATTATCTCTCCCCCAACAAAA
CCCATACCTATCAAGCTGTCACTCCCCATACCCCATTCTCTTTTTCATCTCAGCCCTGTCAATCTGGTT
TTTGTCCTTATGGACTTACCAATTCTGAATATTTCCTATAAACAGAATCACACAATATTTGATTTTTTTT
TTAAAACTAAGCCTTGCTCTGTCTCCCAGGCTGGAGTGCTGTGGCGTGATTTTGGTTCACTGCAACCTCC
GCCTTCCAAGTTCAAGAGATTCTCCTGCCTCAGCTTCCAAGTAGCTGGGATTACAGGCATGTGGTACCAC
GCCTGGCTAATTTTCTTGTATTTTTAGTAGGGACATGTTGGCCAGGCTGGTTGTGAGCTCCTGGCCTCAG
GTGATCCACACGCCTCAGTGTCCCAGAGTGCTGATATTACAGGCGTAATATGTGATCTTTTGTGTCTGGT
TCCTTTCACGTTGAACGCTATTTTTGAGGTTCGTGCCTGTTGTAGACCACAGTCACACACTGCTGTAGTC
TTCCCCCATCCTCATTCCCAGCTGCCTCCTCCTACTGTTTCCCTCTATCAAAAAGCCTCCTTGGCGCAGG
TTCCCTGAGCTGTGGGATTCTGCACTGGTGCTTTGGATTCCCTGATATGTTCCTTCAAATCCACTGAGAA
TTAAATAAACATCGCTAAAGCCTGACCTCCCCACGTC
```

FIGURE 103
SEQ ID NO: 95
Genbank ID        : AK023208.1
Unigene ID(#167)  : Hs.62180
Unigene name      : anillin, actin binding protein (scraps homolog, Drosophila) ANLN
>gi|10435031|dbj|AK023208.1|    Homo    sapiens    cDNA    FLJ13146    fis,    clone
NT2RP3003311

```
ATATGGAGAAGAGCCAAGAGGAGATGGATCAAGCATTAGCAGAAAGCAGCGAAGAACAGGAAGATGCACT
GAATATCTCCTCAATGTCTTTACTTGCACCATTGGCACAAACAGTTGGTGTGGTAAGTCCAGAGAGTTTA
GTGTCCACACCTAGACTGGAATTGAAAGACACCAGCAGAAGTGATGAAAGTCCAAAACCAGGAAAATTCC
AAAGAACTCGTGTCCCTCGAGCTGAATCTGGTGATAGCCTTGGTTCTGAAGATCGTGATCTTCTTTACAG
CATTGATGCATATAGATCTCAAAGATTCAAAGAAACAGAACGTCCATCAATAAAGCAGGTGATTGTTCGG
AAGGAAGATGTTACTTCAAAACTGGATGAAAAAATAATGCCTTTCCTTGTCAAGTTAATATCAAACAGA
AAATGCAGGAACTCAATAACGAAATAAATATGCAACAGACAGTGATCTATCAAGCTAGCCAGGCTCTTAA
CTGCTGTGTTGATGAAGAACATGGAAAAGGGTCCCTAGAAGAAGCTGAAGCAGAAAGACTTCTTCTAATT
GCAACTGGGAAGAGAACACTTTTGATTGATGAATTGAATAAATTGAAGAACGAAGGACCTCAGAGGAAGA
ATAAGGCTAGTCCCCAAAGTGAATTTATGCCATCCAAAGGATCAGTTACTTTGTCAGAAATCCGCTTGCC
TCTAAAAGCAGATTTTGTCTGCAGTACGGTTCAGAAACCAGATGCAGCAAATTACTATTACTTAATTATA
CTAAAAGCAGGAGCTGAAAATATGGTAGCCACACCATTAGCAAGTACTTCAAACTCTCTTAACGGTGATG
CTCTGACATTCACTACTACATTTACTCTGCAAGATGTATCCAATGACTTTGAAATAAATATTGAAGTTTA
CAGCTTGGTGCAAAAGAAAGATCCCTCAGGCCTTGATAAGAAGAAAAAACATCCAAGTCCAAGGCTATT
ACTCCAAAGCGACTCCTCACATCTATAACCACAAAAAGCAACATTCATTCTTCAGTCATGGCCAGTCCAG
GAGGTCTTAGTGCTGTGCGAACCAGCAACTTCGCCCTTGTTGGATCTTACACATTATCATTGTCTTCAGT
AGGAAATACTAAGTTTGTTCTGGACAAGGTCCCCTTTTTATCTTCTTTGGAAGGTCATATTTATTTAAAA
ATAAAATGTCAAGTGAATTCCAGTGTTGAAGAAAGAGGTTTTCTAACCATATTTGAAGATGTTAGTGGTT
TTGGTGCCTGGCATCGAAGATGGTGTGTTCTTTCTGGAAACTGTATATCTTATTGGACTTATCCAGATGA
TGAGAAACGCAAGAATCCCATAGGAAGGATAAATCTGGCTAATTGTACCAGTCGTCAGATAGAACCAGCC
AACAGAGAATTTTGTGCGAGACGCAACACTTTTGAATTAATTACTGTCCGACCACAAAGAGAAGATGACC
GAGAGACTCTTGTCAGCCAATGCAGGGACACACTCTGTGTTACCAAGAACTGGCTGTCTGCAGATACTAA
AGAAGAGCGGGATCTCTGGATGCAAAAACTCAATCAAGTTCTTGTTGATATTCGCCTCTGGCAACCTGAT
GCTTGCTACAAACCTATTGGAAAGCCTTAAACCGGGAAATTTCCATGCTATCTAGAGGTTTTTGATGTCA
TCTTAAGAAACACACTTAAGAGCATCAGATTTACTGATTGCATTTTATGCTTTAAGTACGAAAGGGTTTG
TGCCAATATTCACTACGTATTATGCAGTATTTATATCTTTTGTATGTAAAACTTTAACTGATTTCTGTCA
TTCATCAATGAGTAGAAGTAAATACATTATAGTTGATTTTGCTAAATCTTAATTTAAAAGCCTCATTTTC
```

FIGURE 103 cont'd

```
CTAGAAATCTAATTATTCAGTTATTCATGACAATATTTTTTAAAAGTAAGAAATTCTGAGTTGTCTTCT
TGGAGCTGTAGGTCTTGAAGCAGCAACGTCTTTCAGGGGTTGGAGACAGAAACCCATTCTCCAATCTCAG
TAGTTTTTTCGAAAGGCTGTGATCATTTATTGATCGTGATATGACTTGTTACTAGGGTACTGAAAAAATG
TCTAAGGCCTTTACAGAAACATTTTTAGCAATGAGGATGAGAACTTTTTCAAATAGCAAATATATATTGG
CTTAAAGCATGAGGCTGTCTTCAGAAAAGTGATGTGGACATAGGAGGCAATGTGTGAGACTTGGGGGTTC
AATATTTTATATAGAAGAGTTAATAAGCACATGGTTTACATTTACTCAGCTACTATATATGCAGTGTGGT
GCACATTTTCACAGAATTCTGGCTTCATTAAGATCATTATTTTTGCTGCGTAGCTTACAGACTTAGCATA
TTAGTTTTTTCTACTCCTACAAGTGTGAATTGAAAAATCTTTATATTAAAAAAGTAAACTGTTATGAAGC
TGCTATGTACTAATAATACTTTGCTTGCCAAAGTGTTTGGGTTTTGTTGTTGTTTGTTTGTTTGTTTGTT
TTTGGTTCATGAACAACAGTGTCTAGAAACCCATTTTGAAAGTGGAAAATTATTAAGTCACCTATCACCT
TTAAACGCCTTTTTTTAAAATTATAAAATATTGTAAAGCAGGGTCTCAACTTTTAAATACACTTTGAACT
TCTTCTCTGAATTATTAAAGTTCTTTATGACCTCATTTATAAACACTAAATTCTGTCACCTCCTGTCATT
TTATTTTTATTCATTCAAATGTATTTTTTCTTGTGCATATTATAAAAATATATTTTATGAGCTCTTACT
CAAATAAATACCTGTAAATGTCTAAAGG
```

FIGURE 104
SEQ ID NO: 96
Genbank ID         : AI668629
Unigene ID(#167)   : Hs.25345
Unigene name       :        Transcribed sequences
>gi|4827937|gb|AI668629.1|AI668629 yo65d06.x5 Soares breast 3NbHBst Homo sapien
s cDNA clone IMAGE:182795 3', mRNA sequence
```
ATCTNNATAAAAAAATGTATTTATTGAATGTCTTGGAAGTATACTAATACATTTCTGTTGTAATACATT
AAATGATACAATATGAAAAAGTATAAAAACAAAGTTAATTATCTCTCCCTGCCTTCCTTCTACCTATGCT
TCGCATTCCTCAGTGGAAACCAATTTTAGTGGTCTGGTATGTACCTTCATACCTATCTCCTTGTTGAAAT
GAATATATATAGCATATTATCTAAAGGGGTTTGGTTGGTTGATTGTTAGTGCTGAAATGAACTTTAAATA
CATGCATTATTCTGTAGTATGCTTCTTTCACATGTCAATATATTGTGGGCATTTCTAGAAGTCAGTAAAT
ACAGATCTAAGCTTGCTTTACTAACTTCCTGAGGTAGACAAAAGCAAACAAATATTATATATCATCATAA
TGGTATAATCATTTCTGTATTCAGTTGTATCATAATCATATGATTATGTTATATTTTACATACATATTAT
ATATTGCATCATACATAATTATACATATTACACATATTTATATATAACAGTTAAAGTAAATTCATGAATT
CTCT
```

FIGURE 105
SEQ ID NO: 97
Genbank ID         : AL137566.1
Unigene ID(#167)   : Hs.32405
Unigene name       :        MRNA; cDNA DKFZp686A0815 (from clone DKFZp686A0815)

>gi|6808275|emb|AL137566.1|HSM802310 Homo sapiens mRNA; cDNA DKFZp586G0321 (fro
m clone DKFZp586G0321)
```
ATTAGGGATAGGAAGAGATTTTCACATGGCAGACTTTAGAATTCTTCACTTTAGCCAGTAAAGTATCTCC
TTTTGATCTTAGTATTCTGTGTATTTTAACTTTTCTGAGTTGTGCATGTTTATAAGAAAAATCAGCACAA
AGGGTTTAAGTTAAAGCCTTTTTACTGAAATTTGAAAGAAACAGAAGAAAATATCAAAGTTCTTTGTATT
TTGAGAGGATTAAATATGATTTACAAAAGTTACATGGAGGGCTCTCTAAAACATTAAATTAATTATTTTT
TGTTGAAAAGTCTTACTTTAGGCATCATTTTATTCCTCAGCAACTAGCTGTGAAGCCTTTACTGTGCTGT
ATGCCAGTCACTCTGCTAGATTGTGGAGATTACCAGTGTTCCGTCTTCTCCGAGCTTAGAGTTGGATGG
GGAATAAAGACAGGTAAACAGATAGCTACAATATTGTACTGTGAATGCTTATGCTGGAGGAAGTACAGGG
AACTATTGGAGCACCTAAGAGGAGCACCTACCTTGAATTTAGGGGTTAGCAGAGGCATCCTGAAAAAGT
CAAAGCTAAGCCACAATCTATAAGCAGTTTAGGAATTAGCAGAACGTGCATGGTGAGGAGATGCCAAAGG
CAAGAAGAGAAGAGTATTCCAAACAGGAGGGATTCCAAAGAGAGAAGAGTATCCCAAACAACATTTGCAC
AAACCTGATGGGGAGAGAGAATGTGGGTGGGGATGGATGATGAGACTGAAGAAGAAAGCCAGGTCTAGA
TAATCAGTGGCCTTGTACACCATGTTAAAGAGTGTAGACTTGATTCTGTTGTAAACAGGAAAGCAGCACA
ATTCATATGAATATTTTAGAAGACTCCCACTGGAATATGGAGAATAAAGTTGGAGATGACTAATCCTGGA
AGCAGGGAGAACATTTTTGAGGAAGTTGCACTATTTTGGTGAAAATGATGGTCATAAACATGAAGAATTG
TAGGTGATCATGACCTCTCTCTAATTTTCCAGAAGGGTTTTGGAAGATATAACATAGGAACATTGACAGG
ACTGACGAAAGGAGATGAAATACACCATATAAATTGTCAAACACAAGGCCAGATGTCTAATTATTTTGCT
```

FIGURE 105 cont'd

```
TATGTGTTGAAATTACAAATTTTTCATCAGGAAACCAAAAACTACAAAACTTAGTTTTCCCAAGTCCCAG
AATTCTATCTGTCCAAACAATCTGTACCACTCCACCTATATCCCTACCTTTGCATGTCTGTCCAACCTCA
AAGTCCAGGTCTATACACACGGGTAAGACTAGAGCAGTTCAAGTTTCAGAAAATGAGAAAGAGGAACTGA
GTTGTGCTGAACCCATACAAAATAAACACATTCTTTGTATAGATTCTTGGAACCTCGAGAGGAATTCACC
TAACTCATAGGTATTTGATGGTATGAATCCATGGCTGGGCTCGGCTTTTAAAAAGCCTTATCTGGGATTC
CTTCTATGGAACCAAGTTCCATCAAAGCCCATTTAAAAGCCTACATTAAAAACAAAATTCTTGCTGCATT
GTATACAAATAATGATGTCATGATCAAATAATCAGATGCCATTATCAAGTGGAATTACAAAATGGTATAC
CCACTCCAAAAAAAAAAAAAAAGCTAAATTCTCAGTAGAACATTGTGACTTCATGAGCCCTCCACAGCCT
TGGAGCTGAGGAGGGAGCACTGGTGAGCAGTAGGTTGAAGAGAAACTTGGCGCTTAATAATCTATCCAT
GTTTTTTCATCTAAAAGAGCCTTCTTTTGGATTACCTTATTCAATTTCCATCAAGGAAATTGTTAGTTC
CACTAACCAGACAGCAGCTGGGAAGGCAGAAGCTTACTGTATGTACATGGTAGCTGTGGGAAGGAGGTTT
CTTTCTCCAGTTCCTCACTGGCCATACACCAGTCCCTTGTTAGTTATGCCTGGTCATAGACCCCCGTTGC
TATCATCTCATATTTAAGTCTTTGGCTTGTGAATTTATCTATTCTTTCAGCTTCAGCACTGCAGAGTGCT
GGGACTTTGCTAACTTCCATTTCTTGCTGGCTTAGCACATTCCTCATAGGCCCAGCTCTTTTCTCATCTG
GCCCTGCTGTGGAGTCACCTTGCCCCTTCAGGAGAGCCATGGCTTACCACTGCCTGCTAAGCCTCCACTC
AGCTGCCACCACACTAAATCCAAGCTTCTCTAAGATGTTGCAGACTTTACAGGCAAGCATAAAAGGCTTG
ATCTTCTGGACTTCCCTTTACTTGTCTGAATCTCACCTCCTTCAACTTTCAGTCTCAGAATGTAGGCAT
TTGTCCTCTTTGCCCTACATCTTCCTTCTTCTGAATCATGAAAGTCTCTCACTTCCTCTTGCTATGTGCT
GGAGGCTTCTGTCAGGTTTTAGAATGAGTTCTCATCTAGTCCTAGTAGCTTTTGATGCTTAAGTCCACCT
TTTAAGGATACCTTTGAGATTTAGACCATGTTTTTCGCTTGAGAAAGCCCTAATCTCCAGACTTGCCTTT
CTGTGGATTTCAAAGACCAACTGAGGAAGTCAAAAGCTGAATGTTGACTTTCTTTGAACATTTCCGCTAT
AACAATTCCAATTCTCCTCAGAGCAATATGCCTGCCTCCAACTGACCAGGAGAAAGGTCCAGTGCCAAAG
AGAAAAACACAAAGATTAATTATTTCAGTTGAGCACATACTTTCAAAGTGGTTTGGGTATTCATATGAGG
TTTTCTGTCAAGAGGGTGAGACTCTTCATCTATCCATGTGTGCCTGACAGTTCTCCTGGCACTGGCTGGT
AACAGATGCAAAACTGTAAAAATTAAGTGATCATGTATTTTAACGATATCATCACATACTTATTTTCTAT
GTAATGTTTTAAATTTCCCCTAACATACTTTGACTGTTTTGCACATGGTAGATATTCACATTTTTTTGTG
TTGAAGTTGATGCAATCTTCAAAGTTATCTACCCCATTGCTTATTAGTAAAACTAGTGTTAATACTTGGC
AAGAGATGCAGGGAATCTTTCTCATGACTCACGCCCTATTTAGTTATTAATGCTACTACCCTATTTTGAG
TAAGTAGTAGGTCCCTAAGTACATTGTCCAGAGTTATACTGTTAAAGATATTTAGCCCCATATACTTCTT
GAATCTAAAGTCATACACCTTGCTCCTCATTTCTGAGTGGGAAAGACATTTGAGAGTATGTTGACAATTG
TTCTGAAGGTTTTTGCCGAGAAGGTGAAACTGTCCTTTCATCTGTGTATGCCTGGGGCTGGGTCCCTGGC
AGTGATGGGGTGACAATGCAAAGCTGTAAAAACTAGGTGCTAGTGGGCACCTAATATCATCATCATATAC
TTATTTTCAAGCTAATATGCAAAATCCCATCTCTGTTTTTAAACTAAGTGTAGATTTCAGAGAAAATATT
TTGTGGTTCACATAAGAAAACAGTCTACTCAGCTTGACAAGTGTTTTATGTTAAATTGGCTGGTGGTTTG
AAATGAATCATCTTCACATAATGTTTCTTTAAAAATATTGTGAATTTAACTCTAATTCTTGTTATTCTG
TGTGATAATAAAGAATAAACTAATTTCTATAAAAAAAAAAAAAAAAAGG
```

FIGURE 106

SEQ ID NO: 98

```
Genbank ID        : NM_000824.1
Unigene ID(#167)  : Hs.32973
Unigene name      :     glycine receptor, beta   GLRB
>gi|4504022|ref|NM_000824.1| Homo sapiens glycine receptor, beta (GLRB),
mRNA
GAGCCTCCACGATCTCGCCCGGCGATTGTGGGCAGGGGCGCCTCCGGATCGATCTTCTGAAATTCAAGTT
TTCAAGATGAAGTTTTTATTGACAACTGCCTTTTTAATTTTAATTTCCTTGTGGGTGGAAGAAGCCTATT
CTAAGGAAAAGTCTTCAAAGAAAGGGAAGGGGAAAAGAAGCAGTATCTATGCCCATCTCAGCAGTCAGC
AGAGGACCTTGCCCGAGTACCTGCCAACTCCACTAGCAATATCTTGAACAGGTTATTGGTCAGTTATGAT
CCCAGGATAAGACCAAACTTCAAAGGCATTCCTGTTGATGTAGTAGTCAACATTTTTATTAACAGTTTTG
GATCCATTCAAGAAACAACAATGGACTATAGAGTTAACATCTTCCTGAGACAAAAATGGAATGACCCCAG
GCTGAAGCTCCCCAGTGATTTTAGGGGTTCAGATGCACTGACAGTGGATCCAACAATGTACAAGTGTTTA
TGGAAACCTGATTTATTTTTGCAAATGAAAAAGTGCCAATTTTCATGATGTGACCCAGGAAAACATCC
TCCTCTTTATTTTTCGTGATGGAGATGTCTTTGTCAGCATGAGGTTATCTATTACTCTTTCATGCCCTTT
GGACTTGACATTGTTTCCCATGGATACACAACGTTGCAAGATGCAACTGGAGAGCTTTGGTTACACAACT
GATGATTTACGATTTATCTGGCAGTCAGGAGATCCTGTGCAATTAGAAAAAATTGCCTTGCCTCAATTTG
ATATCAAAAGGAAGATATTGAATATGGTAACTGTACAAAATACTATAAAGGCACGGGCTACTACACATG
CGTGGAAGTCATCTTCACCCTGAGGAGGCAGGTCGGCTTTTACATGATGGGGGTCTACGCCCCAACCCTG
CTCATTGTTGTTCTCTCCTGGCTTTCCTTCTGGATCAACCCGGACGCGAGTGCTGCCAGAGTGCCCCTGG
GTATCTTCTCAGTCCTCAGCTTGGCCTCTGAGTGCACAACCCTTGCCGCTGAGCTTCCCAAAGTTTCCTA
TGTGAAGGCTCTTGATGTTTGGCTTATTGCTTGCCTTCTCTTTGGGTTTGCTTCCCTGGTGGAGTATGCA
```

FIGURE 106 cont'd

GTTGTCCAGGTGATGCTGAACAACCCCAAAAGGGTTGAAGCTGAAAAAGCCAGAATTGCTAAGGCTGAGC
AAGCAGATGGAAAAGGTGGAAATGTGGCTAAAAAGAATACTGTGAATGGAACAGGGACTCCTGTTCATAT
TAGCACTTTGCAGGTTGGTGAGACCAGATGCAAAAAAGTTTGTACTTCTAAGTCTGATCTGAGATCTAAT
GACTTCAGCATTGTTGGAAGCTTACCAAGAGATTTTGAACTATCCAATTATGACTGCTATGGAAAACCCA
TTGAAGTTAACAACGGACTTGGGAAATCTCAGGCTAAGAACAACAAGAAGCCTCCCCCTGCGAAACCTGT
TATTCCAACAGCAGCAAAGCGAATTGATCTTTATGCAAGAGCATTGTTTCCTTTCTGCTTCTTGTTCTTC
AATGTTATATATTGGTCTATATATTTATGATAAATCTTTTCCATTTGTACAAAATAAAATTCCATTTCAT
TGTGACCTACTCCTTTCATAAATGCCAATCTGTGAGAACTTTTGAATTTTCATAGCAACATTGCATTTTG
GATGCCATTTGATTGTAATAAAACTGTGGCACCTTAATTTTGAATGGCAGCATGATCATGTAATATCTGT
GCTCTAATAACGATGTATATATGTATAGTGAACATATTGCTTAGTAACAAATGAAGGACAAGCATACTAC
ATAATATAATCCATACAATTCTCTTCAGTTAGTGTAAACTGCAAATACTACAGATAATTCTGATAATAAA
ATGATATGCACGCTGAATCCTGCTATGGTACCATTCTAATGTATGTAGTATTTCAAATTTCCTTCCTTGT
AACTTTCAAAGAAAGCCATCTTATTCTTGTAAAATTTTAGATGGTATTATCACAGATTTAAAAAGGTTGT
ATTACATATTGTTTAAACTTTGTAAGTAGAAATATATCTGTTATAATTATACAGGCTCTGTGGAGAAATA
AAGTTC

FIGURE 107
SEQ ID NO: 99
Genbank ID         : AA760689
Unigene ID(#167)   : Hs.210532
Unigene name       :      KIAA0141 gene product    KIAA0141
>gi|2809619|gb|AA760689.1|AA760689  nz13a05.s1  NCI_CGAP_GCB1  Homo  sapiens
cDNA c
lone IMAGE:1287632 3' similar to contains element MER22 repetitive element
;, m
RNA sequence
TTTTTTTTTTTTTTTTTTTTTTTTTTTGCAACAAACATTTTGTGTTTATTGAATAATTACTAAGTG
CCAGAAGTAGCACAGGAAACCGTGTGTGTGTGTGCGTGTGTGCGTGTGTATAGGCGGCGAGTGGGGGG
CAATACAGAATTATTCATTCAAGTTATTTAAAATTATTCATTCAAATTACTTAAAGTACCTACTATGTGC
TGGGTAGGCTTGGTGCTGGGCATTGGGTGGGGGGAGTTGAGTATAATCACTCACTTATTTGTTGAATGTA
TATTTACTGAACATCTGAGTGCCCCACACTATATTAGCACTAATGATATAGTAAACCAAATAGCCTTGTT
CCCATCATAGTGTCAGGACTCCCTGAAAACAGCATCTCCGGATAGGGAAACTGAGGCAGTAGAGCTTCCC
ACAAAGGTCTCATTGGTGAGGGCGCCGGGCTTTAACCCAGCATCCTGACCCAGGCTGGCCCTGCTGATGG
GAGCCACCTCCCTCTCGTCCTCTCACACTTCCTCTGGGGCACTGATGATGAGTCATTAATAACAGAATTT
TAATGG FIGURE 108
SEQ ID NO: 100
Genbank ID         : AW959427
Unigene ID(#167)   : Hs.98849
Unigene name       :      dynein, cytoplasmic, light polypeptide 2B DNCL2B
>gi|8149111|gb|AW959427.1|AW959427  EST371497  MAGE  resequences,  MAGF  Homo
sapien
s cDNA, mRNA sequence
CAGCCCTGACGCTTCCGTGGGGCCACTTCCTTCTTTGTCTCCTAGCAACGGCGGGTAGCGTTGTTGACAT
CCCGGGAGGCTGTGCCGCCGGCCTGAGCCCAGAGTTTCGCGGCCTCCGCGATGGCAGAGGTGGAGGAAAC
CTTAAAGAGGATCCAGAGTCATAAAGGGGTTATTGGAACTATGGTTGTAAATGCAGAAGGTATTCCCATC
CGAACAACCTTGGACAACTCAACAACTGTTCAATATGCAGGCCTTCTTCATCACCTGACAATGAAAGCCA
AAAGCACAGTTCGTGATATTGATCCTCAGAACGACCTGACTTTTCTTAGGATCAGATCAAAGAAACATGA
AATCATGGTAGCTCCAGATAAGGAATATCTTCTGATCGTCATTCAGAATCCATGTGAATAGACCTGCGAT
GGCCAAGGCTGTTTAAGCGACACTGGGTTGGAAACACTTGGCTCTCTTATGAGTATAAAATTCTATTTCA
ATCTAAAAAAAAAAAAAAAAAAACTCGGGGGGGGGGCCCGTACCCAATTCGCCCTTATGGGGGCGTATTA
CAATTAACTGGCCCGCGTTTTACAACGCGTGACTGGAAAAAACCCTGC FIGURE 109
SEQ ID NO: 101
Genbank ID         : AB007899.1

FIGURE 109 cont'd

Unigene ID(#167) : Hs.249798
Unigene name : neural precursor cell expressed, developmentally down-regulated 4-like NEDD4L
>gi|2662158|dbj|AB007899.1| Homo sapiens KIAA0439 mRNA, partial cds
GCCCGGGTGGGTGGCTGCGCAGGGCCCTACCTGGGCGGGAGCGGCTGCAGAGCCCTGTCCACGCGGTGCC
TCCCCAGCACGGCACCTCCCACTCCAGGCTGTTGGTTACCTGGCCGGGAGCTGGCAGAGACCAGGATTTC
TCCTCGCCGCCGTTGCTGTTGTTAGGGGAAACAGACCATCTGCATCTAGACCTGCCTCTCTCTCCGCTCC
CCACTTCAGACGAGCTCTTCCTGCCTGGAATCTGTGATCCGTATGTGAAACTTTCATTGTACGTAGCGGA
TGAGAATAGAGAACTTGCTTTGGTCCAGACAAAAACAATTAAAAAGACACTGAACCCAAAATGGAATGAA
GAATTTTATTTCAGGGTAAACCCATCTAATCACAGACTCCTATTTGAAGTATTTGACGAAAATAGACTGA
CACGAGACGACTTCCTGGGCCAGGTGGACGTGCCCCTTAGTCACCTTCCGACAGAAGATCCAACCATGGA
GCGACCCTATACATTTAAGGACTTTCTCCTCAGACCAAGAAGTCATAAGTCTCGAGTTAAGGGATTTTTG
CGATTGAAAATGGCCTATATGCCAAAAAATGGAGGTCAAGATGAAGAAAACAGTGACCAGAGGGATGACA
TGGAGCATGGATGGGAAGTTGTTGACTCAAATGACTCGGCTTCTCAGCACCAAGAGGAACTTCCTCCTCC
TCCTCTGCCTCCCGGTGGGAAGAAAAAGTGGACAATTTAGGCCGAACTTACTATGTCAACCACAACAAC
CGGACCACTCAGTGGCACAGACCAAGCCTGATGGACGTGTCCTCGGAGTCGGACAATAACATCAGACAGA
TCAACCAGGAGGCAGCACACCGGCGCTTCCGCTCCCGCAGGCACATCAGCGAAGACTTGGAGCCCGAGCC
CTCGGAGGGCGGGATGTCCCCGAGCCTTGGGAGACCATTTCAGAGGAAGTGAATATCGCTGGAGACTCT
CTCGGTCTGGCTCTGCCCCCACCACCGGCCTCCCCAGGATCTCGGACCAGCCCTCAGGAGCTGTCAGAGG
AACTAAGCAGAAGGCTTCAGATCACTCCAGACTCCAATGGGAACAGTTCAGCTCTTTGATTCAAAGAGA
ACCCTCCTCAAGGTTGAGGTCATGCAGTGTCACCGACGCAGTTGCAGAACAGGGCCATCTACCACCGCCA
TCAGTGGCCTATGTACATACCACGCCGGGTCTGCCTTCAGGCTGGGAAGAAAGAAAAGATGCTAAGGGGC
GCACATACTATGTCAATCATAACAATCGAACCACAACTTGGACTCGACCTATCATGCAGCTTGCAGAAGA
TGGTGCGTCCGGATCAGCCACAAACAGTAACAACCATCTAATCGAGCCTCAGATCCGCCGGCCTCGTAGC
CTCAGCTCGCCAACAGTAACTTTATCTGCCCCGCTGGAGGGTGCCAAGGACTCACCCGTACGTCGGGCTG
TGAAAGACACCCTTTCCAACCCACAGTCCCCACAGCCATCACCTTACAACTCCCCCAAACCACAACACAA
AGTCACACAGAGCTTCTTGCCACCCGGCTGGGAAATGAGGATAGCGCCAAACGGCCGGCCCTTCTTCATT
GATCATAACACAAAGACTACAACCTGGGAAGATCCACGTTTGAAATTTCCAGTACATATGCGGTCAAAGA
CATCTTTAAACCCCAATGACCTTGGCCCCCTTCCTCCTGGCTGGGAAGAAAGAATTCACTTGGATGGCCG
AACGTTTTATATTGATCATAATAGCAAAATTACTCAGTGGGAAGACCCAAGACTGCAGAACCCAGCTATT
ACTGGTCCGGCTGTCCCTTACTCCAGAGAATTTAAGCAGAAATATGACTACTTCAGGAAGAAATTAAAGA
AACCTGCTGATATCCCCAATAGGTTTGAAATGAAACTTCACAGAAATAACATATTTGAAGAGTCCTATCG
GAGAATTATGTCCGTGAAAAGACCAGATGTCCTAAAAGCTAGACTGTGGATTGAGTTTGAATCAGAGAAA
GGTCTTGACTATGGGGTGTGGCCAGAGAATGGTTCTTCTTACTGTCCAAAGAGATGTTCAACCCCTACT
ACGGCCTCTTTGAGTACTCTGCCACGGACAACTACACCCTTCAGATCAACCCTAATTCAGGCCTCTGTAA
TGAGGATCATTTGTCCTACTTCACTTTTATTGGAAGAGTTGCTGGTCTGGCCGTATTTCATGGGAAGCTC
TTAGATGGTTTCTTCATTAGACCATTTTACAAGATGATGTTGGGAAAGCAGATAACCCTGAATGACATGG
AATCTGTGGATAGTGAATATTACAACTCTTTGAAATGGATCCTGGAGAATGACCCTACTGAGCTGGACCT
CATGTTCTGCATAGACGAAGAAACTTTGGACAGACATATCAAGTGGATTTGAAGCCCAATGGGTCAGAA
ATAATGGTCACAAATGAAAACAAAAGGGAATATATCGACTTAGTCATCCAGTGGAGATTTGTGAACAGGG
TCCAGAAGCAGATGAACGCCTTCTTGGAGGGATTCACAGAACTACTTCCTATTGATTTGATTAAAATTTT
TGACGAAAATGAGCTGGAGTTGCTCATGTGCGGCCTCGGTGATGTGGATTGAATGACTGGAGACAGCAT
TCTATTTACAAGAACGGCTACTGCCCAAACCACCCCGTCATTCAGTGGTTCTGGAAGGCTGTGCTACTCA
TGGACGCCGAAAAGCGTATCCGGTTACTGCAGTTTGTCACAGGGACATCGCGAGTACCTATGAATGGATT
TGCCGAACTTTATGGTTCCAATGGTCCTCAGCTGTTTACAATAGAGCAATGGGGCAGTCCTGAGAAACTG
CCCAGAGCTCACACATGCTTTAATCGCCTTGACTTACCTCCATATGAAACCTTTGAAGATTTACGAGAGA
AACTTCTCATGGCCGTGGAAAATGCTCAAGGATTGAAGGGGTGGATTAAGCACCCTGTGCCTCGGGGGT
GGTTGTTCTTCAAGCAAGTTCTGCTTGCACTTTTGCATTTGCCTAACAGACTTTTGCAGAGGCGATGGCA
GAGAGCAGCTGCAGGCATGGTCCCTGGAGCCGAGCCTTCACCACGCACTCGTCCAAGTTCGGATGCGGGA
ACCTGGTCCCAGCTTGAGTTCCTGCCTTTCCCACCACAAATTATCAACTGGTTGATGTGTACACTAATTA
CATTTCAGGAGGACTTAATGCTATTTATGTTGTGCCTCTGCAGGCAAAGCCCTTAATAAATATTTTACAT
CCTTTCTAATGACAATGAATGGAATTAATCACTCAACAGGTATAGTATTACGACTCATGTTTACTTTTTA
AAATGATTTAGACCGATTTTCAGATTTTATTTCGTTATGATTAAAGATGTCTCATGTACTTGGAAAAGTG
AGCATTTTTTTTTTTTTTGTATTTCACTTTCATACCAGGCTTAATGTCAATGACATTTTTATTTTTGAA
GTACTCTGACACCTCCACCCTCTACTTTATTAGAATTGGAAGGCAAATTTTTGTCCAAAAACCTACAGAC
AAGTACTTTGAGAGAATTTCCAATATAATATTAGACATAATGATAATTTTTTCCATACTCAGAATGAAAA
ACTGGATATTACGTTTTTGTTTGGGGTTTTTTTGTACAAATTTAGCTAATAGCTACAGGCTGAGAGAAT
TGTAACATAGCATGACAAATTTTGTGTTGACTTGAAAGGAATCACACCATTATTCCTTAGAAGTAATTAC
ATGTGTTCTAACACATTTGAGACAGGGTTGGACTCCCATTTCTCATCCGAGAAATTACTTAACCCTTCCT
GGCGCTGTACAGTCATCTTTTATTCTATTTCCTCTTTGCTGTTTGTAGTAGAGACATTTTGAATGAAACT
TGGCACTGCTTGATTCAAAACTGTGGAAACCAGATCTGTTTAGTCTCCTGTTTGTATGCGTTTGCTAATG FIGURE 109 cont'd GTAGCTAAATAACCAGTTTTTGTTGTAAATGCACCAATTCTGAAGGCACTTTATGTACTACATGGAGGTC
ATATCTGGTTTTGTTTTTATTTTTTTATCATGAACATTAAATGTGATGATGATTTCTTTTCCCTGCACAC
ATCTTTCCGGTGCAATATCTATCAATTGTGAATCTGGCTGCTGGTGTATAAAAACCTGGATGTAAAGCTG
AGCCTACAGACCTGTCCTCACCAACTGTTTTGTGATTTCTACTCAACTACAAAGATTTATTTAATGTACT
CTTAATCTAACTGAGTTTTGTTACCAATGACCTGTTGCATGCTTCAATACCGTGTACTGCCTGAGTTGTG
CCTCTTGTGTGCTAGATTAAAAGTGAGACAGAGACTTGACTTGATCCTCTGAGCTCAAGCTATTGAGCTG
GTAGTGGCAGAGGACTGAGGGTACCTGCACAGTTTGATTCTTTTCCACGTGTAAGTCTCCATTGCAGAAT
TGTCGTGCTTTGAGAAAACACCTGAGGCAGTGTGGGAGTTGAACGACCCTGCTGTCCTTTTTAACCTGTG
TTGTCCTAGACCCTGTCGGGGCAGTCAGGGGACACTAGAGATTTGATCTCATGCGAGTCATCAATAGGAC
AAAAAAGTTGTGGTTTGGGGAGGTCTGTTTGTTACATAAAAAGGACCTTTCGGTGTAAGAAATTGCCGTT
TTTACCCTGCCCTGGCTGGCATGTGAGAAGCCATGGAAGGTTGTGGTTGTAAATGAGTTGTCTAAAGGGG
TGCAGAGGCCTGAGGTTTCTAAAAGAAGGTAGATTTCTACAGAGCTGAGTGTTGGTTCCTTTTTCTTATT
GGTTGAAAATTACCTGGTAGTGATCAGAAAACTTAGATGCTATGTAACT

FIGURE 110
SEQ ID NO: 102
```
Genbank ID       : AI469788
Unigene ID(#167) : Hs.381225
Unigene name     :        kinetochore protein Spc24       Spc24
>gi|4331878|gb|AI469788.1|AI469788  tm20h11.x1  NCI_CGAP_Co14  Homo  sapiens
cDNA c
lone IMAGE:2157189 3' similar to contains element MER36 repetitive element
;, m
RNA sequence
```
AGCGGCCGCCCTTTTTTTTTTTTTTTTTTTTTTTTTGGAGTATATGTTCAGTTAGGGTTTATTTTGG
TATCTGTCATAGAAAACCCCCAAAACCAGCAGCTTACACAAGGTAGAAGTTGAGATTGGTTCTCCCCTTC
TCTCTCCCATTTAAGTAAGTTTGTGCTGATATCTGGCTCTGCCATCATCAGGGAACCAGGCTCCTGTCAT
CCCTAAAGGACGGCACTCGTCTGTACACGTGGCAGTATGGCTGCCAGGGCTCCAGCCATCACACCCACAT
TCCAGGAAATAGGAAGGGGGAAGAAAGGGTGTATTTGTCTTTTAAGAATCCTTCTAGAAGTGTCATGTAA
CATTTCCACATACATTTCACTGGCCAGACCTTAACTATAAGGGCAG

FIGURE 111
SEQ ID NO: 103
```
Genbank ID       : AI796169
Unigene ID(#167) : Hs.169946
Unigene name     :        GATA binding protein 3   GATA3
>gi|5361632|gb|AI796169.1|AI796169  wh43d10.x1  NCI_CGAP_Kid11  Homo  sapiens
cDNA
clone  IMAGE:2383507  3'  similar  to  gb:X58072_rna1  TRANS-ACTING  T-CELL
SPECIFIC T
RANSCRIPTION FACTOR (HUMAN);, mRNA sequence
```
TGGTTTTTTTTAGTTTTAAAATATTTTCACTTTATTATTATGCTTATAATATTATTCCAACAGACTGTAT
TAAAGGCAGTGATCACTAACACAGAACACGACAGGGCGAAGAGGCAGCCGGGCCGATTGCAGGACGTGGC
CTGTCGGGCCAGGGTCGCTGACATGCACGCTGGTAGCTCATACACTGCTACCCTCAGCACAGGCTGCAGG
AATTAGGGACAAGACAGATGCCGCCGGACTCTTAGAAGCTATTTAATAAATATCATCCAAAAACAAATG
GAAAAGAAACAAGAAACCCTCCGAGCACAACCACCTTAGGCCAACTGAATGTAATCTAGTTTATTCAACC
AAAAATTGAGAGAGAAGGAAAATATTGAAACAAACAAACGAAAGAAAGCAGTTCTTAAGACTAGCAGTAA
ATAAATTTATACAACAGTTCGGTCTGTATAATATGATGAAATAAATCTACATCTTTTCTTATTTTGGTGC
TTTGAATTATACATACAAACAACAATTACAGGGACTTGTTCACAAAGCATGTAGGCCTAGAAAAGGCTCT
CTGAGACCCTCAATGGCAACTGGTAACGGTAACACTGATTGCCCAGAACTGGTATTTNCTTTGCAGAGG
CCAACAGCTTTGAACACATGATTCGCCTACAACTATTTGCTTTGTCTGTCTTTTCTGTTTTTGCTTTTGT
CTATTATCTTTTAAGGCACCAAACAACTGTGGCCAGTGAAAAGAAACAAAAACTGCAGTCTGTCCATTTG
AATATCANGACTAGNTCCTTCCTAATNTCACAC

FIGURE 112
SEQ ID NO: 104
```
Genbank ID       : NM_000826.1
Unigene ID(#167) : Hs.335051
```

FIGURE 112 cont'd

Unigene name : glutamate receptor, ionotropic, AMPA 2  GRIA2
>gi|4758479|ref|NM_000826.1| Homo sapiens glutamate receptor, ionotropic, AMPA
2 (GRIA2), mRNA
AGGGATTCTTCTGCCTCCACTTCAGGTTTTAGCAGCTTGGTGCTAAATTGCTGTCTCAAAATGCAGAGGA
TCTAATTTGCAGAGGAAAACAGCCAAAGAAGGAAGAGGAGGAAAAGGAAAAAAAAAGGGGTATATTGTGG
ATGCTCTACTTTTCTTGGAAATGCAAAAGATTATGCATATTTCTGTCCTCCTTTCTCCTGTTTTATGGGG
ACTGATTTTTGGTGTCTCTTCTAACAGCATACAGATAGGGGGCTATTTCCTAGGGGCGCCGATCAAGAA
TACAGTGCATTTCGAGTAGGGATGGTTCAGTTTTCCACTTCGGAGTTCAGACTGACACCCCACATCGACA
ATTTGGAGGTGGCAAACAGCTTCGCAGTCACTAATGCTTTCTGCTCCCAGTTTTCGAGAGGAGTCTATGC
TATTTTTGGATTTTATGACAAGAAGTCTGTAAATACCATCACATCATTTTGCGGAACACTCCACGTCTCC
TTCATCACTCCCAGCTTCCCAACAGATGGCACACATCCATTTGTCATTCAGATGAGACCCGACCTCAAAG
GAGCTCTCCTTAGCTTGATTGAATACTATCAATGGGACAAGTTTGCATACCTCTATGACAGTGACAGAGG
CTTATCAACACTGCAAGCTGTGCTGGATTCTGCTGCTGAAAAGAAATGGCAAGTGACTGCTATCAATGTG
GGAAACATTAACAATGACAAGAAAGATGAGATGTACCGATCACTTTTTCAAGATCTGGAGTTAAAAAAGG
AACGGCGTGTAATTCTGGACTGTGAAAGGGATAAAGTAAACGACATTGTAGACCAGGTTATTACCATTGG
AAAACACGTTAAAGGGTACCACTACATCATTGCAAATCTGGAATTTACTGATGGAGACCTATTAAAAATC
CAGTTTGGAGGTGCAAATGTCTCTGGATTTCAGATAGTGGACTATGATGATTCGTTGGTATCTAAATTTA
TAGAAAGATGGTCAACACTGGAAGAAAAAGAATACCCTGGAGCTCACACAACAACAATTAAGTATACTTC
TGCTCTGACCTATGATGCCGTTCAAGTGATGACTGAAGCCTTCCGCAACCTAAGGAAGCAAAGAATTGAA
ATCTCCCGAAGGGGGAATGCAGGAGACTGTCTGGCAAACCCAGCAGTGCCCTGGGGACAAGGTGTAGAAA
TAGAAAGGGCCCTCAAACAGGTTCAGGTTGAAGGTCTCTCAGGAAATATAAAGTTTGACCAGAATGGAAA
AAGAATAAACTATACAATTAACATCATGGAGCTCAAAACTAATGGGCCCCGGAAGATTGGCTACTGGAGT
GAAGTGGACAAAATGGTTGTTACCCTTACTGAGCTCCTTCTGGAAATGACACCTCTGGGCTTGAGAATA
AGACTGTTGTTGTCACCACAATTTTGGAATCTCCGTATGTTATGATGAAGAAAAATCATGAAATGCTTGA
AGGCAATGAGCGCTATGAGGGCTACTGTGTTGACCTGGCTGCAGAAATCGCCAAACATTGTGGGTTCAAG
TACAAGTTGACAATTGTTGGTGATGGCAAGTATGGGGCCAGGGATGCAGACACGAAAATTTGGAATGGGA
TGGTTGGAGAACTTGTATATGGGAAAGCTGATATTGCAATTGCTCCATTAACTATTACCCTTGTGAGAGA
AGAGGTGATTGACTTCTCAAAGCCCTTCATGAGCCTCGGGATATCTATCATGATCAAGAAGCCTCAGAAG
TCCAAACCAGGAGTGTTTTCCTTTCTTGATCCTTTAGCCTATGAGATCTGGATGTGCATTGTTTTTGCCT
ACATTGGGGTCAGTGTAGTTTTATTCCTGGTCAGCAGATTTAGCCCCTACGAGTGGCACACTGAGGAGTT
TGAAGATGGAAGAGAAACACAAAGTAGTGAATCAACTAATGAATTTGGGATTTTTAATAGTCTCTGGTTT
TCCTTGGGTGCCTTTATGCGGCAAGGATGCGATATTTCGCCAAGATCCCTCTCTGGGCGCATTGTTGGAG
GTGTGTGGTGGTTCTTTACCCTGATCATAATCTCCTCCTACACGGCTAACTTAGCTGCCTTCCTGACTGT
AGAGAGGATGGTGTCTCCCATCGAAAGTGCTGAGGATCTTTCTAAGCAAACAGAAATTGCTTATGGAACA
TTAGACTCTGGCTCCACTAAAGAGTTTTTCAGGAGATCTAAAATTGCAGTGTTTGATAAAATGTGGACCT
ACATGCGGAGTGCGGAGCCCTCTGTGTTTGTGAGGACTACGGCCGAAGGGGTGGCTAGAGTGCGGAAGTC
CAAAGGGAAATATGCCTACTTGTTGGAGTCCACGATGAACGAGTACATTGAGCAAAGGAAGCCTTGCGAC
ACCATGAAAGTTGGTGGAAACCTGGATTCCAAAGGCTATGGCATCGCAACACCTAAAGGATCCTCATTAG
GAACCCCAGTAAATCTTGCAGTATTGAAACTCAGTGAGCAAGGCGTCTTAGACAAGCTGAAAAACAAATG
GTGGTACGATAAAGGTGAATGTGGAGCCAAGGACTCTGGAAGTAAGGAAAAGACCAGTGCCCTCAGTCTG
AGCAACGTTGCTGGAGTATTCTACATCCTTGTCGGGGGCCTTGGTTTGGCAATGCTGGTGGCTTTGATTG
AGTTCTGTTACAAGTCAAGGGCCGAGGCGAAACGAATGAAGGTGGCAAAGAATGCACAGAATATTAACCC
ATCTTCCTCGCAGAATTCACGAATTTTGCAACTTATAAGGAAGGTTACAACGTATATGGCATCGAAAGT
GTTAAAATTTAGGGGATGACCTTGAATGATGCCATGAGGAACAAGGCAAGGCTGTCAATTACAGGAAGTA
CTGGAGAAAATGGACGTGTTATGACTCCAGAATTTCCCAAAGCAGTGCATGCTGTCCCTTACGTGAGTCC
TGGCATGGGAATGAATGTCAGTGTGACTGATCTCTCGTGATTGATAAGAACCTTTTGAGTGCCTTACACA
ATGGTTTTCTTGTGTGTTTATTGTCAAAGTGGTGAGAGGCATCCAGTATCTTGAAGACTTTTCTTTCAGC
CAAGAATTCTTAAATATGTGGAGTTCATCTTGAATTGTAAGGAATGATTAATTAAAACACAACATCTTTT
TCTACTCGAGTTACAGACAAAGCGTGGTGGACATGCACAGCTAACATGGAAGTACTATAATTTACCTGAA
GTCTTTGTACAGACAACAAACCTGTTTCTGCAGCCACTATTGTTAGTCTCTTGATTCATAATGACTTAAG
CACACTTGACATCAACTGCATCAAGATGTGACATGTTTTAT

FIGURE 113
SEQ ID NO: 105
Genbank ID     : NM_001168.1
Unigene ID(#167) : Hs.1578
Unigene name   : baculoviral IAP repeat-containing 5 (survivin)
    BIRC5

FIGURE 113 cont'd

>gi|4502144|ref|NM_001168.1| Homo sapiens baculoviral IAP repeat-containing 5 (
survivin) (BIRC5), mRNA
CCGCCAGATTTGAATCGCGGGACCCGTTGGCAGAGGTGGCGGCGGCGGCATGGGTGCCCCGACGTTGCCC
CCTGCCTGGCAGCCCTTTCTCAAGGACCACCGCATCTCTACATTCAAGAACTGGCCCTTCTTGGAGGGCT
GCGCCTGCACCCCGGAGCGGATGGCCGAGGCTGGCTTCATCCACTGCCCCACTGAGAACGAGCCAGACTT
GGCCCAGTGTTTCTTCTGCTTCAAGGAGCTGGAAGGCTGGGAGCCAGATGACGACCCCATAGAGGAACAT
AAAAAGCATTCGTCCGGTTGCGCTTTCCTTTCTGTCAAGAAGCAGTTTGAAGAATTAACCCTTGGTGAAT
TTTTGAAACTGGACAGAGAGAAGAGCCAAGAACAAAATTGCAAAGGAAACCAACAATAAGAAGAAAGAATT
TGAGGAAACTGCGAAGAAAGTGCGCCGTGCCATCGAGCAGCTGGCTGCCATGGATTGAGGCCTCTGGCCG
GAGCTGCCTGGTCCCAGAGTGGCTGCACCACTTCCAGGGTTTATTCCCTGGTGCCACCAGCCTTCCTGTG
GGCCCCTTAGCAATGTCTTAGGAAAGGAGATCAACATTTTCAAATTAGATGTTTCAACTGTGCTCCTGTT
TTGTCTTGAAAGTGGCACCAGAGGTGCTTCTGCCTGTCAGCGGGTGCTGCTGGTAACAGTGGCTGCTTC
TCTCTCTCTCTCTTTTTTGGGGGCTCATTTTTGCTGTTTTGATTCCCGGCTTACCAGGTGAGAAGTG
AGGGAGGAAGAAGGCAGTGTCCCTTTTGCTAGAGCTGACAGCTTTGTTCGCGTGGGCAGAGCCTTCCACA
GTGAATGTGTCTGGACCTCATGTTGTTGAGGCTGTCACAGTCCTGAGTGTGGACTTGGCAGGTGCCTGTT
GAATCTGAGCTGCAGGTTCCTTATCTGTCACACCTGTGCCTCCTCAGAGGACAGTTTTTTTGTTGTTGTG
TTTTTTTGTTTTTTTTTTTTGGTAGATGCATGACTTGTGTGTGATGAGAGAATGGAGACAGAGTCCCTGG
CTCCTCTACTGTTTAACAACATGGCTTTCTTATTTTGTTTGAATTGTTAATTCACAGAATAGCACAAACT
ACAATTAAAACTAAGCACAAAGCCATTCTAAGTCATTGGGGAAACGGGGTGAACTTCAGGTGGATGAGGA
GACAGAATAGAGTGATGGAAGCGTCTGGCAGATACTCCTTTTGCCACTGCTGTGTGATTAGACAGGCCC
AGTGAGCCGCGGGGCACATGCTGGCCGCTCCTCCCTCAGAAAAAGGCAGTGGCCTAAATCCTTTTTAAAT
GACTTGGCTCGATGCTGTGGGGACTGGCTGGGCTGCTGCAGGCCGTGTGTCTGTCAGCCCAACCTTCAC
ATCTGTCACGTTCTCCACACGGGGAGAGACGCAGTCCGCCCAGGTCCCCGCTTTCTTTGGAGGCAGCAG
CTCCCGCAGGGCTGAAGTCTGGCGTAAGATGATGGATTTGATTCGCCCTCCTCCCTGTCATAGAGCTGCA
GGGTGGATTGTTACAGCTTCGCTGGAAACCTCTGGAGGTCATCTCGGCTGTTCCTGAGAAATAAAAGCC
TGTCATTTC

FIGURE 114
SEQ ID NO: 106
Genbank ID          : AF186255.1
Unigene ID(#167)    : Hs.38084
Unigene name        :       sulfotransferase    family,   cytosolic,   1C,   member   1
     SULT1C1
>gi|8117858|gb|AF186255.1|AF186255   Homo    sapiens    sulfotransferase    1C1
(SULT1C1)
mRNA, complete cds, alternatively spliced
AGCTTCGAGGCCAGTGGGAGGAGGGAGGGGCCAGGCAGCTGAGGGCCAGGAAAGATGTGAAAAACTCTAG
CTGGTGACCGAGAGGAGGAGTAGAGTGTGCCCTTAGTTCATATGAACTAGAGGGAGTTGGTATTTGCACA
GCAGTCAGGGTCACATGAGTGATCATGGTACAGTGAGAAGTTCTCCCTCCCAGGGCCAGGTCACAGGGTT
TGTTTCTGTTCAATCCGGATTCTTCCAGTAAAAGCTTCAACTTCCCACACTGAAGCTGAGAGCCTCCCAA
AGTGCTGGCTACCTGCTGAGCGCCCCGTAACTCTGACACAGTAGTAATTTGAGCCTCTGCAATTGCCGT
CTGCTTCCTGTGAAAGTCCTTTCCGTGCCCACTGACCCTTGAGTGGGCCTTTGAGCTGCTGACTTTCAGC
TGGAACTTGAAGGGACCCCAACCCTGAGACACTATGGCCCTGACCTCAGACCTGGGGAAACAGATAAAAC
TGAAAGAGGTGGAGGGGACCCTCCTGCAGCCTGCAACTGTGGACAACTGGAGCCAGATCCAGAGCTTCGA
GGCCAAACCAGATGATCTCCTCATCTGCACCTACCCTAAAGCAGGGACAACGTGGATTCAGGAAATTGTG
GATATGATTGAACAGAATGGGACGTGGAGAAGTGCCAGCGAGCCATCATCCAACACCGCCATCCTTTCA
TTGAGTGGGCTCGGCCACCCCAACCTTCTGAGACAGGATTTCACCATGTTGCCCAGGCTGGTCTCAAACT
CCTGAGCTCAAGCAATCCACCTGCCTCAACCTCCCAAAGTGCCAAGATTACAGACCTGCTGCCACCGTCT
TTCTGGGAAAACAACTGCAAGTTCCTTTATGTAGCTCGAAATGCCAAAGACTGTATGGTTTCCTACTACC
ATTTCCAAAGGATGAACCACACATGCTTCCTGACCCTGGTACCTGGGAAGATATTTGAAACCTTCATCAA
TGGAAAAGTGGTTTGGGGTTCCTGGTTTGACCACGTGAAAGGATGGTGGAGATGAAAGACAGACACCAG
ATTCTCTTCCTCTTCTATGAGGACATAAAGAGGGACCCAAAGCATGAAATTCGGAAGGTGATGCAGTTCA
TGGGAAAGAAGGTGGATGAAACAGTGCTAGATAAAATTGTCCAGGAGACGTCATTTGAGAAAATGAAAGA
AAATCCCATGACAAATCGTTCTACAGTTTCCAAATCTATCTTGGACCAGTCAATTTCCTCCTTCATGAGA
AAAGGAACTGTGGGGATTGGAAAAACCACTTCACTGTTGCCCAGAATGAGAGGTTTGATGAAATCTATA
GAAGAAAGATGGAAGGAACCTCCATAAACTTCTGCATGGAACTCTGAGCAAGATGTAAATAAAATTAAAA
GGTGGATGGCAAGAGTGCAAATACTATCTTCAATCCTTCAGTCCCAGCCAGAAGAATCTCTGAAAGCATA
TTGTGAATGTATACAATGTAGTACAAACAATCTCTGTGATGATTAACAGTATGTCACCACTTCATTTTTT
AAAAAGGATCACGTCTAATGCCCATTTTCCCAACTATTCTTTCCAAAGTAAGATATAAGGTAGCTTAATA FIGURE 114 cont'd

AACTAAGTAAAACGTAAAAAAAAAAAAAAAAAAAAAAAAAAAA

FIGURE 115
SEQ ID NO: 107
Genbank ID        : NM_004378.1
Unigene ID(#167)  : Hs.346950
Unigene name      :        cellular retinoic acid binding protein 1   CRABP1
>gi|4758051|ref|NM_004378.1| Homo sapiens cellular retinoic acid binding protei
n 1 (CRABP1), mRNA
GAGTCTGCCCTTGCGAGCTCAGAGTGTGCCCGTGCGCCGCCGCCGTCGTACCTGCCGCCGCCGCCACCGC
CACCATGCCCAACTTCGCCGGCACCTGGAAGATGCGCAGCAGCGAGAATTTCGACGAGCTGCTGAAGGCA
CTGGGTGTGAACGCCATGCTGAGGAAAGTGGCCGTAGCGGCTGCGTCCAAGCCGCACGTGGAGATCCGCC
AGGACGGGGATCAGTTCTACATCAAGACATCCACCACCGTGCGCACCACTGAGATCAACTTCAAGGTCGG
AGAAGGCTTTGAGGAGGAGACCGTGGACGGACGCAAGTGCAGGAGTTTAGCCACTTGGGAGAATGAGAAC
AAGATCCACTGCACCCAAACTCTTCTTGAAGGGGACGGCCCCAAAACCTACTGGACCCGTGAGCTGGCCA
ACGATGAACTTATCCTGACGTTTGGCGCCGATGACGTGGTCTGCACCAGAATTTATGTCCGGGAATGAAG
GCAGCTGGCTTGCTCCTACTTTCAGGAAGGGATGCAGGTCCCCGAGGAATATGTCATAGTTCTGAGCTGC
CAGTGGACCGCCCTTTTCCCCTACCAATATTAGGTGATCCCGTTTTCCCCATGACAATGTTGTAGTGTCC
CCCACCCCCACCCCCTGGCCTTGGTGCCTCTTGTATCCCTAGTGCTGCATAGCCCGGCATTTGCACGGT
TTCGAAGTCATTAAACTGGTTAGACGTGTCTCAAA

FIGURE 116
SEQ ID NO: 108
Genbank ID        : NM_006398.1
Unigene ID(#167)  : Hs.44532
Unigene name      :        ubiquitin D UBD
>gi|5454143|ref|NM_006398.1| Homo sapiens ubiquitin D (UBD), mRNA
GGCCCCTTGTCTGCAGAGATGGCTCCCAATGCTTCCTGCCTCTGTGTGCATGTCCGTTCCGAGGAATGGG
ATTTAATGACCTTTGATGCCAACCCATATGACAGCGTGAAAAAAATCAAAGAACATGTCCGGTCTAAGAC
CAAGGTTCCTGTGCAGGACCAGGTTCTTTTGCTGGGCTCCAAGATCTTAAAGCCACGGAGAAGCCTCTCA
TCTTATGGCATTGACAAAGAGAAGACCATCCACCTTACCCTGAAAGTGGTGAAGCCCAGTGATGAGGAGC
TGCCCTTGTTCTTGTGGAGTCAGGTGATGAGGCAAAGAGGCACCTCCTCCAGGTGCGAAGGTCCAGCTC
AGTGGCACAAGTGAAAGCAATGATCGAGACTAAGACGGGTATAATCCCTGAGACCCAGATTGTGACTTGC
AATGGAAAGAGACTGGAAGATGGGAAGATGATGGCAGATTACGGCATCAGAAAGGGCAACTTACTCTTCC
TGGCATCTTATTGTATTGGAGGGTGACCACCCTGGGGATGGGGTGTTGGCAGGGGTCAAAAAGCTTATTT
CTTTTAATCTCTTACTCAACGAACACATCTTCTGATGATTTCCCAAAATTAATGAGAATGAGATGAGTAG
AGTAAGATTTGGGTGGGATGGGTAGGATGAAGTATATTGCCCAACTCTATGTTTCTTTGATTCTAACACA
ATTAATTAAGTGACATGATTTTTACTAATGTATTACTGAGACTAGTAAATAAATTTTTAAGGCAAAATAG
AGCATTC

FIGURE 117
SEQ ID NO: 109
Genbank ID        : BC000712.1
Unigene ID(#167)  : Hs.20830
Unigene name      :        kinesin family member C1        KIFC1
>gi|12653842|gb|BC000712.1|BC000712 Homo sapiens, Similar to kinesin family mem
ber C1, clone MGC:1202 IMAGE:3506669, mRNA, complete cds
GGCACGAGGTCAAAAGTGGCGGGTGTGGCGCGGGGCTGGTAGCGGCCGGACCGTGCGAGTTCTCTACCC
TGCTTCGCGAGCGGGCGAGAGAACGCGAGTCCCAGGATCCCCGGCACCCAGTTCTCTTCACTGCATTCC
CCCGGCGCGTGTGGGACCGAGGTGGACATGGATCCGCAGAGGTCCCCCCTATTGGAAGTAAAGGGAACA
TAGAACTGAAGAGACCTCTGATTAAGGCCCCTTCCCAGCTGCCTCTCTCAGGAAGCAGACTCAAGAGGAG
GCCTGACCAGATGGAAGATGGCCTGGAGCCTGAGAAGAAACGGACAAGAGGCCTGGGTGCAACGACCAAA
ATTACCACATCCCACCCAAGAGTTCCATCCCTCACTACAGTGCCACAGACACAAGGCCAGACCACAGCTC
AAAAAGTTTCCAAGAAGACAGGACCCCGGTGTTCCACAGCTATTGCCACAGGGTTGAAGAACCAGAAGCC
AGTTCCTGCTGTTCCTGTCCAGAAGTCTGGCACATCAGGTGTTCCTCCCATGGCAGGAGGGAAGAAACCC
AGCAAACGTCCAGCCTGGGACTTAAAGGGTCAGTTATGTGACCTAAATGCAGAACTAAAACGGTGCCGTG

FIGURE 117 cont'd

```
AGAGGACTCAAACGTTGGACCAAGAGAACCAGCAGCTTCAGGACCAGCTCAGAGATGCCCAGCAGCAGGT
CAAGGCCCTGGGGACAGAGCGCACAACACTGGAGGGGCATTTAGCCAAGGTACAGGCCCAGGCTGAGCAG
GGCCAACAGGAGCTGAAGAACTTGCGTGCTTGTGTCCTGGAGCTGGAAGAGCGGCTGAGCACGCAGGAGG
GCTTGGTGCAAGAGCTTCAGAAAAAACAGGTGGAATTGCAGGAAGAACGGAGGGGACTGATGTCCCAACT
AGAGGAGAAGGAGAGGAGGCTGCAGACATCAGAAGCAGCCCTGTCAAGCAGCCAAGCAGAGGTGGCATCT
CTGCGGCAGGAGACTGTGGCCCAGGCAGCCTTACTGACTGAGCGGGAAGAACGTCTTCATGGGCTAGAAA
TGGAGCGCCGGCGACTGCACAACCAGCTGCAGGAACTCAAGGGCAACATCCGTGTATTCTGCCGGGTCCG
CCCTGTCCTGCCGGGGGAGCCCACTCCACCCCCTGGCCTCCTCCTGTTTCCCTCTGGCCCTGGTGGGCCC
TCTGATCCTCCAACCCGCCTTAGCCTCTCCCGGTCTGACGAGCGGCGTGGGACCCTGAGTGGGGCACCAG
CTCCCCCACCTCGCCATGATTTTTCCTTTGACCGGGTATTCCCACCAGGAAGTGGACAGGATGAAGTGTT
TGAAGAGATTGCCATGCTTGTCCAGTCAGCCCTGGATGGCTATCCAGTATGCATCTTTGCCTATGGCCAG
ACAGGCAGTGGCAAGACCTTCACAATGGAGGGTGGGCCTGGGGGAGACCCCCAGTTGGAGGGGCTGATCC
CTCGGGCCCTGCGGCACCTCTTCTCTGTGGCTCAGGAGCTGAGTGGTCAGGGCTGGACCTACAGCTTTGT
AGCAAGCTACGTAGAGATCTACAATGAGACTGTCCGGGACCTGCTGGCCACTGGAACCCGGAAGGGTCAA
GGGGGCGAGTGTGAGATTCGCCGTGCAGGGCCAGGGAGTGAGGAGCTCACTGTCACCAATGCTCGATATG
TCCCTGTCTCCTGTGAGAAAGAAGTGGACGCCCTGCTTCATCTGGCCCGCCAGAATCGGGCTGTGGCCCG
CACAGCCCAGAATGAACGGTCATCACGCAGCCACAGTGTATTCCAGCTACAGATTTCTGGGGAGCACTCC
AGCCGAGGCCTGCAGTGTGGGGCCCCCCTCAGTCTTGTGGACCTGGCCGGGAGTGAGCGACTTGACCCCG
GCTTAGCCCTCGGCCCCGGGGAGCGGGAACGCCTTCGGGAAACACAGGCCATTAACAGCAGCCTGTCCAC
GCTGGGGCTGGTTATCATGGCCCTGAGCAACAAGGAGTCCCACGTGCCTTACCGGAACAGCAAACTGACC
TACCTGCTGCAGAACTCTCTGGGTGGTAGTGCTAAGATGCTCATGTTTGTGAACATTTCTCCACTGGAAG
AGAACGTCTCCGAGTCCCTCAACTCTCTACGCTTTGCCTCCAAGGTGAACCAGTGTGTTATTGGTACTGC
TCAGGCCAACAGGAAGTGAAGACGGATCCAGATCTGTGTGTGTGTGTGTGTGTGTGTGTGTGTGTGTGTG
TGTGTGTGTGTGTGTCCCTATGTCTATGTATCGGGTGAGGGTGGGAGGGTTGCTGGAGGGTGCTTTA
TTGGGTGGAGGGCACCATGTCCCAGGGCTATCAAATAAAGAATAGTTTGGTTTTTTTTTAAAAAAAAAA
AAAAAAAAAAAAAAAAAAA
```

FIGURE 118
SEQ ID NO: 110
Genbank ID      : AI631850
Unigene ID(#167) : Hs.158992
Unigene name    :       cDNA FLJ45983 fis, clone PROST2017749
>gi|4683180|gb|AI631850.1|AI631850 wa36h07.x1 NCI_CGAP_Kid11 Homo sapiens cDNA
clone IMAGE:2300221 3' similar to contains TAR1.t2 TAR1 repetitive element
;, m
RNA sequence
```
TTTTTTTTCGCTTCACACCGTTTTTATTGACCGATCGCAGCCCAGCAAGATTGATCGAGCTGGAATGGGA
AGGGACTTCTCCTCCCCCAGGCCCAGCTCGCCAGGGCCTCGGGCCGTGCTGCAGTTTCTGGCCTTTGGTG
TCGCTCCCCGCCCCCCAGCCCCGCAAAATCCCGGCTTCTTTTCTGTCTGCGCGGCCGGGACCGCCCAGGC
AGGCGCCGGGGCTCCGGGGCTCCGGGGGAGGGACTCGGCGGCTCGGCTCGGCTCCGCTTCTTTCTCCTG
CCTGCAAATATTTGCTGCCTCGCTGGAAATCCGACGATTTCGCGCGCGCTCTGCTTGCAAAGTCTTTAAG
TAAACACGCTCAAATGACCGCCCCGGGCGGCCCGAGGCACGCTCTCTCCCCCTCCGCGGGATTAGTAACT
TTAGGACTTCGACCCCGGGGCTCCGCTTTGCCTGTTACCCAGGTCGGGCAGCGCGCGGGCGCCCGGNGCC
G
```

FIGURE 119
SEQ ID NO: 111
Genbank ID      : NM_000125.1
Unigene ID(#167) : Hs.1657
Unigene name    :       estrogen receptor 1       ESR1
>gi|4503602|ref|NM_000125.1| Homo sapiens estrogen receptor 1 (ESR1), mRNA
```
GAGTTGTGCCTGGAGTGATGTTTAAGCCAATGTCAGGGCAAGGCAACAGTCCCTGGCCGTCCTCCAGCAC
CTTTGTAATGCATATGAGCTCGGGAGACCAGTACTTAAAGTTGGAGGCCCGGGAGCCCAGGAGCTGGCGG
AGGGCGTTCGTCCTGGGAGCTGCACTTGCTCCGTCGGGTCGCCGGCTTCACCGGACCGCAGGCTCCCGGG
GCAGGGCCGGGGCCAGAGCTCGCGTGTCGGCGGGACATGCGCTGCGTCGCCTCTAACCTCGGGCTGTGCT
CTTTTTCCAGGTGGCCCGCCGGTTTCTGAGCCTTCTGCCCTGCGGGGACACGGTCTGCACCCTGCCCGCG
GCCACGGACCATGACCATGACCCTCCACACCAAAGCATCTGGGATGGCCCTACTGCATCAGATCCAAGGG
```

FIGURE 119 cont'd

```
AACGAGCTGGAGCCCCTGAACCGTCCGCAGCTCAAGATCCCCCTGGAGCGGCCCCTGGGCGAGGTGTACC
TGGACAGCAGCAAGCCCGCCGTGTACAACTACCCCGAGGGCGCCGCCTACGAGTTCAACGCCGCGGCCGC
CGCCAACGCGCAGGTCTACGGTCAGACCGGCCTCCCCTACGGCCCCGGGTCTGAGGCTGCGGCGTTCGGC
TCCAACGGCCTGGGGGGTTTCCCCCCACTCAACAGCGTGTCTCCGAGCCCGCTGATGCTACTGCACCCGC
CGCCGCAGCTGTCGCCTTTCCTGCAGCCCCACGGCCAGCAGGTGCCCTACTACCTGGAGAACGAGCCCAG
CGGCTACACGGTGCGCGAGGCCGGCCCGCCGGCATTCTACAGGCCAAATTCAGATAATCGACGCCAGGGT
GGCAGAGAAAGATTGGCCAGTACCAATGACAAGGGAAGTATGGCTATGGAATCTGCCAAGGAGACTCGCT
ACTGTGCAGTGTGCAATGACTATGCTTCAGGCTACCATTATGGAGTCTGGTCCTGTGAGGGCTGCAAGGC
CTTCTTCAAGAGAAGTATTCAAGGACATAACGACTATATGTGTCCAGCCACCAACCAGTGCACCATTGAT
AAAAACAGGAGGAAGAGCTGCCAGGCCTGCCGGCTCCGCAAATGCTACGAAGTGGGAATGATGAAAGGTG
GGATACGAAAAGACCGAAGAGGAGGAGAATGTTGAAACACAAGCGCCAGAGAGATGATGGGGAGGGCAG
GGGTGAAGTGGGGTCTGCTGGAGACATGGAGCTGCCAACCTTTGGCCAAGCCCGCTCATGATCAAACGC
TCTAAGAAGAACAGCCTGGCCTTGTCCCTGACGGCCGACCAGATGGTCAGTGCCTTGTTGGATGCTGAGC
CCCCCATACTCTATTCCGAGTATGATCCTACCAGACCCTTCAGTGAAGCTTCGATGATGGGCTTACTGAC
CAACCTGGCAGACAGGGAGCTGGTTCACATGATCAACTGGGCGAAGAGGGTGCCAGGCTTTGTGGATTTG
ACCCTCCATGATCAGGTCCACCTTCTAGAATGTGCCTGGCTAGAGATCCTGATGATTGGTCTCGTCTGGC
GCTCCATGGAGCACCCAGTGAAGCTACTGTTTGCTCCTAACTTGCTCTTGGACAGGAACCAGGGAAAATG
TGTAGAGGGCATGGTGGAGATCTTCGACATGCTGCTGGCTACATCATCTCGGTTCCGCATGATGAATCTG
CAGGGAGAGGAGTTTGTGTGCCTCAAATCTATTATTTTGCTTAATTCTGGAGTGTACACATTTCTGTCCA
GCACCCTGAAGTCTCTGGAAGAGAAGGACCATATCCACCGAGTCCTGGACAAGATCACAGACACTTTGAT
CCACCTGATGGCCAAGGCAGGCCTGACCCTGCAGCAGCAGCACCAGCGGCTGGCCCAGCTCCTCCTCATC
CTCTCCCACATCAGGCACATGAGTAACAAAGGCATGGAGCATCTGTACAGCATGAAGTGCAAGAACGTGG
TGCCCCTCTATGACCTGCTGCTGGAGATGCTGGACGCCCACCGCCTACATGCGCCCACTAGCCGTGGAGG
GGCATCCGTGGAGGAGACGGACCAAAGCCACTTGGCCACTGCGGGCTCTACTTCATCGCATTCCTTGCAA
AAGTATTACATCACGGGGGAGGCAGAGGGTTTCCCTGCCACAGTCTGAGAGCTCCCTGGCTCCCACACGG
TTCAGATAATCCCTGCTGCATTTTACCCTCATCATGCACCACTTTAGCCAAATTCTGTCTCCTGCATACA
CTCCGGCATGCATCCAACACCAATGGCTTTCTAGATGAGTGGCCATTCATTTGCTTGCTCAGTTCTTAGT
GGCACATCTTCTGTCTTCTGTTGGGAACAGCCAAAGGGATTCCAAGGCTAAATCTTTGTAACAGCTCTCT
TTCCCCCTTGCTATGTTACTAAGCGTGAGGATTCCCGTAGCTCTTCACAGCTGAACTCAGTCTATGGGTT
GGGGCTCAGATAACTCTGTGCATTTAAGCTACTTGTAGAGACCCAGGCCTGGAGAGTAGACATTTTGCCT
CTGATAAGCACTTTTTAAATGGCTCTAAGAATAAGCCACAGCAAAGAATTTAAAGTGGCTCCTTTAATTG
GTGACTTGGAGAAAGCTAGGTCAAGGGTTTATTATAGCACCCTCTTGTATTCCTATGGCAATGCATCCTT
TTATGAAAGTGGTACACCTTAAAGCTTTTATATGACTGTAGCAGAGTATCTGGTGATTGTCAATTCACTT
CCCCCTATAGGAATACAAGGGGCCACACAGGGAAGGCAGATCCCCTAGTTGGCCAAGACTTATTTTAACT
TGATACACTGCAGATTCAGAGTGTCCTGAAGCTCTGCCTCTGGCTTTCCGGTCATGGGTTCCAGTTAATT
CATGCCTCCCATGGACCTATGGAGAGCAACAAGTTGATCTTAGTTAAGTCTCCCTATATGAGGGATAAGT
TCCTGATTTTTGTTTTTATTTTTGTGTTACAAAAGAAAGCCCTCCCTCCCTGAACTTGCAGTAAGGTCAG
CTTCAGGACCTGTTCCAGTGGGCACTGTACTTGGATCTTCCCGGCGTGTGTGTGCCTTACACAGGGGTGA
ACTGTTCACTGTGGTGATGCATGATGAGGGTAAATGGTAGTTGAAAGGAGCAGGGGCCCTGGTGTTGCAT
TTAGCCCTGGGGCATGGAGCTGAACAGTACTTGTGCAGGATTGTTGTGGCTACTAGAGAACAAGAGGGAA
AGTAGGGCAGAAACTGGATACAGTTCTGAGCACAGCCAGACTTGCTCAGGTGGCCCTGCACAGGCTGCAG
CTACCTAGGAACATTCCTTGCAGACCCCGCATTGCCTTTGGGGTGCCCTGGGATCCCTGGGGTAGTCCA
GCTCTTATTCATTTCCCAGCGTGGCCCTGGTTGGAAGAAGCAGCTGTCAAGTTGTAGACAGCTGTGTTCC
TACAATTGGCCCAGCACCCTGGGGCACGGGAGAAGGGTGGGGACCGTTGCTGTCACTACTCAGGCTGACT
GGGGCCTGGTCAGATTACGTATGCCCTTGGTGGTTTAGAGATAATCCAAAATCAGGGTTTGGTTTGGGGA
AGAAAATCCTCCCCCTTCCTCCCCCGCCCCGTTCCCTACCGCCTCCACTCCTGCCAGCTCATTTCCTTCA
ATTTCCTTTGACCTATAGGCTAAAAAGAAAGGCTCATTCCAGCCACAGGGCAGCCTTCCCTGGGCCTTT
GCTTCTCTAGCACAATTATGGGTTACTTCCTTTTCTTAACAAAAAAGAATGTTTGATTTCCTCTGGGTG
ACCTTATTGTCTGTAATTGAAACCCTATTGAGAGGTGATGTCTGTGTTAGCCAATGACCCAGGTAGCTGC
TCGGGCTTCTCTTGGTATGTCTTGTTTGGAAAAGTGGATTTCATTCATTTCTGATTGTCCAGTTAAGTGA
TCACCAAGGACTGAGAATCTGGGAGGGCAAAAAAAAAAAAAAAAGTTTTTATGTGCACTTAAATTTGGG
GACAATTTTATGTATCTGTGTTAAGGATATGCTTAAGAACATAATTCTTTTGTTGCTGTTTGTTTAAGAA
GCACCTTAGTTTGTTTAAGAAGCACCTTATATAGTATAATATATATTTTTTGAAATTACATTGCTTGTT
TATCAGACAATTGAATGTAGTAATTCTGTTCTGGATTTAATTTGACTGGGTTAACATGCAAAAACCAAGG
AAAAATATTTAGTTTTTTTTTTTTTTTTGTATACTTTTCAAGCTACCTTGTCATGTATACAGTCATTTA
TGCCTAAAGCCTGGTGATTATTCATTTAAATGAAGATCACATTTCATATCAACTTTTGTATCCACAGTAG
ACAAAATAGCACTAATCCAGATGCCTATTGTTGGATATTGAATGACAGACAATCTTATGTAGCAAAGATT
ATGCCTGAAAGGAAAATTATTCAGGGCAGCTAATTTTGCTTTTACCAAAATATCAGTAGTAATATTTTT
GGACAGTAGCTAATGGGTCAGTGGGTTCTTTTTAATGTTTATACTTAGATTTTCTTTTAAAAAAATTAAA
ATAAAACAAAAAAAATTTCTAGGACTAGACGATGTAATACCAGCTAAAGCCAAACAATTATACAGTGGAA
GGTTTTACATTATTCATCCAATGTGTTTCTATTCATGTTAAGATACTACTACATTTGAAGTGGGCAGAGA
```

FIGURE 119 cont'd

ACATCAGATGATTGAAATGTTCGCCCAGGGGTCTCCAGCAACTTTGGAAATCTCTTTGTATTTTTACTTG
AAGTGCCACTAATGGACAGCAGATATTTTCTGGCTGATGTTGGTATTGGGTGTAGGAACATGATTTAAAA
AAAAAACTCTTGCCTCTGCTTTCCCCCACTCTGAGGCAAGTTAAAATGTAAAAGATGTGATTTATCTGGG
GGGCTCAGGTATGGTGGGGAAGTGGATTCAGGAATCTGGGGAATGGCAAATATATTAAGAAGAGTATTGA
AAGTATTTGGAGGAAAATGGTTAATTCTGGGTGTGCACCAAGGTTCAGTAGAGTCCACTTCTGCCCTGGA
GACCACAAATCAACTAGCTCCATTTACAGCCATTTCTAAAATGGCAGCTTCAGTTCTAGAGAAGAAAGAA
CAACATCAGCAGTAAAGTCCATGGAATAGCTAGTGGTCTGTGTTTCTTTTCGCCATTGCCTAGCTTGCCG
TAATGATTCTATAATGCCATCATGCAGCAATTATGAGAGGCTAGGTCATCCAAAGAGAAGACCCTATCAA
TGTAGGTTGCAAAATCTAACCCCTAAGGAAGTGCAGTCTTTGATTTGATTTCCCTAGTAACCTTGCAGAT
ATGTTTAACCAAGCCATAGCCCATGCCTTTTGAGGGCTGAACAAATAAGGGACTTACTGATAATTTACTT
TTGATCACATTAAGGTGTTCTCACCTTGAAATCTTATACACTGAAATGGCCATTGATTTAGGCCACTGGC
TTAGAGTACTCCTTCCCCTGCATGACACTGATTACAAATACTTTCCTATTCATACTTTCCAATTATGAGA
TGGACTGTGGGTACTGGGAGTGATCACTAACACCATAGTAATGTCTAATATTCACAGGCAGATCTGCTTG
GGGAAGCTAGTTATGTGAAAGGCAAATAAAGTCATACAGTAGCTCAAAAGGCAACCATAATTCTCTTTGG
TGCAAGTCTTGGGAGCGTGATCTAGATTACACTGCACCATTCCCAAGTTAATCCCCTGAAAACTTACTCT
CAACTGGAGCAAATGAACTTTGGTCCCAAATATCCATCTTTTCAGTAGCGTTAATTATGCTCTGTTTCCA
ACTGCATTTCCTTTCCAATTGAATTAAAGTGTGGCCTCGTTTTAGTCATTTAAAATTGTTTTCTAAGTA
ATTGCTGCCTCTATTATGGCACTTCAATTTTGCACTGTCTTTTGAGATTCAAGAAAAATTTCTATTCATT
TTTTTGCATCCAATTGTGCCTGAACTTTTAAAATATGTAAATGCTGCCATGTTCCAAACCCATCGTCAGT
GTGTGTGTTTAGAGCTGTGCACCCTAGAAACAACATACTTGTCCCATGAGCAGGTGCCTGAGACACAGAC
CCCTTTGCATTCACAGAGAGGTCATTGGTTATAGAGACTTGAATTAATAAGTGACATTATGCCAGTTTCT
GTTCTCTCACAGGTGATAAACAATGCTTTTTGTGCACTACATACTCTTCAGTGTAGAGCTCTTGTTTTAT
GGGAAAAGGCTCAAATGCCAAATTGTGTTTGATGGATTAATATGCCCTTTTGCCGATGCATACTATTACT
GATGTGACTCGGTTTTGTCGCAGCTTTGCTTTGTTTAATGAAACACACTTGTAAACCTCTTTTGCACTTT
GAAAAAGAATCCAGCGGGATGCTCGAGCACCTGTAAACAATTTTCTCAACCTATTTGATGTTCAAATAAA
GAATTAAACT

FIGURE 120
SEQ ID NO: 112
Genbank ID        : AI810054
Unigene ID(#167)  : Hs.445098
Unigene name      :       cell cycle control protein SDP35    SDP35
>gi|5396620|gb|AI810054.1|AI810054    wf79h07.x1    Soares_NFL_T_GBC_S1    Homo sapiens
cDNA clone IMAGE:2361853 3', mRNA sequence
TTTTTTTTTTTTGATAGCAAATAAGTTTTAATCAGCAGAGACCTTAAACGTCAATCATGGCAAGAGGAGG
GGACACAAACACCCAGCGCGGGCTTGCTAAATTCAAGATTTAAATATATTGCCTTTCTTTCACTACAATC
ACAACTCACTTAGGTAGATACTTTAATTCACATTTTACAGATGAGAAGATTCAGAGTTTAAGCTTCCCAA
GGACAGAAAGGTAAGTCAGTGGGAAATTCCATGTACATTCCATTACTAAATGCCACATAACTGTTTGGAT
AACATAAGAAGAGTGGGTCATTATATGATACCAATTACAAGATATTAGGGATGGTGGAGGCAGTAATTTC
TGGGATAAGAACTATAATTTACAGAATAACCAGACATCATCTGATCTGGTGAAACCTGTGCATTCCCACA
ATTAGGCTTTTTCACACTTTCTCTCTTTAAATGTGCAACACCTTCCCCATCCCCTTTACTTGTAGCAGTT
GATTCTGCTTCTTATATCCCGAGAAAGCAACTACCACCAAATCTACC FIGURE 121
SEQ ID NO: 113
Genbank ID        : BC001147.1
Unigene ID(#167)  : Hs.436924
Unigene name      :       peroxisomal membrane protein 4, 24kDa    PXMP4
>gi|12654620|gb|BC001147.1|    Homo sapiens peroxisomal membrane protein 4, 24kDa,
mRNA (cDNA clone MGC:1213 IMAGE:3533572), complete cds
CCGACCCTGCGCGCAGCCCGCACTATGGCAGCCCCGCCGCAGCTAAGGGCTCTGCTCGTAGTCGTCAACG
CACTGCTGCGCAAGCGCCGCTACCACGCTGCGTTGGCCGTGCTTAAGGGCTTCCGGAACGGGGCTGTCTA
TGGAGCCAAAATCCGGGCCCCTCACGCGCTGGTCATGACCTTTCTCTTCCGGAATGGCAGCCTCCAGGAG
AAGCTGTGGGCCATACTGCAGGCCACATATATCCACTCCTGGAACCTGGCACGGTTTGTGTTCACCTACA
AGGGTCTCCGTGCCCTGCAGTCCTACATACAAGGCAAGACCTACCCAGCACACGCATTCCTGGCGGCCTT
CCTCGGGGGTATCCTGGTGTTTGGAGAAAACAATAACATCAACAGCCAGATCAACATGTACCTGTTGTCA

FIGURE 121 cont'd

```
CGCGTCCTGTTTGCCCTGAGCCGCCTGGCTGTAGAGAAGGGCTACATCCCTGAACCCAGGTGGGACCCGT
TCCCGCTGCTCACTGCGGTGGTGTGGGGGCTGGTGCTGTGGCTCTTTGAGTATCACCGATCCACCCTGCA
GCCCTCGCTGCAGTCCTCCATGACCTACCTCTATGAGGACAGCAATGTATGGCACGACATCTCAGACTTC
CTCATCTATAACAAGAGCCGTCCCTCCAATTAATGCAGCCCTGAGGTGTCTGGCTGTGGCTCAAGATTTG
GCCCCATGCAGACCCTCCCAAAGGATACTGCCTTCTCAAGATCATAGGCCTCAGACTCCAACTGGTGTTA
TCCCAGGGTTCCGTTTGCTGAAGTAAAAACACTGATTTTAAAATCCCAGTGGGTACCTTTGTATGGTGGC
ACAAGTGGCCGAATCAGGCTGAGGAATCTACGGCTTGGTTCCAGCTGTGCAGCTGACTTCTGTGAGACTG
GGGCCAGCCACACTACTCTCTAGGCCTCAGGGGTCAAGGAGCTCAGAGGAGGGCCCTGAGGTCTCTTTCC
GGTGGGTATGTTCATTCTTCAACTGTTCTTATGTCACAGAGGGCTCCTTGCTGGTGGGCAGTGGGTTGTA
AATACTTTTTAAAAAACACTAAGTTCCTTATCTCAGATGCTGTTCTACTGGAGAAGTTCTAGATTCCCAC
TGTCCAATAGAAACACGTGAGCCATATATGTAATTAAAATGTTTCTAGTAGCTGCATTACAAAAAAGAAG
CCTGGGCACTGTGGCTCACGCCTGTAATCCCAGCACTTTGGGAGGCTGAGGCAGGCAGATAACCTGAGAT
CAGGAGTTCTTGACCAGCCTGGCCAACATGGTAAAACCCCATCTCTACTAAAAATACAAAAATTAGCTGG
ACATGGTGGCAGGCACCTGTAATTCCAGCTACTTGGGAGGCTGAGGTGGGAGAATCTCTTGAACCTGGGG
GGCTGCTGTGAGCCGAGATAGTTCCATTACACTTCAGCCTGGGTGACAGAGTAAGACTCTGTCTCAAAAA
AAAAAAAAAAAAAAAAAA
```

FIGURE 122
SEQ ID NO: 114
Genbank ID         : AI732488
Unigene ID(#167)   : Hs.29190
Unigene name       :        hypothetical protein MGC24047 MGC24047
>gi|5053601|gb|AI732488.1|AI732488 nh77c06.x5 NCI_CGAP_Br1.1 Homo sapiens cDNA
clone IMAGE:964522 3', mRNA sequence

```
GCTGTTCATAATCATCTTCTTTATTTATTGGGTTACTTTATTTATTCAGGGTGGGTTCCCTCCACCCCAA
AAATACCAGCTCCAGGAAAACCATGGTATCTCCCCAGCACTTTGCAGGGCCTGGCATGTGGAAGATGTAC
CAGTAATATTTGCTGTATGAATGAATGAGTCTCTTCATGTGCAGGTGACTTATCCTGCCTCTGCCACTCG
ACGGATGTTTCAGATGCCCCTTAGCGGATCTAATGATGTTTCCTTGGCTCAAGCACAAAAGACTCCTGCT
TAGCTGGGGAAGCAGGGCCAGGCCCTGGGAATTGCAGCCTCTGGGCATCAGAGCCCGGCCCTTCCAGCTA
ATCGGCCTGCCCACAGACACAAGAGGAGAGGGCTTTCAGTGAGTCCTTGACTGTTCCCCAAGTTGAAGAC
CTCACAGGCGCAGCCTTCACGGGTTTCCCCTTAGCCTCGGGAACCTCCTGNGGGCAGAGCGGGCTGACTG
GGAAGGAAGCTGAGGCCACAGACCCTCTGCAGAGCGGCAGGGTGGCCCTGGCC
```

FIGURE 123
SEQ ID NO: 115
Genbank ID         : D89675.1
Unigene ID(#167)   : Hs.87223
Unigene name       :        bone    morphogenetic    protein    receptor,    type    IB
    BMPR1B
>gi|2055308|dbj|D89675.1| Homo sapiens mRNA for bone morphogenetic protein type
 IB receptor, complete cds

```
GCAAACTTCCTTGATAACATGCTTTTGCGAAGTGCAGGAAAATTAAATGTGGGCACCAAGAAAGAGGATG
GTGAGAGTACAGCCCCCACCCCCGTCCAAAGGTCTTGCGTTGTAAATGCCACCACCATTGTCCAGAAGA
CTCAGTCAACAATATTTGCAGCACAGACGGATATTGTTTCACGATGATAGAAGAGGATGACTCTGGGTTG
CCTGTGGTCACTTCTGGTTGCCTAGGACTAGAAGGCTCAGATTTTCAGTGTCGGGACACTCCCATTCCTC
ATCAAAGAAGATCAATTGAATGCTGCACAGAAAGGAACGAATGTAATAAAGACCTACACCCTACACTGCC
TCCATTGAAAAACAGAGATTTTGTTGATGGACCTATACACCACAGGGCTTTACTTATATCTGTGACTGTC
TGTAGTTTGCTCTTGGTCCTTATCATATTATTTTGTTACTTCCGGTATAAAAGACAAGAAACCAGACCTC
GATACAGCATTGGGTTAGAACAGGATGAAACTTACATTCCTCCTGGAGAATCCCTGAGAGACTTAATTGA
GCAGTCTCAGAGCTCAGGAAGTGGATCAGGCCTCCCTCTGCTGGTCCAAAGGACTATAGCTAAGCAGATT
CAGATGGTGAAACAGATTGGAAAAGGTCGCTATGGGGAAGTTTGGATGGGAAAGTGGCGTGGCGAAAAGG
TAGCTGTGAAAGTGTTCTTCACCACAGAGGAAGCCAGCTGGTTCAGAGAGACAGAAATATATCAGACAGT
GTTGATGAGGCATGAAAACATTTTGGGTTTCATTGCTGCAGATATCAAAGGGACAGGGTCCTGGACCCAG
TTGTACCTAATCACAGACTATCATGAAAATGGTTCCCTTTATGATTATCTGAAGTCCACCACCCTAGACG
CTAAATCAATGCTGAAGTTAGCCTACTCTTCTGTCAGTGGCTTATGTCATTTACACACAGAAATCTTTAG
TACTCAAGGCAAACCAGCAATTGCCCATCGAGATCTGAAAAGTAAAAACATTCTGGTGAAGAAAAATGGA
```

FIGURE 123 cont'd

ACTTGCTGTATTGCTGACCTGGGCCTGGCTGTTAAATTTATTAGTGATACAAATGAAGTTGACATACCAC
CTAACACTCGAGTTGGCACCAAACGCTATATGCCTCCAGAAGTGTTGGACGAGAGCTTGAACAGAAATCA
CTTCCAGTCTTACATCATGGCTGACATGTATAGTTTTGGCCTCATCCTTTGGGAGGTTGCTAGGAGATGT
GTATCAGGAGGTATAGTGGAAGAATACCAGCTTCCTTATCATGACCTAGTGCCCAGTGACCCCTCTTATG
AGGACATGAGGGAGATTGTGTGCATCAAGAAGTTACGCCCCTCATTCCCAAACCGGTGGAGCAGTGATGA
GTGTCTAAGGCAGATGGGAAAACTCATGACAGAATGCTGGGCTCACAATCCTGCATCAAGGCTGACAGCC
CTGCGGGTTAAGAAAACACTTGCCAAAATGTCAGAGTCCCAGGACATTAAACTCTGATAGGAGAGGAAAA
GTAAGCATCTCTGCAGAAAGCCAACAGGTACCCTT

FIGURE 124
SEQ ID NO: 116
Genbank ID          : NM_002497.1
Unigene ID(#167)    : Hs.153704
Unigene name        :       NIMA  (never  in  mitosis  gene  a)-related  kinase  2
    NEK2
>gi|4505372|ref|NM_002497.1| Homo sapiens NIMA (never in mitosis gene a)-relate
d kinase 2 (NEK2), mRNA
GGCACGAGTAGGGGTGGCGGGTCAGTGCTGCTCGGGGGCTTCTCCATCCAGGTCCCTGGAGTTCCTGGTC
CCTGGAGCTCCGCACTTGGCGCGCAACCTGCGTGAGGCAGCGCGACTCTGGCGACTGGCCGGCCATGCCT
TCCCGGGCTGAGGACTATGAAGTGTTGTACACCATTGGCACAGGCTCCTACGGCCGCTGCCAGAAGATCC
GGAGGAAGAGTGATGGCAAGATATTAGTTTGGAAAGAACTTGACTATGGCTCCATGACAGAAGCTGAGAA
ACAGATGCTTGTTTCTGAAGTGAATTTGCTTCGTGAACTGAAACATCCAAACATCGTTCGTTACTATGAT
CGGATTATTGACCGGACCAATACAACACTGTACATTGTAATGGAATATTGTGAAGGAGGGGATCTGGCTA
GTGTAATTACAAAGGGAACCAAGGAAAGGCAATACTTAGATGAAGAGTTTGTTCTTCGAGTGATGACTCA
GTTGACTCTGGCCCTGAAGGAATGCCACAGACGAAGTGATGGTGGTCATACCGTATTGCATCGGGATCTT
AAACCAGCCAATGTTTTCCTGGATGGCAAGCAAAACGTCAAGCTTGGAGACTTTGGGCTAGCTAGAATAT
TAAACCATGACACGAGTTTTGCAAAAACATTTGTTGGCACACCTTATTACATGTCTCCTGAACAAATGAA
TCGCATGTCCTACAATGAGAAATCAGATATCTGGTCATTGGGCTGCTTGCTGTATGAGTTATGTGCATTA
ATGCCTCCATTTACAGCTTTTAGCCAGAAAGAACTCGCTGGGAAAATCAGAGAAGGCAAATTCAGGCGAA
TTCCATACCGTTACTCTGATGAATTGAATGAAATTATTACGAGGATGTTAAACTTAAAGGATTACCATCG
ACCTTCTGTTGAAGAAATTCTTGAGAACCCTTTAATAGCAGATTTGGTTGCAGACGAGCAAAGAAGAAAT
CTTGAGAGAAGAGGGCGACAATTAGGAGAGCCAGAAAAATCGCAGGATTCCAGCCCTGTATTGAGTGAGC
TGAAACTGAAGGAAATTCAGTTACAGGAGCGAGAGCGAGCTCTCAAAGCAAGAGAAGAAAGATTGGAGCA
GAAAGAACAGGAGCTTTGTGTTCGTGAGAGACTAGCAGAGGACAAACTGGCTAGAGCAGAAAATCTGTTG
AAGAACTACAGCTTGCTAAAGGAACGGAAGTTCCTGTCTCTGGCAAGTAATCCAGAACTTCTTAATCTTC
CATCCTCAGTAATTAAGAAGAAAGTTCATTTCAGTGGGGAAAGTAAAGAGAACATCATGAGGAGTGAGAA
TTCTGAGAGTCAGCTCACATCTAAGTCCAAGTGCAAGGACCTGAAGAAAAGGCTTCACGCTGCCCAGCTG
CGGGCTCAAGCCCTGTCAGATATTGAGAAAAATTACCAACTGAAAAGCAGACAGATCCTGGGCATGCGCT
AGCCAGGTAGAGAGACACAGAGCTGTGTACAGGATGTAATATTACCAACCTTTAAAGACTGATATTCAAA
TGCTGTAGTGTTGAATACTTGGCCCCATGAGCCATGCCTTTCTGTATAGTACACATGATATTTCGGAATT
GGTTTTACTGTTCTTCAGCAACTATTGTACAAAATGTTCACATTTAATTTTTCTTTCTTCTTTTAAGAAC
ATATTATAAAAGAATACTTTCTTGGTTGGGCTTTTAATCCTGTGTGTGATTACTAGTAGGAACATGAGA
TGTGACATTCTAAATCTTGGGAGAAAAAATAATATTAGGAAAAAAATATTTATGCAGGAAGAGTAGCACT
CACTGAATAGTTTTAAATGACTGAGTGGTATGCTTACAATTGTCATGTCTAGATTTAAATTTTAAGTCTG
AGATTTTAAATGTTTTTGAGCTTAGAAAACCCAGTTAGATGCAATTTGGTCATTAATACCATGACATCTT
GCTTATAAATATTCCATTGCTCTGTAGTTCAAATCTGTTAGCTTTGTGAAAATTCATCACTGTGATGTTT
GTATTCTTTTTTTTTTTCTGTTTAACAGAATATGAGCTGTCTGTCATTTACCTACTTCTTTCCCACTAAA
TAAAAGAATTCTTCAGTTA

FIGURE 125
SEQ ID NO: 117
Genbank ID          : AA227842
Unigene ID(#167)    : Hs.21929
Unigene name        :       hypothetical protein MGC52057 MGC52057
>gi|1849413|gb|AA227842.1|AA227842    zr28h02.s1    Stratagene    NT2    neuronal
precursor
  937230 Homo sapiens cDNA clone IMAGE:664755 3', mRNA sequence

FIGURE 125 cont'd

```
AAGATACACTCAAAACCTTTATTCATTGATTTACAAACTGTACAATATTTACAAAGTTTAGGCATTAATC
CCATATTGACATGAATGCTGTGGAGAGTCTAAAAATAAATATGTGGCACATAGCTTAATATACACATCAT
GGCTCTTTACACTTAAGCCATTACCAATAGTGAGATGTAATGGAGAATTTAATGTGGTAGAAAAGTCAGA
GTGGCTGACCAGTCCCGGACCTTCCATGTGAATGACTCTTCCTTGGCTCCTTGAGGCTGGGGATAGTGAG
CAAATAACTTTCTTTCAAGAGAATTAAACACTGCCATTCTGACAGGCACATGGGACGCATGCAGCAACAT
CTATGCAGAGTCTGCAAGCACTCCCTGGGTGGTGGTTGAATCTGCACCACTGTGGACCTGATCCCTGTAC
ACCAGCCAGGGAG
```

FIGURE 126
SEQ ID NO: 118
Genbank ID       : BE669692
Unigene ID(#167) : acc_BE669692
Unigene name     :
>gi|10030233|gb|BE669692.1|BE669692  7e17f11.x1 NCI_CGAP_Lu24 Homo sapiens cDNA
clone IMAGE:3282765 3', mRNA sequence

```
TTTTTGGGATTTCCTGCTATTAGCAGCAGAACGCATCTTCATTGAAATATTCATTCCACACATTTTGGTT
CTACCTTGAAATTCCACACCACAAGTCTCATATAAAATGAGAAAATCATTTCCTCAACTTAGGAAATGAG
GCCTATTTGTTGCAACTCTGTGATCAAACAGAACAGACATAATTATCAGCTTAATATATTTCTATAGGAT
TTATACTCTTACAGGATTTATATGCACTTGTACTGCTACGTATGTACAAGTAACATAAAACTAAAAATAA
GATATGCATAAAAACAACTTTTAATTTGATTGAAAATAAAATAACAGTCGTCTCTGACA
```

FIGURE 127
SEQ ID NO: 119
Genbank ID       : NM_021953.1
Unigene ID(#167) : Hs.511941
Unigene name     :      forkhead box M1    FOXM1
>gi|11386144|ref|NM_021953.1| Homo sapiens forkhead box M1 (FOXM1), mRNA

```
CGGCGGCGACTGCAGTCTGGAGGGTCCACACTTGTGATTCTCAATGGAGAGTGAAAACGCAGATTCATAA
TGAAAGCTAGCCCCCGTCGGCCACTGATTCTCAAAAGACGGAGGCTGCCCCTTCCTGTTCAAAATGCCCC
AAGTGAAACATCAGAGGAGGAACCTAAGAGATCCCCTGCCCAACAGGAGTCTAATCAAGCAGAGGCCTCC
AAGGAAGTGGCGGAGTCCAACTCTTGCAAGTTTCCAGCTGGGATCAAGATTATTAACCACCCCACCATGC
CCAACACGCAAGTAGTGGCCATCCCCAACAATGCTAATATTCACAGCATCATCACAGCACTGACTGCCAA
GGGAAAAGAGAGTGGCAGTAGTGGGCCCAACAAATTCATCCTCATCAGCTGTGGGGAGCCCCAACTCAG
CCTCCAGGACTCCGGCCTCAAACCCAAACCAGCTATGATGCCAAAAGGACAGAAGTGACCCTGGAGACCT
TGGGACCAAAACCTGCAGCTAGGGATGTGAATCTTCCTAGACCACCTGGAGCCCTTTGCGAGCAGAAACG
GGAGACCTGTGCAGATGGTGAGGCAGCAGGCTGCACTATCAACAATAGCCTATCCAACATCCAGTGGCTT
CGAAAGATGAGTTCTGATGGACTGGGCTCCCGCAGCATCAAGCAAGAGATGGAGGAAAAGGAGAATTGTC
ACCTGGAGCAGCGACAGGTTAAGGTTGAGGAGCCTTCGAGACCATCAGCGTCCTGGCAGAACTCTGTGTC
TGAGCAGCCACCCTACTCTTACATGGCCATGATACAATTCGCCATCAACAGCACTGAGAGGAAGCGCATG
ACTTTGAAAGACATCTATACGTGGATTGAGGACCACTTTCCCTACTTTAAGCACATTGCCAAGCCAGGCT
GGAAGAACTCCATCCGCCACAACCTTTCCCTGCACGACATGTTTGTCCGGGAGACGTCTGCCAATGGCAA
GGTCTCCTTCTGGACCATTCACCCCAGTGCCAACCGCTACTTGACATTGGACCAGGTGTTTAAGCCACTG
GACCCAGGGTCTCCACAATTGCCCGAGCACTTGGAATCACAGCAGAAACGACCGAATCCAGAGCTCCGCC
GGAACATGACCATCAAAACCGAACTCCCCCTGGGCGCACGGCGGAAGATGAAGCCACTGCTACCACGGGT
CAGCTCATACCTGGTACCTATCCAGTTCCCGGTGAACCAGTCACTGGTGTTGCAGCCCTCGGTGAAGGTG
CCATTGCCCCTGGCGGCTTCCCTCATGAGCTCAGAGCTTGCCCGCCATAGCAAGCGAGTCCGCATTGCCC
CCAAGGTGCTGCTAGCTGAGGAGGGGATAGCTCCTCTTTCTTCTGCAGGACCAGGGAAAGAGGAGAAACT
CCTGTTTGGAGAAGGGTTTTCTCCTTTGCTTCCAGTTCAGACTATCAAGGAGGAAGAAATCCAGCCTGGG
GAGGAAATGCCACACTTAGCGAGACCCATCAAAGTGGAGAGCCCTCCCTTGGAAGAGTGGCCCTCCCCGG
CCCCATCTTTCAAAGAGGAATCATCTCACTCCTGGGAGGATTCGTCCCAATCTCCCACCCCAAGACCCAA
GAAGTCCTACAGTGGGCTTAGGTCCCCAACCCGGTGTGTCTCGGAAATGCTTGTGATTCAACACAGGGAG
AGGAGGGAGAGGAGCCGGTCTCGGAGGAAACAGCACTACTGCCTCCCTGTGTGGATGAGCGGAGCTGC
TCTTCTCAGAGGGGCCCAGTACTTCCCGCTGGGCCGCAGAGCTCCCGTTCCCAGCAGACTCCTCTGACCC
TGCCTCCCAGCTCAGCTACTCCCAGGAAGTGGGAGGACCTTTTAAGACACCCATTAAGGAAACGCTGCCC
ATCCTCCACCCCGAGCAAATCTGTCCTCCCCAGAACCCCTGAATCCTGGAGGCTCACGCCCCCAGCCA
AAGTAGGGGGACTGGATTTCAGCCCAGTACAAACCTCCCAGGGTGCCTCTGACCCCTTGCCTGACCCCT
GGGGCTGATGGATCTCAGCACCACTCCCTTGCAAAGTGCTCCCCCCCTTGAATCACCGCAAAGGCTCCTC
```

FIGURE 127 cont'd

```
AGTTCAGAACCCTTAGACCTCATCTCCGTCCCCTTTGGCAACTCTTCTCCCTCAGATATAGACGTCCCCA
AGCCAGGCTCCCCGGAGCCACAGGTTTCTGGCCTTGCAGCCAATCGTTCTCTGACAGAAGGCCTGGTCCT
GGACACAATGAATGACAGCCTCAGCAAGATCCTGCTGGACATCAGCTTTCCTGGCCTGGACGAGGACCCA
CTGGGCCCTGACAACATCAACTGGTCCCAGTTTATTCCTGAGCTACAGTAGAGCCCTGCCCTTGCCCCTG
TGCTCAAGCTGTCCACCATCCCGGGCACTCCAAGGCTCAGTGCACCCCAAGCCTCTGAGTGAGGACAGCA
GGCAGGGACTGTTCTGCTCCTCATAGCTCCCTGCTGCCTGATTATGCAAAAGTAGCAGTCACACCCTAGC
CACTGCTGGGACCTTGTGTTCCCCAAGAGTATCTGATTCCTCTGCTGTCCCTGCCAGGAGCTGAAGGGTG
GGAACAACAAAGGCAATGGTGAAAAGAGATTAGGAACCCCCCAGCCTGTTTCCATTCTCTGCCCAGCAGT
CTCTTACCTTCCCTGATCTTTGCAGGGTGGTCCGTGTAAATAGTATAAATTCTCCAAATTATCCTCTAAT
TATAAATGTAAGCTTATTTCCTTAGATCATTATCCAGAGACTGCCAGAAGGTGGGTAGGATGACCTGGGG
TTTCAATTGACTTCTGTTCCTTGCTTTTAGTTTTGATAGAAGGGAAGACCTGCAGTGCACGGTTTCTTCC
AGGCTGAGGTACCTGGATCTTGGGTTCTTCACTGCAGGGACCCAGACAAGTGGATCTGCTTGCCAGAGTC
CTTTTTGCCCCTCCCTGCCACCTCCCCGTGTTTCCAAGTCAGCTTTCCTGCAAGAAGAAATCCTGGTTAA
AAAAGTCTTTTGTATTGGGTCAGGAGTTGAATTTGGGTGGGAGGATGGATGCAACTGAAGCAGAGTGTG
GGTGCCCAGATGTGCGCTATTAGATGTTTCTCTGATAATGTCCCCAATCATACCAGGGAGACTGGCATTG
ACGAGAACTCAGGTGGAGGCTTGAGAAGGCCGAAAGGGCCCCTGACCTGCCTGGCTTCCTTAGCTTGCCC
CTCAGCTTTGCAAAGAGCCACCCTAGGCCCCAGCTGACCGCATGGGTGTGAGCCAGCTTGAGAACACTAA
CTACTCAATAAAAGCGAAGGTGGACCNAAAAAAAAAAAAAAAAAAA
```

FIGURE 128
SEQ ID NO: 120
Genbank ID       : NM_018952.1
Unigene ID(#167) : Hs.98428
Unigene name     :       homeo box B6         HOXB6
>gi|9506792|ref|NM_018952.1| Homo sapiens homeo box B6 (HOXB6), mRNA
```
ATGAGTTCCTATTTCGTGAACTCCACCTTCCCCGTCACTCTGGCCAGCGGGCAGGAGTCCTTCCTGGGCC
ACGTACCGCTCTATTCGTCGGGCTATCGGGACCCGCTGAGACATTACCCCGCGCCCTACGGGCCAGGGCC
GGGCCAGGACAAGGGCTTTGCCACTTCCTCCTATTACCGCCCGCGCGGGGGCTGGCTACGGCCGAGCGGCG
CCCTGCGCCTACGGCCGGCGCCGGCCTTCTACCGCGAGAAAGAGTCGGCCTGCGCACTCTCCGGCGCCG
ACGAGCAGCCCCGTTCCACCCCGAGCCGCGGAAGTCGGACTGCGCGCAGGACAAGAGCGTGTTCGGCGA
GACAGAAGAGCAGAAGTGCTCCACTCCGGTCTACCCGTGGATGCAGCGGATGAATTCGTGCAACAGTGAG
TGAGACTTCCCGGTCGCCGTCGCCCCGGCTCCCCTGGGCGCCCACCCCGGGACACAGAACTAGTGAGCGC
CCCCTGCCCCAATCTCCCACAGGGTGCTGGGTGGCATCTCAGTTAGGAGATAGAAGAAGATTGGGCGCC
GGCCGGGGGTCTCTCGCTGTGTCCCCTATTAGGCAGGAGTTACAAAGTTTGCAAAGTCCCAGCCGCACTG
GGAGCCATGGGGAGCAAGTGTGCTCTCCTGGGGCGCCTGGCCAGAGCCGGGGTTCCAGGACAGGGAAGGG
AGCAGGAGCCTGCAGTCACTGGCTTGGCTTTACTTTGAGCCCCCAACCCCCCTCTCCCAGCCCTGGTAGG
GTTCCCCAACCAAAGACGGCTCCATTAAAAACGGAGTGCGTCATGCAAGGGGTAGGGGTGACGCTGAA
GAGGAAGAGTTGAGTCTGTCTGGGACTGTGTTTCCCTGTGGTGGGGAGCTGGGGCAAGATGAGGCACCAG
GAAAGGGGTGGTAGTCAGAGGAGGGAGGAGGAATAAGGGGAAGGAAGAGAGAGGGAGCAGGCGGAGCGAG
AGAGGGAGAAACAGGCGCGGGGTCTCAGGTTGGATTATTTGTTGGCCTTAAGTCCCAACTGATGTCCATT
AGCCGGACTCGAAAGTGAGGAGCCGTTAATGTGGACTATGGATCGATCTACGTCATTACGGATTAACGGC
CTGGATTTATCATTGGGTTGGGGGGATGACGGGGGGTGGGAACAAGATGGATGGAAAGGGAGGGAAAGAC
AAGATGCAACTAGGAAGAGACACACCTGACCAGCCCCTCCCCCAGGCTCAGGTGGGAGTTCCAACTGCT
CCTCCCCTCCCCCATCTAGAGTCTACAGACGGCACAGGCCTAGGAGACTAGGAGGGAATCTGGAGGGGGC
GCTGGAGGAGTGCGAAACGGGGAAGGGAGCCGGCAGAATAGAGGGGCATTCCCGGTACTGGCTGGAGTCT
GTGTTCGAGGGTCGACTAGGGGAGGGGGTCCTGGGCCCGGTGACCGCAGGCCTCAGCATCTCCACTCTGC
GTAACAGGTTCCTCCTTTGGGCCCAGCGGCCGGCGAGGCCGCCAGACATACACACGTTACCAGACGCTGG
AGCTGGAGAAGGAGTTTCACTACAATCGCTACCTGACGCGGCGGCGGCGCATCGAGATCGCGCACGCCCT
GTGCCTGACGGAGAGGCAGATCAAGATATGGTTCCAGAACCGACGCATGAAGTGGAAAAAGGAGAGCAAA
CTGCTCAGCGCGTCTCAGCTCAGTGCCGAGGAGGAGGAAGAAAACAGGCCGAGTAAGGTGCTGGAAAGG
GAGGGAGGACGCCGAGGGAAAGGCCTGTGGGGAGCCACGGGCGTCAGAGAGACCCGGGAAGGAAGGCTCT
CGGGTGGGGGAGCCAGGACACCTGCTCTCCGGCGCAGACAGCGGGGCCCAGCGCTCTCCTGGACGCCCC
GCCGCACAGCTCCCGGCGGGTGCTCTGAGGCCTCACTACTCGAGCCCACCCAGCATCCCGCGTCGTCCCT
TCCTTCCCGAGGAACTGCCCTCAGCCTGATCAGGCTTCCTGGTGAGAACTGAGGAGCGGACTCACTTGAT
GTTTCCTGGAAGCAGAGCAAAAGTTCTCTTGTCCCTGTCGCGTCTCATTTTGTCCATGTCCCCGTGCAC
GGTTCAATGGTAGATTCGCTGTCCTCAGCGGGGGCCTTGAAGACTCCCTGATCCCAGACCTGGTCGTCTC
TCCCACCCCCTCCCCAAAGCCACTGGAAGGAGCACATACTACCTAGAAGTAAGAAGAGGAGCCTCAGAAG
AAAACAAAGTTCTATTTTATTAATTTTCTATGTGTTGTGTTTGTAGTCTTGTCTTAGCTCTGGACGCGAA
ATACTTCGATGATGATGATGATGATGATAATAATAATAATAATAACAACAACAACAATAATAAAGAT
GTGAAAACTCGAA
```

FIGURE 129
SEQ ID NO: 121
Genbank ID         : AA524895
Unigene ID(#167)   : Hs.449141
Unigene name       :         Hypothetical  protein  LOC285103,  mRNA  (cDNA  clone
IMAGE:5273139), partial cds
>gi|2265823|gb|AA524895.1|AA524895   nh34g05.s1   NCI_CGAP_Pr3   Homo   sapiens
cDNA cl
one IMAGE:954296, mRNA sequence
GCTCGACACCAAGAGCCTCTCCAAGAAATGCCTGCTTCTGAGCCCACCTGTGGCGGACGTGCCATCCTGC
CCGCACTGAAGCAGACCCCGAAGAACAACTTTGCCGAGACAGAAGAGGCTGCAGGCAATGCAGAAACGGC
GCCTGCATCGCTCGGTGCTTTGAGCTACCCGCATCTGGTCAGTGCCAGGCCCACCAACCTGCAGCTGGAG
ATTGGCTCTCTATAGCATTTCCTGATACTTCCGCTACTTTTAGGCCTGGCTAAATTCCAAGATAGATAAC
ACTCAAGATAGATAAAGTACTTGATCTCCAAACTGACAAACTGTTTATTTTCTAGCTGTTATTTTGCTAT
TTGGCATTTACATAAAAGCACACGATGAAGCAGGTATCGCCTTACCTGTTGAAACTGAAAATAAAGCTTG
TTTATTTCCAAAAAAAAAAAAAAGTCGACG

FIGURE 130
SEQ ID NO: 122
Genbank ID         : AL138828
Unigene ID(#167)   : acc_AL138828
Unigene name       :
>gi|10443374|emb|AL138828.15|  Human  DNA  sequence  from  clone  RP11-472E5  on
chrom
osome 6. Contains ESTs and STSs. Contains the 3' part of the gene for high-
affi
nity  cAMP-specific  3',5'-cyclic  phosphodiesterase  (EC  3.1.4.17,  rolipram-
insens
itive phosphodiesterase type 7) and a novel gene, complete sequence
GAATTCGGCTGTGAATTCATCTGGTCCTGGACTTTTTTGGTTGGTAGGCTATTCATTATTGCCTCAATT
TCAGAACCTGTTATTGGTCTATTCAGAGATTCAACTTCTTCCTGCTTTAGTCTTGGGAGGGTGTATGTGT
CCAGGAATCTATCCATTTCTTCCAGGTTTTCTAGTTTATTTGTGTAGAAGTGTTTGTAGTATTCTCCAAT
GGTAGTTTCTATTTCTGTCTTCGCCTACTTTTCAACATTTTGTGTAATGTTTTGCATAAGCATTTGTTGA
AATGAACTGAATTAGTTTAGGATCCCCTCAGCCTGCCCAAAAACTGGCCCCTTTGCTGACTCCCATACCT
AAATGTTCTACCAAACTGCAAGATACCTACACACTCCAGTGGAGTCTACATCTTCCTGTAGTCTAACCTG
CACCACTAGGGGTTCATGGGTCCCGAGCTGTGGTCCACAGCACACCTGTTGTCCTGGGCTTATAATGTTG
CTGTGAAGAAACACCAGGATAAATGTTCGGTTTTCCTCAGGACATAGTTTTGGTGCTCACTTTTATTAAC
CCTGTCATGTCCAGCAGAGAGAGAAGAAACATGGCCTGGGAAGACTGAAGGGACCTATGAAGTACATCAT
GCGTAGTTGTTCCTGGTCTCTGTTGTGGAGAATGGAGATGCTGGCCACGTGCAGGAGTGCTTTAGAGAGC
AAGGGCTCCCGAGGGCACCTGGAATCCCAATTTAGTCACTTTATAAGCTCTCTGTGCTCCTCAGGACAGT
GGGGATGATACACACACCTATGCCTGGGGCTTGTCACAAGGACTAAAGGTGCTCATACACATAAAGCCCT
TCAAACAGATCCTGACATTTAGAAAATCCTCCTAAAAATACCAACAATTAAGGAGCTGGTAGGGGTGGG
TGGGGGTTTGGGAAGGAACACAGAATATCCATCGGAAGAATGGTAACTAAGTAAGAACAATAGCTACTGG
TTTTTGAATACCAACTATGTGCCAGGCACTGTGCTAAGCAATTTATATATAATGCATTTCTAAAAAACAA
CGAACTTTGCTTGGTGGAAATTCTGGAGATTAAAAGTATTATCCCAGAAATACGTGAATGATGCGTAATC
TTACACCCATCCGTGTTTTCATTACTGAAGGCAGACCCAGATTTCATAGTCCCCAAGTTGACTCCTCAAG
TTGTTCTCCTTCTACCCAACCTTTATAAAAAGACATGTCTTTGTGTTCTTTTAAGGTCTTTTACAGCTTT
TGAAATTCTCCTTGGGCATTCCCACTGCTTCTTGTTCAGTATCTTTTTTTATGAGACTCCTATGTTCCTG
GTGATTGAAGCTTACTTTTTTCTCATTTTCCCTCTGAAAAACTATCAAGCTCAAAAATGAGGATAGCTCT
TGTTGACACTAGTCTAAAACCTGCCTTACCTTCTTTAGAAAACAAACACACTACTATTTACATATTCACT
TTTCAGCATTCAAGTTCCAAAATGCACATTTGTCAGAAAGTCATCATTCTAAGCTAAAGATGCAAGGTGA
TGCAGTATTGTTTGGCGACTCTAACTTAGTGAAATTTCCCTTTTCTCTGATTTTTATATGCAAATCAAGA
TTTTTAAGAAGAGAAGAAAGAACTTTTTTCACATGCAAAGAAATTGTGTTTCATTCCTTTTGCGAAAAA
TGTGGTTTCTGGACGACTAACTCCTGGTTTGCCTCTTTCCTACATACAAAGCTCTCTCACCGACAGCCCA
GGAACACACAGCTAGTGAAACAGAACAATGGACAGGAAGCCTCCTACTTAGCCAGTTCAGCACATAGTCC
TTGATGACCAGGCAGGCCCAGTGTCACTCAAGAAAGTGGAAGATTGAACGCCCACAGGGGAAATTTGGGT
CTAATCAGCCATCTTGGCTCCCTCCTGTAAGATCATGGTACTCGGAACAATAATCTCTGCCTAAGTTATC FIGURE 130 cont'd

```
TGAACTGGCTGCTTGTGCTATCCCATAAATCTATGGAGTGATTAAATTGCACAACCTTCCTCCTCTCTTT
TAGGCCAGATAAACATCTTAGGAGAAATCGTTCACTTAGTTAATTTGGAGAGTAGTCAGCTGAAATAAAC
AAAGCTTCTAGCTGAGATGTGCAGTATGGTGAAAGTTGTCTGAGATTTGGGATCTGGATTTTCTCTGTCT
TTATTTTGCAAGTGGTGGCAGTGACATGAATTAGTAATGTGCTCAGCAAGCTCAGAGGAATACCTTTCAT
GAGAGCTGCTTCTTTCCCACCATATTTGGGCTGCTTTGCGGCTTCACCTTTCTGATACCAGCACTATCTC
ATCTTCCTGGTTCCTTAGTGATGCCCCTGCTATGAATCTCTATCCCATATTCCGTGCAACCTGTTTATAC
CAAGAACGTCACTATCTTCTTCATTCATCTCAGATGCCATGGAAGCCCAGTAGCTACTGCTCTGTCCCTG
ACACCTTTTCCTCACCCTGAAATGACCTTGACATACCACGACAGGGGCCAGAGTCTGGTTCTTGTCACAT
GGCCTGTGTTTCAGCCACTGTAAGTTGTCATCGCTGTCAGAGTCTCCACCCTCTTTGCCAGTTACATAAG
AGGCTACATAGACATCTGCTTCCTAGCACAAGCTTTTATTAACCAGAGGCAGCGTGAGAGGCCAAGTAAG
CAAGAGGTCCATTCCGGAGCCCTGTCCTCAGGGAGGGTGAGGGGCTGTCGTCAGGTCAGGTCGTGGCTCC
TGGGGCAATTCAGCTCAGCTCTGAGCCTGTTTGCAGCCTTCAGTACAGGGGATGACATGTGATGTTGTCA
GCCTGAAGGGGCAAAAAAAGCAGCAGCCTTTCAAAATCAGAATGCCCCTGCTGTTTGTTTCCTTTTGGA
ACACAATAAGAACAGACTGGGGACATGACTCTAGGCTGTCAACGCTTCCTACCAGCTTCCACAGCACCTT
TCATATGCCAGAAGAAAAAAACAAGTTGCTTAAGTTAAACAAGGACTCAATGAATAGTCAAATAATTG
TTTAGCTTGGATATAAGGCCTTAGGTAAATAGATGATTGCCTGAGACCCTGGGCCAGGAAAAGCAGCTAG
GCAGGACACCGCTTGTTCTGTCCCTCAGAAAACAGCCCAGTAGCCTCTGCTCCTCTGAGGACTGTTGTTA
CTGAATTAATTCTCTCTTCCCACCAGCGTATTAAAGCAATTTAATATCAGAACAGGCTCCTTAAAGCAGG
GAGAAGGAAAGAAAACTTTCTATATTAGAAATATACCATTAACACATAAATCTTACTACATGAGCGCTTC
CATTAAATAGAATGCTTCAGATTGGGAATGTCTGGTGTGTTTGTATTGAACTGTTTTCATGTTGTGAAAT
TTCTCAGATGCATTGTTAGCATACTTACAATTGTCCTGCCTCCTGCCTTACTGGTATTCTTAACATGATT
TCATCCTTTTGAAAATGATTATTTACTACACCAAAGGGGCATTGTTAGGTTTATGAGGAATCAGCTTCTC
AAAGTGCAGTGTAGTTATGGACAGTGTCAGCACTGAAATGGAATCTTCCAGGTATGGTTTCCTTATTTGT
TGTTATTGCCGATTTGTTTGGGTTTGTTTGCTTGTTTAGGTATCTTTGCTCTCACCTAGCTCCATTGTTA
CTTGTCTCTTCTTCCCAAAGTAGGGTGCAGTGTGAAAATTTGTTGCCAGCTAATTTCAGTTCTGCTGAAG
AATATTTTTAATAATTGCTTTCTTACTTAAAAGTAATAGATTCCTTGTTGATCCAGGACAGGATTTGGTT
GTCTTGCTTGTACAGCCCATTTCCACTGAAATGCTCTTTGATTGAACCGTGAACTCATCAAGGGAGTGGG
ATTCTCCTGGTATTCTTTTTCCACAAATCATCATGACTGTACATTTGGTTTATCAGCAAACAGCAATCAA
AGCATACATTACGTAAGAAAAAGTTAATGCTGACCTGTTTAACCAATTTTTCATCTTGATAATATAGGAA
AGTGGTTAAGAACATGAGGTTTCAAGTCGGTTCTGAGTTTAAGCATAAGCTCTGCACTTACTAGCTCTAT
GAGTCTGAACAAATTATCAAATTTCCATTAGCTTTGCTTCCTCATCTGTAAAGCTGTCAAATAATAATAA
TAACAGCTACTTTGGGTTGTTGGGTTGATGATGTGAGATAATACATGTAAAATCCTCAGCACAGTATAAG
TATTCAATGAATGTTATCTACCATATTATTTTCACATACCTTATAATTTCCTTACAACAACTCTGTGATG
TAGATAAAATTGCTATGATTTATGCAATTTAAATATTAGACAACTGGACTTCAGAGTGATTACTGATTCA
TCCAGGGTTACCCAAGATGGCAAAATGTTCGTCCTGTCAGTACAGGAGCCCCCAAGTTCCCAGTGTATTG
CCCTCCCTTCATCCATTTGGCCACAGGGTACTCTTCCTCAGTTTCCCTAAATCTAAAACTTTACGTAATA
ATGGGCCTCCGCTGCCCTAGATTGTCAGGTGAAGACCAGGAAGAAATCCTGTCACAGGCATTAAAAACTT
CATCAATATTACACAGTGATTTCCAAAAGGTGAGCGTGAAAGTGCTGGAAGGAGCCCATGAGATTACAGC
AACAGGTCAACAAATCCACAAGCCCAGCCAGCTTTGTAGATAAAATCTATACAGTTCCTCTTTGGTAATA
CTGAGAAGAAAATACTAATGGAGAAGTGATTTCCAAAAGGTGAGCGTGAAAGTGCTGGAAGGAGCCCATG
AGATTACAGCAACAGGTCAACAAATCCACAAGCCCAGCCAGCTTTGTAGATAAAATCTATACAGTCTCCT
CCATGCATCATTTTTACTGTATATGTCTCCCTTCTTACCATTATAAAACATAAATTTATTTAAAGTCAGT
GAGTCTATCATTTTAACATGCTGTATTTTCTCAATTGATATTAAAACTACAACTACTTTTATGTGAGGAT
CTAAGATTTTCATTTCTTTTTTCATTTTAAAAACCAGGTCTACACACTCCCTAAGGTGTGTGTTTCTAAT
CATAAGGTTAGAAAACAACGGTATTGTAGAAAGAGCTCTTCCTATGAAGTCTAACAGCCTAGATTTAAGT
GCTACCCCACTGACTATAAGCTGAAAGCACCATAAACTTAGGCAGCTCAATTAAAGTCCATAAATATTTA
CTATATCAGGACTTTAAGGGGCTTGTGCCCTTAACTGGGACTACAGAGCGAATAGTAGTCCTTCACAACC
ATTCTTCTCTGAGCCTCTATTTTCTTACTTATAAAGTAAAGAGAATAAAGGTGTCTCTCCTCACAGGGTT
ATTATGAAGGTCCAATGAGAAAAAACAAGAAGATAAATATACTGTCATGTTGTGAAAGTGCTTTGTAAAC
ATAGGGTGTTCAAGACAACTGCCGAGGAGAGAAAAACACTTCAACTTTTCTTGGTAGCTTTCCTTTATTG
ACCAGCCACCCCATATTAAAGTACATAAGTACATTTTTTTAAAGCTAACAGCTTTACCCTCATTGATGT
AAGTTTATATTCAGACCTATAAAAGTACTTTTCCATCTATTCCTCTTCCTCTCACTTTGGTTTATAACAT
TTATCCATAAATTACAATATTCTTTCATATCAATATGGCAATGTAATATCACATTATACAAAGCATTGAA
GAAGGCACCAATGTAAAATTCAAAGCAGAGAACAGCCCAAGAGCTCATGGCTTGCACTTTACAACCCCAA
GTACACTCAAGGCCCATCTATGAGGGACATTTTAAGCATATCAGTTGCATGAGTTGCAGCTGATGGGAT
CTCACCCAGGCCCTGAGTTCCTCCAGGAATTAGGAAAGGAAGGAGAGAGGACTGTTCTTCCTTTCAGCTC
CCAGGCTGGGGCCCAGTGCCACCTTACTTCGGGAAAAAGGTGATTTATGGGAGTGTACCCATTACTACT
GGAATTGAAACCTTCCCTGATTCAGTTCTTCCAGAGATACATTATGTCTCACATATTTCTACCTCTCCTC
TGATTCCATATTATATATAATAACTGGTGAATTTGGTCTTTATTTCTACTCTTGTCAACAGAGAACATTC
ACTTAGAATCCACTAAGTACCAGACAGCATTCAAAGTGCTATTATGGAGAAATGTAAATAACATGATATG
CATGATCCCTGCTTTGCAGGAGTTTAGAAGGAAGCAAACCAGCATTTATTGCCAGGCAGTGAGTATTATT
```

FIGURE 130 cont'd

```
TTAGCTTCTCTGACAAGGACACTTCGAAGTGGGTCTTAACTTTATTTTATAAATGAGGCGTCTGAGGCTC
AGAGAAATAAATCTGCCAAGATCACACAAGTAGCAAGCGTCTGGGCCAGATTTCTCCAAGGCCTACCGTG
TTCTAAAGTCCATGCTCTTTCCACTCTACTCCATTACCTCCCCTGATGAGAAAGGCAGGACACATACTAA
AAAGGAAAACGAACACAGATATTAAATATTAAAGGAAACCAGCCAGGCGTGGTGGCTCATGCCTGTAATC
CCAGAACTTTGGGAGGCCGAGGTGGGTGGATCACAAGGTCAAAAGATCAAGACCATCCTGGCCAACATGG
TGATACCCTGTCTCTACTAAAAATACAAAAATTAGCTAGGCATAGTGGCGTGTGCCTGTAGTCCCAGCTA
CTCGGGAGGCTAAGGCAGGAGAATCGCTTGAACTCGGGAGTCAGAGGTTGCAGTGAGCCAAGATCGTGCC
ACTGCACTCCAACCTGGCAACAAAGCGAGACTCCATGTCAAAAAAAAAAAAAAAAAAGAAAGAAATATAT
ATATACATATAAAGGGAACCTACAAATAAATAAGTACTAGAAACTCGACAGACTGTCCTGTGTGCAAGAG
TGGCCAAGTGCCTGGAGCAAGGCTAGCCTGTGAGCCGATTCTAAAGCACATTAATGATACAATCTGGAAA
AAAGAAAGGTGGATGCCAGTCAGAAACAATTGTGTTGGAACAAAGAAAAATTATAGTCTGGGTGATTAA
CACTTTTAAGAACGAAAGCTACAATGCAACACCCATTTGTCTTTCTGGATTCAGAGTCTTTGTCTCTGTG
GCCCTGGGAAGCATAAAAAGACTTTTGTCTTTTTATGGAAATTTGTAAGTTGCTGTGATTTTCACAGACC
CATCTTCTAAGCACATACAAGAGACCTGTGTTCCTTGTTAGTGTATTGCCAACCTCATTACACTCAGTAT
TAAATATTCCTTTCCACATAGCACTCTTCAGTATGGTGAATGGGAACCATTTTCTCCTGACATCTGGGG
TTGGTTTCATTGAGGATTTACAGGGGAAAAGTGAATGCACGTGGCAATGTTTTCAAGCCTTTGTTTGGAT
TTTCTGTTTTCTAGGAGATATACGACTAAGGGTCAGACGGGGGTTCGTGCTGAACGCCGTGGCTCCTAC
CCATTCATTGACTTCCGCCTACTTAACAGTGAGTAATCAAGTGTACCTGGAAAGGAACAAACGTTTTCTT
CAAAAAGAAAAAAAAAAATCCTCATTTCCCTCTGAACTTCGAAACCTTCTGGGGTCTGCCTTCCTTCCTG
AATCTCTCTTCTGCCAACTAGAACTTAACCCTTTGTCTTTGAGTTTCCTCACAAGTGAAGTAATTCTGGC
CCTGCACTGCCTCTCAGAGCTCCACTGAGGGTCAAATGAGATCAGGTCAGCTTTAAAAGTATAAATCTCT
GGCCAGGCATGGTGGCTCACGCCTGTAATCCCAGCACTTCGGGAGGCCAAGGTGGGAGGATTGCTTCAGC
CCAGGAGTTGGGCAACAGAGTGAGACCTTATCTCTACAAAAAATCAAAAAATTAGCTGGGTATGGTGGCA
CAGCCTGTAGTCCCAGCTACTTAATTGGGGCTGAGGTGAGAGAATAGCTTGATCCCAGGAGGTCAAGGC
TGCAGTGAGCCAGGATTGCACCACTGCCTTCCAGCATGTCTCAAAAGAATAAAATTTTTTGTATAAAA
GTGTAAGTCTCAAAACTGTGATGCCCTATACAGGGAAGCTACTATTTTCATTTTCCAGCACATTCTCTC
TACCTTCAGCCAGAGCTAGACTAGGTGAGATTCCATTTTGTTTTAAAACCCCACAGGGAAACCTCTTCT
ACAGTTGCCCTTAGTAACCTACCTGTTATGGAATTCTCACTTCTTTGTCTAATATAAATCCTTGAGGTCT
ATTCTTGCCTTCCTGGTAAAACTCTTCACCAGGGCAAAATCCAAAGCACTTGCTGCTTTCTCCCTTGAAT
CTTACAAGTTCATTGACTTCTACCTTCCCCTCCCTAAACTGCTCCTCATCAGTAGTTTTGCTCAACCTTT
GGTCCACAATTTTCTTAATCTTAGGTTTCTTTGCAAACCCAAACCAGTGACCAGTCATCCCTCCAGATTT
CATGCCTTATAACGATCATAATCATCCTTCACTGTAGACTTGTGGGGGAGGTGGAAGAGCAAGTGGATAA
ATTTCACAATTTGCTCCAAGGTTTTCAGTGTTTGGTTCTCATATCACTTCCCATCTATAAATTTCAAAGT
GCTAGATTATACCCAAAGAATATTACTTTCCTTTGACATAAATAAGCTCAGCTAAAGAGGCAATTTGATT
TACTTCAACCCCTGGAAATTACTAGGAGAAATTAGAACCTGTTATTTCTGATCCTTCGATCCTTGAGAGG
CCAATAGTAGGTGGCATGTTTGTATTTCTCCTGGCTTGTTAATCTCCCATATCAATGTGCAATGTCTGTT
TTTTTTAGCACTTTCAGGGACACAGAGACTTGGAGTAATTCTTTCCACACTAGAGATAACCTTCCCTACC
CAGACCCTCAAAAATGCTTTTTGGAAGACCGAATTGAGCCATTAGACCAATGCAATATGGGATACAGCCT
GCGGGAGCTCTATTGGTCTCTCTGACCTTTCCTTATACCCTGAATGGGCTGTTCCAGCTACCCACGGAAG
TTACACCTTTGACAGTCTCTAGACTGAGTGGATTTCCAGGTCCTAGGCATGTGGTTTCTCCAAGCAGGAC
AAGGATGAGCAAGGGGTTCCATTTCACTGTTTCATATAGACCAGAACGCTCCAACGGCATCCCATTTGA
AAGTCGGAGGGAGAAAACAACCGAAAGGCCTCTTTTCAATAGTAGATGAGTGTTAGTTCATGGTTTCTAA
TATGAACCACAAAGGAATTAGGAAAATAAGGGGATATTTCTGTTTATAATTCCAAAGTTTCATTATTTTA
AAACCTTAATCCCAGTGTTAATAAGCAACTTTACTGCTAATGGTGGTTATGTTTGCAGGTGGGACAGTGG
AATATTTAATTATCTACATCATAGGATTCTGCAACATTTTTTTTTTTTTTTTTTACAATTTGCCTCT
TTTACTTTTGTAATCTGAAAAACAACTGCAAAAATAAATAACATTTAAAGAGAAACTCATTGCAGATAAT
AATTCAGTGTCATATTGTTCACCACGTAAGAGATCATCTGCCAGCAGCTGCTATCCTGTCTTCCCTTTGC
TGGAGATCCTCCAGGACTTCTGAGCACCTGGGCTCAACCCCAGCCTCATTTCCCTGGCCCTGGATGCTGC
CTGCCCCTCTACCCCCATTTCACCCCACCTGGTACTCACAATCCTCCACTCATCGAGTGACAGTGCTGGC
CATCCACCCGGAAATTCCCTTTAGGGTCTCCTCAGCATTCCATTCCGGATAACTCTTTCACCCATGTCTC
TTACTCTGTAACATATTGCAGATGCAATATTAATTTTCCTTTAGCATATTTTCCTTTATAGGTGGTCTCC
AGTTTTTTTAATGTATCAAAGACACCCCAAAAAGACTATAAGATCCTAAAGACAGTCTTCTCTTTATCCC
TAAATAGACTATCAGATCCTAAAGACAATCAATTGCTATTGATCATTTACTAACTATAGTTAACTGACCA
ATTATTAAAGGGTCTCCTCGAAAACATTATATTAAATAACTATGAATGTAAATCATCCCTGTGTTTAAC
TGAACAACACGGGTAGGAATGAAGGCCTCTAAGATTTTCCTTTGTGATACGATTTACCTCTTGGTATAAT
GCACCAAAGACCCCATTGGTGATTGAAACTAGAACAGATAACATTACTGTGGTCGCCCTCCACGGTTCC
TAACTTAGTTTGCAATTACAACAGCTTGTCACCATGGAGCAGAGATGTATGAACATCTGTGTTATGCACA
GTCACATAAGGTATATATGGCATATCTCCTACTACTTCATATACTGTCTATTTAATTCTCTTTAATATCA
TTCACGTCCTTGTTGTGGTTTGCCTGAGTTGTTAGTGTGTGCTTTATGCCTAAAGGGAAACATCTTGGGA
CATTTGGGGATTTTCTCGTAGAACTTTTCTTTTTACCAGCTCATTCTTATTCTACACTGTAAGAGCTGAA
CTAGTTTAAAGTGATTCTTTAGATCACTTACCTTAATTTTGAGTCAAGTTTTTCCCAGTGTGGGCACAGA
```

FIGURE 130 cont'd

```
CCCCAAACTTCATTTTCCTTGGGTGCTTGCAGTTTTGTTCTCTCTCCCACAGTAAAATCTAATCTAGGAT
TTTTTTAAACCATTTATAGGAAAAACCAAATCACCATAGCTGTCACTCCCCAGCTCTGCATCCCTGCAGC
CTTCCTTCCAAAATGTTAGTGAAACCCACACAACTGCCATCCCCTTTCCAAAGTGTCGCTGGGTGGGTGT
CCCTCCCCCACCCACCTCAGTATATGCATTGAATCACTGGAGCACGCAAGAGCAGAAATGTATACTAAAT
AGTGAGGCCCATGCATTTCCCCATTGGTCCCATTAGTCACAGCCCCAGTTTGTCACAGGAGGGCAGAGGA
CATCAGAATTAAAATCTAAAATTACTTGTCTTCAACCAGAACAAAGTTTCTAGGCGTTAAAATGGATAAC
TAGAACAGAAGTGGACAAATGACTGTCCACACACCAAATCTGTCCCCTCCTCCTGCCTGTTTTGGTAAAT
AAAATTTTACTGGGATATTGCTATGCCCATTTGTTTATATGACATCTATGACTGCTGTCACTGAAACAGT
GGCAAGTAGTTGCACAGAAACCGTGTGGTCTACAAACCGCCCCCACAAACCCCAAAATACTCACCCTA
TGGCCCTTTACAGAACAAGGTTGCCAATCCTTAACTTAGATTTTTTAAACAGATTTAAGAGAGCTTTTT
GACAAAGCCACAAGCACATTCAGTCCAGTGTGTTTATCTTTGTTAATGTCTTTTTTTTTTCTGTTCAGT
TTCCACTGCCATCACTTTACTTTCAAGAATGGACTCACATTGACTAAATTTTTATGAACAGAAGAATAAA
CAGAGAGGGAACCTCTGTTATTGATGCAGATTTTAAATTCCAATTTAAAATTATAATTTCTACTTGCACA
TTCTTCTGGAAGAGATTATTTTTGCGGGGAGGGGAAGCACATGTTTGGGGCAGAGGGAAACACAGTACTA
CCAATTTCATGTACCTGTTTTCTGCATATAAGGTGACTCTTGGTTTGCCTGGCATAGTCCTAGTTTGCAC
CTGTTGTTCAGGAGTATTTATTAATAGTGCCATTTTCATTCCCAGAGTGTCCTGATTTGGACACTAAAT
TACAAGGCCAACTGCTTATATAGGTTTTCCCAAAAAAGAGTATTTAAATTTAATGTTTCTCAAAGATCAC
ATGCAGGAATAAGCTTAAAAGATCTATTGTATAATATTGTGACTATAGTTAATAACAAACGTATATTTGA
AAATTGCTAACAGAGTAGGTTTTAAATGATCTCATCACAAAAATAAGTACGTGAGGTAATGCATAAGTT
ATTTAGCTTTACTTAGCCATTCCACAATGTGTGTGTATATATACATATAGATCTTGAAATATGTTGTA
TACCATAAATATGTACAATTTTGTTAAAAATAATAATACCATATCATATGCATTCCAGGAATAAAGATTA
GAAAATCATTTTCATAAGAGATTCATCTAGATCAATAGAAATACATAACACTCATTAAAAGCTAATTTCG
TTCCCTGTTTCTATTTTACACAATTTAGAAGAGAGTCATCTCTATGAACTTCTTGAAGCTTCTCTGGATA
AATAGCAGGAAACTGTGGCCTCAGCACTGTTTGTGTGGGACATAGGAAAGATAGATCTTTAAAGACTGTT
ATCTTTACACCTAAGCATAGAGAGCCAGAACAGAGAGAAAGGGGGAAATTGTTTTTATTCCAGATGAT
GTCCTAACACAGAGAACTGGAGGGACGGAAAAGTAACGGCTGTATTCTCCCAATGTCGATTTCCTATAGA
TTTATTTCATTTACTAATTCTGTTTGTAGGGGGAAACAAAGGAGGAAAAAATGTAGAGAAGAGTGTTCT
GAGACTTGTGGACCCAGAGGGAGAGTTGCAGAAGCAATTACAACCTTCTGCAGAGCAGGCGGCTCCAGC
AGCCCCGTCTACAGCTCTGTCTCCTGATTTAATATAATCAGCAGCCTGAGTAGATAATGACTAGGTTGAG
ATGTTCCCGTGGCAACCATCTCAGAGCAACACAAAGTGATTTCCACACCGGCTCAGCAGAGGAAGTGACA
TACAAAGAAAACGTGCTCAGGGACTGTGAGCTTGAGGAAAAGAAACAGCTTCAGCCTGAGGTTTTAGGG
CACCAAGTATCCACTGCTACAGAGAACCCAGAGCTCCAGACCAGCCCCTGGGCTTTGCAGTAGTAGGTTA
ATTGGCTATTTGGCTTTTCCTGACTGTTAATTTGCTAATCTTGATCTTTAAAGCTCTATTCCTTCAGACT
TGACTCTCCTGTCAGGGTCATCTTAACTGCACAAGCATGAGGTCATTTTAGTAGAGCTACAAAAATATTT
CCCTTTACTTATTATTTCCCAAATGGAACCAATATATACAAACATATATATTTTTAACCTTTCTATGAA
GAAGTGACCCAGAGACTCAAATATTTTTTTAAAGCTGCCATCTAAAACATATTATACCCTGCAGCCATTC
TTTCTTTGACATATAAAACACACTCTCTTTGACATATAAAACACACTCTCGATGAAGGACTGTTGAACAA
AAGCCACTCAGTATGCTGGAAATCATCTGGCCCTAAGTGATAGCCCCATCTTAAAGATGGAGGGACAGTT
TCCTTCCAGACTCCATTTCCTATGAGAGAATTCTTGGCAGACAGTTACAGCCTTTTAGTAACCTTACAGA
TACCTTTTCCTGTCACCTATAAGAACTACACAAAATGCAAAGAATCTGAACTAAAATGTCATTGGATGAT
TTGAATTCAGTCATGCTGAGAAGATGCTATCCCACCCCCAGCCCTGTGTTCCCAAGCGGAGAAGGGAGG
TGTCCGCTGGGACTTGTTCAGACTTCTCCTCACACTTGTGAGTGCCAAGGTAACACCCTACAATTTCAAA
GTTCAATATTTACCTTCCTCTAGAAGAAAGGCAAGGCACTGGCTGTGGTAGTGGTGCTTTCTGGCTCAGC
TGGATCTTGCTCCATGATGGTGCACTCAGGGCTTCTGGCTGCAAGCTCCCAGCACTTCAGCTGCGGAAGT
GCCAGGGCAGCAGGATGGTTAACCACTGAAATGCCCACTAGCTTGCAGAAGACAGAGTTGGCGATGTCCC
GACTCTCCCTATTACTACCCCTCGACGGAGCACCTCCTATGGTAGGCATTGTACCAGTGCTGGAGATACA
AAGATGAATGAGACATGGCCACTGCCCTTGAGGGATTTACAGTAGCATAAGCTACTGTATCTACAATTTA
TTTACAAATACATTTTGATGTGGTGTGATACACCAAATAATACATGCCTGTATAATAACAGCATACATAA
TATGAGAAATATATGCATCTACGGGATTCAGAGGAGTTCGAGAAGGGAATAATTAACTCTGTCTTGGAAA
TTAAGGAAGTCTTCCTGGGAGAAGTTAAAACACAAGCAGATTATGGAAGCAACAGTGAAATAAAAGAGGG
CTGTATGCTAAGGTCAACTATTAGGGCCATTATAAAATACGCTTTAAGACTTAAGAAACCAGGAAACAT
TGTCAACAAGTTTGCTCAACTAGATAAAAGTGTTATTGAAAGACAAAGTATTCTAGTGGGATCCAAGCAG
AGAAGTCAGGAAAAATTATACAACATATGTCTGAGAAAAAACATATTCAAAAGAAACCATTTTCACCTT
CTACATCTAAAAGTGAAAACAGCCATTGCCTTCTGTTAACCTGTCTGACATCATTTAATGGATTACTTTT
TATCTGAAGGATGAAAATAGAAATTGAGTTAGGGAGTCCAGTACTTCCTCTGGGTTTTCATTCATTTA
TTCAGTCAACAAACAGCACCTACTCTATGCCAAGAAGGCCATGAAACCCAGGTGCTCTGAGCCACACCAA
CCGCCACAGGACTGAGATAGCCTTTTGTATGATGGCTACCTTCTGTCTCAGACAGCAGTGGGACTGGGGT
CTACCAGAGACACCAAACAAAATATCTGAACAATTCCTTTTAAGTCAACAAGGACCGGGGAGATGGGGG
AGAAACCTGCTATATGCTATATCTGGGCAGAAATTCTGAGGGCTAGAAAGGAAACTATGAGATATTCTG
CTACCCTCAAAGAGCAAACAATCTCATTACATAGACAAGGAAATAAACATTACACCAAGTACCATACAA
CAAAGTAAATGATCTAATTCTAAAATAAGTAACAATAATCAGAGACAAGAGAAGGCAGAGATTACTGAAG
```

FIGURE 130 cont'd

```
TAACCTGAGCAGAAGAAGGCTTTATGGTCTTGTGCTAAACACTGAAAGATAAGACAGTGTTGACTGATTA
AGGAGTTGCCTATAAGGGAGACTGACCTACATATGAGGACATAACGTCATTAAGTAGGAAGAAGGTCCAA
AAAGTAGCAAATAAAGTTCATTAACTAGAGAGAAAGGCTTGGAATGCCAAGATAAAGAATTCAAACTTGT
CTCATTAAGAAGAGGATCTCTAGAGAATTTTGCAAAAAAGGTGAACCGTATAAAACACTGTTTGAGAAAA
TTAACTAACATCCATATGTAGGAGACACAGTTTCAATGAATCCAAAGAAATGTAATCAGGCTGCAGACTG
TGATGGCTGTAGAGATGATAGTGTAAATCCACAGATTTCATATAAAAGAAGACATAAAACTGGAGGATAC
TGAATATTGGGAGAGCCAGAGTTGGTCTGGCCATCTGAAAAATTGGAGCTGAGATCAACAGTCAGAAAAG
TTAGAGGATGAGTTAGGGGAAAGATGGTAAGCTCCACTGGGACAGGTTGAGTTTGCAGGAGAATCGAGTG
GAAATGTCCGGAAGAAAGCTAGAAATAATGGACTAAAGTGCAGAGGAGAGGTCTATTTTGGGAATTCCAC
TTGGGAATCATAATCATTCATGAGCCATCTGGCCAGAACAGGCGTCATGAAGTCAACCAACTACTTTGT
TCAGGGGCCCCTGTATTTTTAGTTTATAATAAGCTTGATTTTGAAAAGCATTACAAGACTGTCCATGAGA
AATCCCACAAAGAAATTAGTTTCCTTTAGTGAGAAACTCTAAATTTTTCTCTGTGAGAAACTATTTAGAC
ATAAGAGTTCAGGCACCACCTCACTCCCTCATGATGGATTCTATTGAGTACAAAAGTGACTTGTGTCAGA
TCCCAGCGGATTTGCTAACTCACCTGAACACAGCACAGAGAAATGGCCATTTTCTACTACAGCACTTCCT
TGAGCGAAACTCTAACCCACTCAAAGTATTTTCAGCATAGTGGCTTCTTTGGATTTCTGGAGACATTAAA
ATATAGAGGGAAGCAGAAGTAAATTAAGTTTTTTTTACTGAAGTTACCTATGAGTCACTGAGCTAAAATG
ACTTGTTGTTCAATAAAATTAAATTCAACCTCCTACCCAGAAACAGGCAGAGCCTATCTCTGTGACCTC
ATTAATAAACCAAATGCAGGGCTATTTTTTCATTGCCATCCCACCTTCAACGTTTCAGAATATCTAAGG
GATTCACTGTGGTCCCCATTCTACTGTATGTATGAAAAACCAGAACATGGCCCCATCCTTAATATCTTTT
GTATGTTTTCAAACTGAGATCTCAGGGTTCACACACAAGATCAAAAAGACCTTTTTTCTTTCTAACTAG
CAGACCAAATTGCCTTGGGGCATCTGGGTCCTTTATTACTTTTAAGTAAGCTGGGGAAGAAGGGCAGAAG
TTATGGAGGAAAGTCCCAAGAAGAAGGTGGCCAATGCCACTATATCTAACAACAGCCACCATAACAGCTC
TAGTCTGAGAGGTGCTTAACCCCAGGCACAGGATGTACAAGGCCAGGTGTGCACCCCTCTTAGGCAAGGT
CCCCAGGCTATAGGTCTCTTGGAAGCCTGGAAGCACAGGAGGATTGCTGTGAATACTAAAAATAAAAATG
AGTCCCTTCACAACCAAACCACGGCTGCCTCTCTGCCTCTTCTACCATGGTTGCCCCACCCAGAGCTCCA
AGCTCACTAAGTCATCATCAATAGAGGAGCCCACAGAAAGACCATGAGCTTTGAAGTTAGACCTGGGTTT
GAATCCTACTTATACTGTGAGCTTGAAAAGATGCCCAAACTACTTAATGTTCACATACATGCAAGATTT
TAATTTGATTGGGTTGTGGTGAGGAGTAAATGAGATAAATGTGTCCAGAAGCCTGCCTTGCTTATAATAG
GTCCATAATAAATACAGTTGAGTTTTGGATGTCCCTTCTCTCTCTGCTGAGTACATCCCTCTCCAGCCAC
CTCTTCTCCTAGGAAGCATCTGTTCACCCTTCAAGCCCTGGCCCCATCATTATGTCCTTTGTGAAGCCTT
CTTCAATCCTCCCAAAGGAGTGAACTCATCATTCTCTCTGCACTCCCACTACATCTCCCAGAAAGCATTA
TCACATTGTAACTGCGAAGTCATTGAACCTGAATTTCTGGAGGTAGAGCCCAGGATATTTCAAAACAGC
CTCAGGCAACCTGAAGCAACAAGCCTGGCTCTGGGCCTTCCAGGAATATTTGGGAACCACTATATATGTC
AATTATGGCATACAAATTATATCTATGCTTTGCACAGTTAGACTCATTTAATCCCCATAAACACCCTATA
AAGTAGCCACTACTATTACAGATGAGGAAACTGAGACTGAAAGAGGAGAAATAACTCAACCAAGGTCACC
CAGCTTGTAAGCCAGAATTTAAACCCCAAATATATAATCGCAGAGCACAAGCTTTTAACCATAGTAAAGT
ATAATCCTTTTTATATATGAATTTTAATATTCAAAGGCAATATATGATGCAGTATACTCCTTTTACAATG
AACATATATATGCCAATTATTCCTTTTAAATATTTTTTATAAATTATGAAAATTTTCTTTTTATAGTACA
TTTAGATTATTTCCTTTTGGTATTAAATGACTTCAGTATCATTGAACAAATATTCCTATAACTGAATGAG
AAAATATGAGATTAAACATCTAAAAAATCAGATTTTGCAATATTTCTACTGTATTTTCTAATATTCCTGC
CACTCTGGTGGAAGACGCCAAATGACAGACTGCACATTTCATCGCCTGACCTTGTGTTCTTTGATAAGAA
AGAAAAGGGCGTGGTGGTGACAACTGAGGATACTTGTAAGCTGCCCCCAAAGAAGAAGGAAATGGAATCG
CTATTGTGACAAATTAAAGTCAGATTTGTAGCTGCCACCAGTTGCTTTAATTTTTCTCAAGGGGAGTTG
GTTATTTCCTGTCGTGCAAACCATGAATCGCTGAAAGAAACAATTTCTCAAAATGTTTATAACATATTAG
ATAAAAAGCAGAATAGAAAGTCTATATCCAAAAAGAAGATCTCAGTTATGTTTATTAAAATATGCCAAA
ATCCGAACAAGGGTTCTTTCTAGATGATTATTGTTCTTCTGGTTTTCTATTTTTTTCCTACTGGAAGCAT
GTATTCCTTTTTATAATCAGAAAAAAATGAGATTTTATTTTTAAAAATTTCAATGTCCGCAGAAAAAGAA
CCTTTATTTTTCTTCCAAAGGAATATCAAGATGCAGAAAATGAAATTGCAGCCATAGGCCAGAAAACATT
ATTTAACAGGCCTAAATTGGAAAATTGGTTGGAAATTGTGAAGTTGGGTGTTTCTCAAAAGCTATGTAAG
CTACTTTGCTTGTCATTTTAAAGTGAAATTTATTCCAAAGAGCACAAAATCAAAGTTCTTATTCACATTT
GAACAGCACTTTAGACTTTGCAAAGCTTTTAAATGAAGACACTCAAAAAATCATTGAGCCCAGTTTTTCA
TTTTATAAGCAAACAAAAACAAAAAACAGGCCAAGTGATTCAAGCAAAGCTATGAAAGAGTTAACCAGGG
TTGGGCTCTTCTTACATTCTGTCTTTCCACTCAACCATATAAGGCTTCCTTATATAAGCCTTACCTTCAA
GATATAAAATAACTTTTACCACTTGCAAAAAGAGAAAATAAAACACCAGGATTCCCCTTGAAGGTGGTTG
GTGTTGGCTCCAGAGCCGGCTGCCTGGGTTTAGATTCCAGTAGCAGTTGCTACAGGACTTTGATCTACTG
ACCCCTGGTCCTCTGATTCCTCCGGGCTAGAAAAGACGATTCACAAGTGCACATCTCATGGGTTATTGTG
GGAAGTAGTGAGTAAGCGTGCTTAGAGTGCTAGTGTAATACCTGCCATGGTATCAATTATTTTATTATTA
CAGATATTAGTATTCCCATTTAAGAAGGGCATAGGACACATAACAATATAAAGTACTTGACTTATAGTGA
AGTAGAGAATGGCCTATTAACCCTTTTCAGTTTTCCATTCTATAGTTTATCTTTTTTCTGACAGGTATT
TACTGAGCTCCCCCTACAATGCCTGCAGCATTGCTTCCAACATGTGGTTGTTAATAAATTGGTAGAGAG
ACTGATGGCTGGAAAAGTGAGGCTAGGGAAGGTTGTTTTGTTTTGTTTTTCACAAGACATTGAAGCAAGC
```

FIGURE 130 cont'd

```
TGAAATCATGGTGAGAAGGATCTAGTTGAGAAAGAACCATGGAATAGACCAGAAAAATCATAACTGAGAA
TAAAGTGTCCTGAGAAGATGGGAGGGGATGACTGGCCTGAGAAAAGGAGGCAACTCTCCTAACAGCAGGT
GGGAAGAAGGAAAGAAGGGATGCAACGCAGGGGGTTTGGTAGGTTTCATAGCAGAAAAGTAAGGAATTTC
CCATCTAACAACTTCTCGTTTCTCCATGAAGTAGCAAGCCAGGTAGAGAACAGTAGAGATGGGGCAGCCC
GAGGGGCCACCAGAGCTTGGTGGTCTTGCTTTTGTGGCACTATATGTCAGTATAGCCCAGAGAGATAGTT
CTGTGCTCCACCTGGCCACCAGCAGTCAATGTCATCAAAAGCATCACAGGGAAATTCCATCAGCAGTGTG
GTCGCCTGGCTCAGCCTTGGTCATCTAAGTCTTTACCATTGTTTTCAGCTTTCCCCTCCTCAGTTTGGGC
TAGTATAGACAAGCCTACCACTATTCCCACCCTCCCCTACATGTCCACATCTCCCTTAGCAATGCACACT
GAAAAACAAGAAAAATTATAACCTTGTGTCTGACTCCCCTCTCCTTCCTGAACTCATTTGTGCTCTGTGG
GTAATATCATCTATAAGGAAGGTCTAGCAGTGGAAACAAGTTTTCCCTGTCCCTCGGTGTCTGGGCCCTG
GCACACCCACCCCATCCACATGATCATCCACTACTGGTCACTCATCACCTGAAGCCAGCTGTGACTGCAG
CTAGTTCACTTCTAGGCAGGGGTTGGGAGATGTCCCCTCCTTGCTTTCCTGTGATTCTGGATCCTATAAT
GCTAATCTTTTCTCCCAAGAGATGCCAAGAAATTAGGCAAGTAGAAGCCCAGTATCCCCTTCCCTCTCCT
ACCTACCATTTTTCGACAATTCTTTATGTGTAAGGAAAAGAATTCCCCATCTCCCATCTTCTTTTCCCAT
TCTTTCATTTCATGTTCTACCACATTAGCTTTATTTTCTGTTTTGGAGAGAATTCTTGGAAAAGACCAGA
AAGCTAAAAATGTATTTTTAGAAAGTCCTCCTTGGAAGACCTAAGATCATCCCTTTTTAAAAAAAGGAGA
AAGGGTAAACTAGATTACACTATTCACATTTATTGAGCAACTACTGTGTACCAGGCCATAAGTGCTAAAA
GAAATAAAGGATGAACAAAACATTTTGGGAAAGGGCTGATACAGAACTCACTAGAACACCAGCTAAATTG
GCAAGTGTCACGAGGTTCTAATGGAGAAAGCACTGGACATTCTAGTGAAGGACCTTGTGGAAAGGTTGGC
ATTGGCATTTGGACAATGACTGGATTTTTGTAAGTAGAAGTTTTTTTAAAGTGCATTCAAAAAAAGACCA
GGTATGGGAAAATGCTGAATACGTTTAAAGGGTGAGCACCTCAGATTCTGCGGTGAATGTGTAGTGCTGA
AAGGGTATTGCATAGTTGGAGGGACGGTAATCAGAATTGATGTAAAATTAGGCTGAAACCCTTACTAAAT
GTTAAGGGTTGGTTAGAACCAGACCAGTGATGGTCTTGAATGCCAATTTATAATCTTTTTTTTTTTTGAG
ACGGAGTCTTGCTGTGTCACCCAGGCTGGAGCGCAGTGGTGTGATCTTGGCTCACTGCAAGCTCCGCCTC
CCGGGTTCACGCCACTCTCCTGCCTCAGCCTCCTGAGTAGCTGGGACTCCAGGCGCCCACCACCACGCCC
GGCTAATTTTTTGTATTTTTAGTAGAGATGGGGTTTCACCGTGTTAGCCAGGATGGTCTGGATCTCCTGA
CCCCATGATCCGCCTGTCTCGGCCTCCCAAAGTGCTGGGATTACAGGCGTGAGCCACCACGCCCAGCTAT
AATTTAATCTTTTTTAAATGGAGATTTCACTTAGGGCTTGTGAGTATAGACAAACGCATTTTCTTTCCCT
CATATCTTATATAGCAAGTGGTTGCTCCTGCTTAATATTAAAACTAAGTTACAAAGAAAGAGTCAGTTTT
TCCTGGGTATACAGTGAAAACACATTCCCTCTTCAATCCCCTAACCCAACCTTCTATGCCTAAGATCAAG
AGTGCTTTTACAATATGCTTTATAAAAACCTCAAAAACTCATCTCAGTATTCAATTATATTTCAAAATTG
TTGCCTGGAAAGCCCAGGATCTCAATCCATTATTGGTGTACAATCTATAATTGTATATTGGAATTCTAAA
ATTAGCTGGTATCTATTGAAAGTGTTCTATGTGCTAAGCACTTTATATGTATAACATTATTTATTCCTCT
CAAAAATGTGTAGATTCTGTAAATTATTATCCTCAAGTGACACAAGGGGCAACAGAAGCACTAAGGAAGT
AGAGAGGTTCAGTAGCTGTATGGGAGCATAGTCAGGTTGCAAAGCTTCATGGAAGACTCTAGAGATCATC
CTCTGTATCTCTCTGCAGGCAGCTCCCATCACCCTCCCTGCTGAGATGGATGCTCTTCAGGCAAGCCTCC
AGACACACTAAGACTGCTGGGATATTCTTATTCATTCATTTATTCACTCCATTCGTATTTACTGAGCACC
TATGTGTCAGGCGCTCTTCTAATTGCTTAGCTCTTACAGTGGAAAGTGAACAAAGTTCTTTCATTTGAAA
GGCCTCTTCTCCATCTAGGTGCGGTGGCTAATCCCGCACTTTGGGAGGCTGAAGCAAGAGGATCACTTGA
GGCCAGGAGTTCAAAACCAGTCTGGGCAACATAGCAAGACTCTATCTCTACAAAAAATAAAAATAAAACA
ATTAGCTGGGTGTGTGATGACGCGTGCCTGTAGTCCTAGCTACTCGGGGGCTGATGTGGGAGCATTTGA
GCCCAGGAGTTCAAGGCTGTGATGAGCTGGAAGATACCAACTCTATAAAGTAAAAGACCTCTTATTTTCT
CTATCACAATTATGCCTCTTGATTATAACAATAATTATTCTTTTAGAGGAAATATTAGGTCTCCAAAATG
TCAACAGTGTTCTTCATATCACTGCCAAACTATCTCAACGTTCACATAGAAAATCATTTTTACAGGCAAA
TAGATTATAACATCTCAGAAGGAAATGTCTTCAAAGATAAGTGCTGCCTAATATATTAAAGGACAAGCAA
GTTCTAGTTGGTCAAATGGTCTCTTCGCTGGGAATTGCCAAACAAGGATAACCTGTTTGAAAGAATTAT
AGCATAATCAAAAACTCCTAACACAAAAGCTATTTGAGGCATAACTTAACTCTTCCCCAGTGACTCATGA
CTTCTCAGAATCTTAGAATGTTTCAGAGTCAATTAATTTAAACAGCAATTATTAACTGGAACTTCAAAAC
AATCTTTGTGAAGAGTTTAGCTTTCTTATTGTTGCAATTTCCATTTGCTGAACCAATTAAGGCCAGTGGT
ACCACCTGAGATTTTGAAAATAAATCAGTGGGTTTTTATTTCAGCTGTTTGGAAATGACTAATAGAGTAA
TACAATAGATTAATTTTATCTAACATTAATAGCTGGATGTATAAGAAACACCCACTCTCTAGAAATTAAG
ACATGTCACCATAGTCTTATGACAAGAGTGAGTCTCTTATTTTTGAACTTTCTATTGAACAGTTCTCACC
ATCTTAAATCACCCTTTGTTATGAGTTTTTAAGTGTCTTAAGTAGAGAAGGTTAAGAAAATGAATACTTA
TACTCCTTTAAATACTAATTAAGAGGCCCTGGTAACCATTTATCAGTAATATTAATGGCATGAAAATTGA
AAAGTATGACTCAAAGGTGAATTCAGGGCAATTTAAATTATATATAAAAAATAAAAACTTAGGTGGAAG
AATTTAAAAATTTTAAAATTCTGCCCAAATTGTGGAGTGCAATTTTATACACTGGGAAGAAAAATGACAG
CAATAAAAATTTTAAAAAGATGAAAAATATTTTTTAAAAAAATTGTGCAACCCAATTTTAAATGGGACTGA
GAAATATAAGCAAAGCATCGACAAAATAGTATATTGTTAGAAAAGCTATGCAAATGAAAGAACATTAAAA
TCACTTTGCTATATAAAACAATGTCAAATGACAGTATCAAGTGTCCACATCCCCTGAGGCCAAGTTTCAG
TCATCTAGTCCATATGGAGAGTAATGCTGTGCCCTCAGCTATTTCCTTCTTAGGACTAATGGAAATCAAA
TTAGCTCCCTTTTCATATTATGTGAATAAAATATAAGTTCCACAAGGAAAAGGACTTTATTTTGTTCATT
```

FIGURE 130 cont'd

```
GCTATATCCTAGTCCCCAGAACAATGCTTTTTTTCACATAGCAGGATCTTGACAGATATTTGTTGAATTA
ATAAATATTGAAGGCATTTATTCAAAATGACTTGTTGCTATGGATGGCGTATTTTATTTTTACTAAAGTT
AAATTATATATAACATGCTGACAACAGCAGCTGGAGAGTTTGCCCTATTGTGTGAAGTTTTTCCAAGAAG
AGTTTAGCAAACAGCATATTTGTGAAGATTATCAATATGTGGAATGGGTGTGATATTACATACATATCAA
ATTATTTGTATTTGTGATAAAACAAATATTTAAAGTACAATATTGAGGATTTTAGTAAAAGGAGAATTTG
TCTTTTCTAAACAAAGAAAATTATAGGGTGTGACTAGATCATCCTTTATCCTTAAGTCATATTTTCCAAA
TCTTTAATCCTTTATAGCACCATTTCCCAAAGCGTGGTATGGGAACACAGGCGATATTTTGTTACAGAA
ACAACCTTTTATCTTTTACTATAATCGTTACATGTATATTTTAACATGTACTAGAGAAATGTAATTAGC
ACGTCAAATCTGTTTTTTATTGATACTAATTTTATATAAGTTATATGTAAGTAAGGGCCCGGGCATGGTC
ACTCACACTCGTGAATTAGCACTGTGGGAGGCCAAGGCAGGAGGATCGCTTGAGGGCAGGAGTTTGAGAT
CAGCCTGGGAAAAGACATCTCTTAAAAAAATTAAAAAATTAGTCAGGCATGGTGGTGCACACATGTAGTT
CCAGCTACTCAGGAGGCTGAGGTGGGAAGATCACTTAAATCCAGGAGGTCAAGGCTACAGTGAGCTATGA
TACAATTGCTCCAGTGCACTCCAACCTGGAGACAGGGCAAAGATCCTGTCCCTAAAAAAAATAAATAAAT
AAAGAATACATATATATATATAGGTAAAAATGAATTTATTTGATTTTTTAAAAAAGATATTATGTAAGTA
GTGGTATAGGCAGATATGGTAAAAACCCTACTAAAGGCAAGAGCATGACTGAAATTGAGGAAACTCTGAC
CTTAGTTTCTACTTGGAGCAGTGAGACTCAGAGCAAATACTCCATTCTTCTTGTAAAGGTGTTCCCAGGC
TTCAGACAGGAACCCATTACACAACAGCCTTCCCGGGGCGTTTTTACCCAGCAGAAAGACTTCTAACCCT
CTCAGACCCAATGCCTCCTTTTTATAGCACATTTTATAATCTTTACTACCTTGATAGATCCTTTACCCTC
TTGAAAGGAAATCTACAGCCTACTTATTCTCATAAGTTAAAAAAAAATCATAATAAGGCCCTAGCTTTTA
ATACACAAGAAATACAAGAAAAGCAACTTATGACAAATAATGTTTTCAATAAGTAAATACTTGGGCATAA
TCACCCTTGAAGGCCTACGGATATGGTCTATATTGCACCCACATGCAGAATCCCTGTGAATGTGACAGTC
CAGTGCAGATCGATACAGGTGTATTATGTTGGAAATGCAGTCAACTATCATAAGCAGTCTTGCCACTGGT
AATTTCCTAAGAAGGCGAACAACTTCTGGGAAAGTCATGTCCACCACTCCCTCCTCTCACCCACAACCCC
CCAAAAACAACATTCTTTCCTTAGTTTGCATAGTAGTTACATTTCTGAAAAGGGAATACTTGTATTAAAA
CTGTACAAGAGAACAACCACTATGGAAAACAGTGTGGAGATTCCTTAAAGAACTAAAAGTAGAATGACCA
TTTGATCCAGCAATCCCACTCCTGGGTATCTACCCAGAGGAAAAGAAGTTATTATATGAAAAGATACTT
GCACGTGTATGTTTATAGTAGCACCATTTGCAACTGCAAAAATGTGGAACCAACCCAAATGCCCATCAAT
TGATGAATGGATAAAGAAACTGTGGTATATATAAATGATGGAATACCACTCAGCCATAAAAAGGAATGAA
TTAATGGCATTTGCAGCAAACTGGATGGGATTGGAGGCAATTATTCTAAGTGAAGTTACTCAGGAATGGA
AAACCAAACATCGTATGTTCTCACTCATAAGTGAGAGCTAAGCTATGAGGATGCAAAGGCGTAAGAATGC
CACAGTGGACTCTGGGGACTCGGGGAAAGGATGGGAAGAGGTTGAGGGATAAAGATTACAAATTGAGTT
CAATGTATACTGCTCAGGAGATGGGTGCCAAAATCTCCCAAATCGCCACTAAAGAAATTACTCATGTAAC
CAAATACCACCTGTTCCCCAATAACCTATGGAAATAAAAATTTTTTTAAAAATTATACAAAAGAATACTT
TGTGATCTCCATGAATATATACATACCTACTATGTACCCACAAAAATTAATGATTTTAAAGAAAACAAAA
CTTTGAGCTTACCTATCAGAGAAATGGGGTTAGGTTCTAGGTTCAGATCATTATAAACAGGCTTTTCACC
CATATGAATACCTGACCAGCCATTGAAAAATTGAAGGTGATACAGGACAATCCTCTGTTGTGTAGAAGAG
CCCCATATACTTTGCGACATCCCACATCCCTGGCTCCCTTCCATTAAATTCTGTTCTGGCCATTTCTATC
ATTTGACAGCCAAGAATGCCCCCCAACATTTCCCCAATGCCTCCTAGGAGGGTAATGCCTCCCACATTGA
ACTCATAAATCCCAATAGCACTCAAGGATTTATTTTTATTTTAAGCTATCCATTACTATCTGACATGTAG
TCATTAAGTCCCTTTGGGCTTTTTATTTATCAGTGATAGCTTTTGGTTCCAAAGTGTCTTAAACGTAAGA
GATGATGGCTTCTAAGGCTATTATCAGTAATATTCTACTATTATTACAGAAGTGTTATTGTTTATGGCTT
GTTATTAACCACAAAGTTTCTCTTTTGGCTTAAAGTTGGTAAAAATAAATATTGTTAAAATAAATTTCAG
AAAGTTTGGTTGCTCTTAAGAAAAACACTCAAGAGTTAGGGGCTCCTGAAAAGTCTGAAATTCGATATAA
TTAGAAATCTGGTTACTGAAAACCAGATACTTTAAAAATTAAGCCTCTCAGGGCTGCAAATTTTAACAGC
ACAGTTTTAAAAGCAGATTCTTGGCATAATGTTGAGGGGGTTTTGACCAAGTCATGCTGAGAAATTTGCA
ACTGCAGCATTCACTGGGGTGAACGCAAAAGAGAAAAAAACACATTAATGAAAACTTTCCAGGATGAAAG
ACCTTAAACTTAGCTTAACTTCTGAACTTTTTGCTCTGCTGTGATCTTTCTGACACTTTGAAGAATGATT
CTGGATGGGCTCCAAATAGCACACTCCTCACTCCTCATTCTTAAACAGTGTGAAATCTGTCAACCCAATC
AGGTCATCAAGAGGGCAGACTGCCACTTGTCATTACTGAGAGGGGTGTTCTCTAGGACACTGAAATGTC
GGGCAGGTCTTGCTTTTTACCAAGAGCTAGGGCCTGGCATTTTGAGAAAGACACTTATTTCCACTCATTG
GGAAAGCTAGCTTAGCACCCGTGTGCAAATCAAGTATGCCCTATTCAATTTACCAGAGTGATGCTTTGAC
ATCATTCCCCTTAACAGAAAGCTGACAATCAACAATAGCCCACAGGGCTTTATTTGCAAAGATGGAAAGC
TCAAAACAGTTGCCTCAGCTCAAGATGGAATCTAATTTTTTAAATTAATTCTAATGCATGAGACAAAGAA
ACAATATCAGTTAATGAGAAGCATGGGAACTGTTTGAATGCCTGTTCTTCACTTGTTACACGTGTTTTA
CTGAGTGTCTTAATCTTTTGGTACTCTCTTTCTCTGCTTATAAACCTGGAATAATGATAGGTATTATTAG
CTCTGGTTATTTTGTTGTGAGAACTGGGACCCCCCACCCCTGGGCAAAATTACCAAGTGGATTAAGTTT
TCCTTTGACTTTTACCCCTTCCTTACTCACACCATTGAGCTAAGCACTAGGGATTATAGGTAAATAAGGC
ATAGGCCCTGCCCTCAAGGAACTAACAGTTTAGTGGGTGAGAAAGACAAGTAAATATGATAACGCATATA
TGGCTGAAGAACTGCTTTGCTGAATATAATTAGGGTGGGGTTGCTTTGGAGCCCAGCACAAAACACTAGC
CACCATGGGGAAAAGACTAGGAAGACTTTCCACCCAATCACCTTCTTTCTCCTCTCTCTGTCCCTTTGTC
CCACCTTTCTGCTCCCCCCAAAGCCACCACCCCATGACTTCCCTTCTGAGATAGAACCCCAAGCTTTAGA
```

FIGURE 130 cont'd

```
CTGTTCCTTCTGCCCCCTTCCATCAGAACTTATCCATCCAGCATTGCCTACCTAATTGCAAACTAATTCA
AGCTAAGGCATTCATTGATTCATTAACTCTTTCTGAGTGATATTTGCATTCTGACTGGAGCTGTCCTTAC
ACACTCTACCAATCTGTATTGGGCATATACCATGTAGATTCATTTCAATCTTTTACCTAAAAGACTGATA
AGTGGAAGAACCAATCCTTGAACCTCATTCTAGGCCAAGTATCCTTTTCTCAGAAATAGTTTCTTATTCC
ATTTCATCACAGTCTGCAGGCTCTGCCTAGCTTGTCAGCACCTGTAGCAGAGACTCCGTGTACAGCAATA
GGATGGTGCTAAGTCTCATCTATGTGGAGATGAGACATATACCAGAGAGAATGGAGAATACTGTCATGGC
ACCATAGCTGCTCCTGGAGGTCCCAACCCCATGAGGGCACTGCTTAGTTATCCAGCCACACTACTTGCCC
ACTAGAAGGGCAGCTGGAAGTCCCAGGAGAGGGCAGAGATTTCCTCCAACCACACCCCTCCCCACTCCCC
ACCCGAAGGCCACTGTTTTTGGCTCTTGCTGCTATGGAAGGACAGGAGTGAGCTCCCGCTCTTGACAGGA
AACTCTCCAGGAGCAGAAGCTGTAACTTCCTCATCTTTGCATCATCAGCACCCAGCCCAGTGTCTGAGCC
AAAGTAAACCCTCAGTTAATGTTTGGAGAAGGGGAAGGAAAGGAAGGGAAGGGTGAGCTGTTGAGACAAT
CGAGGATAGTTCTTCTCTTTGGCCATTCTAAAAGTACTCAGCTAAATTTATTCTAAAATGCTAGGTCTCC
ACCTTCTGCTTCTCTCTGTCCCTCCTTCAGACACAGCAATTAAACTCTTCATTCTGAGCAATCCAGTGT
TAACCTAGGATGAGAGAAGGCAAGAGAAACCTCAGTGCCAACAGTGCACATCCTTTTTTGTGCATTTCTA
TGCCCCCTCACTTTCATCCCCTGCCAGTTGCATCTCCACAGGTCCCACCTGAGTGGGTTTCTCTGTGGCT
TTAGCACGGTATGTGTATATTCATATTTTTTCCAATATAGGTGTATGTAAGCTTGTTCTCAGAGCTCTAT
AGTTTCCATAGTCGTAAGAATAAAAACATTTTTCTGACCGACCACTCCATCCCTGCCATGATGCTTTACC
TCATCTGGAAGGGTGTGCAGGACCCAGTCCATTACCAGAAAGGATACAGTCTCATAGAGCGCAACTCTCA
AGCCCATATGGGATTCAGAGGGTGGCGCCAAAAACTTCTTACATTTCCTCTCAGACTACCTTTCACTGGT
ACAGAAACCTCCTCCGATGGGTGCTTGAATGTCTCTTCTCTCTTGATCTCCCTTCCTCATTCCTTTTCTA
CTGCTCTGTCTCCTCACCTCTCTACCTGACCACACCCCTACATATATACCAGGTGCCATCTTGCCTCTA
TGCCATGTGGAAAGAAAGGCTTCTGACTCCATCAAGTGTGAGCGGCAAAGTAGAGCATCACTTTCTTGAG
AGCAGAGCACCCGCTAGACAAATGATCTTTCTTTTTCTTGCTCATATTTTTGCTTTATACAGTATTTTA
ATTTCTAGGCACTTTTATACTAAAACCTTCCTTACCTGCCACAGCTGAAGTGGAAACATAAGTAGTGAAG
GGGATAAAGAGCCAATCCCATCACCTTCCTCTGGGTAGTTGAGGACAGAAACACTCACTTAAATCTTCTT
GTATGAGTCCGTTTTCATGCTACTGATAAAGACATACCCGAGACTGGGTAATTTATAAAGAAAAGAGGT
TTAATGGACTCAGTTCTACATGGCTGGGGAGACCTCACAATCATGGTGGGAGATGAAAGGCATGTCTTAC
ATGGCAGTGGCAAAAGAGAAGTGAGAGCCAAGTGAAAGGGGTTCCCCCTTATCAGACCATCAGATCTCAT
GAGACTTATTTATTACCATGAGAACAGTATGGGGAAAACCACCCCATGATTCAATTATCTCCCACCGGGT
CCCTCCCACAACATGTGGGAATTATGGGAGCTACAATTCAAGATGAGATTTGGGTGAGGACACAGCCAAA
CCATATCCATTCTGTATATTCAGGTACCACAATGCCTTGCACAGAGCAGGTGTTCAATGGATATTTATTG
GTGGAGGCTTCCCAGTGTTCATCAGACTACAAAAAACAAATAGCCAATTCATTCCTCACCTGCTTCCAGT
TCATTTGACAACTACCAAAAAATATTATATATTATAGCCATTCCTAATTAAAACATTATGCAAAATTATC
AATGTAGGTAGAGATATTTAGAAAACACATAAAAGACATATGTGTTTTCTAGAGGGAAGGTAAGAAGAAA
ACAATGCCCATGGGCCATGTTAAGCAGCAAGGAAAGGTTTTGGATTATGCCCTGACACCATGACTCTATC
AACAGATGTCCCTTCAGGTAAAATTTCAGGAGACTATAAGGCTTGGCTCCAAAGGGTTAAACACAAGGCC
TGTATGCATCCCTGTGCATCCTGGCAGGTTTTTTTTTTTTTTTTTTTTTTTGAGCCGCCTGTTTGCCC
AAGTAACTCCCACTCTTTCCCTTCCCCACAAGCTGCTGCTCCACTCTATGTACACAACAAAAATATTTGT
CTTTTCCAAAGCTGGGGCACTAACCAATGTCTGTGAATTTCTTTGTATAATAACATAATAATCAAATCA
CATTAAGTCAGTGTCAAGTGAGACATGTGTTTTCAATTTTAAAACCCACAAGTGATTATTTATTCCTTAA
TACTTCATTTGTACATTTAGTGAGAGAAATAGGAAAGTCACACATACATAGAATCGCTTCCAACCTTTGC
TATGAAGTTATTTCTCTAGGTGTTTTCTAGTTATTTTACAAGTTGTCTTTCACTATTAGCATTACAGTAT
TTCTCACTCTCTTGTTCACTGATACCAAGTTTAATTTTCAGCCTTTACAACTTTATTGATTTTTAAACAC
TCGTATTTATGAATTACACGGTTAGAAAGAATGAATAAGAAATGTCCTCTTATTGGTTTTGTTTTACTAT
ACTTTTTATGTGGTAAATAACTCATAATATGAGATCTACCATCTTAGCAAATTTTAAGTATATAGTACA
GTCTTGTTAACTGTAAGTACAATGTTGTACAGCCGACCTCTACAATTTTTTCATCTTGCATGACTGAAAC
TCCATACCCCTTGAACAGTGATTTCCCATTTCCACTTCCCCCAGCCCCTAGCAACCACCATTCTACTTTC
TGCATCTATGAGTTTGGCTACTTTACTATACCTTTTTTTAAAGTACCAAAACTTTAAATCCTTTGGGTG
CTGATACATCATTTTGGATCCCTATACCCCAGAGAAAATAGGGTCCTCTGCTAGACTGCCTTATGTCTCC
ACTCTTTGCCCTTTCCTGTAAAGAGCAGGATATAATGAGCAGAGCATCATCTTCAAGGTCAGAAAGACCC
AGGTTCCATCCCTGCTCTGTTACTTATCCATTGCATGACTTTGGGTAAATTATTAAACCTTTCCAAACTC
ATTTCTTCATCTGTAAGATGTACCTATTTTAATATCAACTTCACAATACCTACTTTTATGAAAATCAATT
GGATCACAAATGTAAATTACCTAGTAGGTGCTCAATATTTTGATTCCATCACCCCAGCTGCAAACCCTAG
CCTCGTATGGATTGAATACATGGAATAGGAGACCCAGTGTGTTTGTTCTAGATGAAATACATGAGATATG
TCTTTGGGATCCATTCAGACATGCAGGTGGACACTGCAGTAGTCATCTAAAACAATTCTTTCTTCTCTCT
GAACTAGTTCAATGTGAAAATATATAGCTTTCATGCCCTGTTAATGTCTTAATGAAACCTGCTTCCTTA
AGAGTGTCCTGCACCAAGAATACAGACATGATTAGTCCTAAGGTGCCACTACAATCCATAGAGCGCCGTG
GGCACTAAGAGAGAAATCTCAATGCACAGGTAAATTTCTCAAGTTCTCTGAGGAACTAAGGATATTTACA
CTTAAAGAGTTATATTCCAACCACATATAAAAAACACATAATTAAATCACAGAATCCACTCCAGTGAAAT
ATAATTCAAGCAGCCTTTGTAACCTATAAAGAAAAAGGAATTAGCTTCCAGTGCTTTCCCTTTCTAAAGC
ATAAAGCATAAAGCAGCATGGCACATGTATACATATGTAACTAACCTGCACATTGTGCACATGTACCCTA
```

FIGURE 130 cont'd

```
AAACTTAAAGTATAATAATAATAATATTAATAATAATAAAACAAGAAGGGGCTGCCAAAAAAAAAAGCA
TAAAGGTTTTCTTTCTGGAAGTTTTTAGAGATCAAAGTTTCTATCTAGGCCTCTACCAATGAGTAAAGTT
AGTACTAATCTACCATCATTCTAAAGATGCACTTATAATCATTTAGGAAAATCCAACAAATTCAGAAAAG
AAATAGAGGTTCAAGTTCTTCTACACAGGGGATCATCCCTGTTATCTGATGTGTTAGATGAGTGAATCTT
GCTTGTTCTGGACAATTACTTCAATTCAACAATTACATGGTAGCACCTATCATGAGCCAGATAATGTACT
ACAATAGACAGAAGAACAGCTTACACTTCAATAAATAGTCATCTCATTCCTTCATTCCTTCTTTCAGTAA
ACACCTTTTCGGTAAGCTAGGCACCATAATAATAATAGGTAAGACATGGTCCTAGCCTAACAGGGTTTAC
AGCAGCGTGCAGCATCTGCCACATAGCAAGTGAGCTAAGTTACTGCAATACTAGGAGGAGAGCTGAATGC
CTCTGACCAGGAGCCCAGGAGGAAATACTTGAGGTGGGCTGCCGAAGGACAGATGGCATTTCAACAGGTG
GGGAGAATATTCAATTGAGAAGGAATGTGGGAATCCAGATAGAAACAGAAAACTCTGGGGGATGTGGCAT
AAAAACAGCAAAAGCAGAGATCTGTTTATCTGCAGGGTACTTTTGGGAGATAAAAATGGAAAAGTAAGTT
GGCCTCATATTGTGGAGGGCCACGAATGTCAGAATAAATAATATAAATTAAGGAGACATTGTGGGGCCA
TTGAAGGACTTGGAGCAGGGGGCTGACATGGTAGGAGTTGTGCCTGAGGAACGAATCCGTTGGTGGTAGG
TGAGATAGATTGAAAGGGATGACTAAAGGCCCTCAGAGGGGTTAATCCAATATCCTGGGACAGGGAGTAA
ACTAGCAGAGACACTGAAAGGAGAGAAGCAGTTGTAGTACGTTATGGCACACATCTGGAACTTTTGCAGT
CAAATTTGACAGTCCAAACATATCTCCCAGATAAAAGACCACACTTGCTTTAAATGTATGCTGAGAACTA
CAGAGTTAATGCAGCAGTTTTTAACCTCTGGAGACTTAGAATCAACTCAAAGTTTGGTCACTTCAATTTG
CTCACCACAAACCGTTGCCCTCAAAACTCTGGATTTGCTGTAACATTTCAAACTCTGAGAAGCGGAGGGT
TCAATAAAACCACATTGCGCCTGGCATGTATTTCTTCTTTAGGACTGAGGAAACTTGATCTGCTTCTTAC
TAATTCATTTAAATTTCATTCAAACTGGGATTTTGAAAAACGTTTCGATTGCCCAGAGAAGCTTAAGAGC
TTACTTTTAAAGCCTTTTTTCCCCTCCTTACAAAAAGGAAACAATAGTTTTCCAACCAACCCTGAACCCC
GGATGTCAGAGATTCAACCCATTCGTTGGGATGGAGTTTATGGTAGGCAAAAAAAAAAAAAAAAAAAAA
ATTGACTAAAACCAGCAGATTTTGCCAAAAATCCGTGTGTTGCATGGTTAAGGAGACAAGCATTTGCTCC
TCTTGAACACCTACAAGCGATGCAGCAGGGGTGCAGACAGTCAGCTAGGAAGGAGCTCATTCTATTCCAT
GACTCAAATCAGCCATGTTGGTTTTCCCTTCACTGTCAAGAACATAAAGGAAAAATGGCAATTGAAAAAA
AAAATAAGCATGTTAAAAAGGAGAGTGAGAGAAACAATTTCACTCTGCCTTAAAGAAGACTTTCCTATTC
CTCCCCCTGCTCCTCCCACTTGGTGGCAATGTTGAAACAAAGCTCTTCTTCTAGTGACAGCCATCAAGAA
GTCGTGAGTATTTTTTGTACACAGAAGAGCTAATGACATAAGGCTTTAATACATTCTATTCAAGACCTGA
GTTTGGAGAACTTAAAATAACTTTTGAGTTCCTTTAAGCTCAAACAGATTTTCCAACTTCAAATTAAATT
TTAAGATGATGGTTTGCTTTATTTTGGTTTAGGTTTTTTCTCCCTTTCTTACTTTTTTCCTCTTTTTGGT
GGTTTTATTATTGTTGTAGATGTTTTGTTGTATGTGTTTTTGTTTTCTAATAGTTACAACTCATCTTCTT
TTCTATTAAAACTAAGCCTAGCAAATGCCCTAAATGTTAAGAAATTTGTTTTTATCTTAAATTGCTCAG
AATTTCAAAGTCATTTATAATGACTTTGTCTTAAAAATATGTCCACCCATGTGAGGAAATCTCCACACTT
GATGATGTTAAGGGCCAAATAATATATTTGGTTGTCATCAGTTTCTACCCATCATTTTCTGACCACTGAG
AATAGACACAGTAAGAAATAAACAAATATGGCCTCTTATGACCACTGGTGATTTCTGAAAGACTGGGGGA
GTCATAGTATTTTATTTTAAAAGGTTTTCTGGCAGCTATTTTATGAATAAATGAAACTTTAATGTCTAGA
GATGCTAAACTGTGAAAGGGATGATTTGAATACTGAAGTCATTACAACCAAGTCTAAGTTATTAAATTTG
CTAAAAGCACGTGAAAGTGAATCGAAGTGTTTAATACATTGAAGGGAGCACTGGTCTCATCCAGAGAATG
ACATCCTTAGCACCTCGTCAAAGTCCGTACTGTAAGTTCTGGAAATGACTCAATATTGTTTTCTACACAC
AACCTCTTTAAATTTTTTTAATTTCTTAAAGTAGTCTATATAAAAATTATTTTTACAGGGCAACTGCATC
TTAGGCTAGGTTACTTCAATCTTAAAATCCTCATGTATGCTTTCAAGAAAACTGTCATCCTAGACAACAC
TAACCTTTTAATTTTACAGGGATCCTGAACCCTGAACTAGTAGAATGTGTGAAAGAGTGAAAGAGCTGTG
CTGTAAATCTGCTACTTCTGCTTCAGGACACTGTCAAACTAATTAACAGTTTCTCCTGTTTTTTAAAGCT
GCATATTGAAAACTAGAATTTCACCCTGCTTTCTCCAGAGTTCCGCATTCTTGAACTTAGATGAGAGCAC
ACACATCAGGAAAGTAATTTAATTCCATCAACATGTATTTCACACCTACAACCTGCAGGACTTTGTGGAA
ATTCAAAGAAAATTTAACAGAAATCTGGTCTCCAAAACCTTACAGCATAATAAGAAAGTCAGATATGTGA
ATAAGAGTGAACTTTGCAACCACACGAGGCACAACTGAGTGTTACAGCAAAAGTCAAAACAAGCAAAGGA
CAAAGAGGGTGACTAGGGTCAATAATAATTGTACATTGAAAAAATAACTAAAAGAGTATAACTGGATTCT
TTGTAACAGAAAGGATGAATGGTTGAAGGTATGGATACCCCATTTTCCATGATGTCATATTACACATTGC
ATGCCCGTTATCAAAACACCTCATGTACCCCATAAATATGTATATACCTACTATGTACCCACAAAAATTA
AAAATAAAACAATTATAAGAAGTGAAATAAATAAATAATGAAAAAAAAAAAAGCAAAGGACAGTGGC
AGTGGCAAGAGGGCCTGGACCCTGGAACTCCATTTTGAGGTTGACTCAGAAAATGATTACAATGTGTATG
TATAAGTTTTAGCATCTCCACTTAACAAATTGGCTTATTGTTCAAAAGAGCATTTAACAGTGATATTTC
TGTAAATGAAGAGAATTTATTCCAATTTAATCAACAAATTTTTTACTGTTTCCATTACATGTAAGATTAT
TATACACTAGATACCAGGGGTCAGAAAGGCTGATTAAATGGTTTCTGACTTTGGGGTGTAATAGTTGTTC
ACCAATAACTGTAGTACAAGACATATGAAAAATCCTGTAACAGTTGGGTGTAGTGGTACATATGTATAAT
CCCAGCTACCCTGGAGGCTGAGGCAGGAGGACTGTTTTAGGGCAGGAGTTTGAGGTTGTAGTACACTAT
GATTGCACACCTGTGAACAGCCACCACCACTCCAGCCTGGGCAGCATAGCAAGACTGTCACTTAAAAAAA
AATTCCTATAAAAGGAAGATAAACAAAGCCTATGAATAGCCACTAACCAAGCAAGAAATTTTATTAGAAT
TACTAGCTCAATAATTATCAAAGTAGGGCTTAATAACACATTATTAAGAGGTTCAGTTGGACTGATGCTC
GAAAGTGCTAATATTAGGTTTATGTAGTTGGATCTCCACGGGTGCTTAACAGTCAGCTCTGCTCACTTAA
```

FIGURE 130 cont'd

```
ACACAAAGGCTTTCTTTGTTCTCAGTATCACCCTAGCTACTTCTGCACCAGTTAGTCACTACTCGACTTC
TGGAAACAGTTGACATAGACCTATTTCAGGGAACCAGATATACAGTTGACAGAAACAGCCTTATAATATG
GATATATTTACAGCTTTCTTAAATCTCAGATATTTATTCTAGATTTAAGGTTTCTCCTGGTACCAAATT
AATCAGCCCCTATACAGAGACTATTCCATAAAGAAGGTACTCAAAAATGAAAATAATTTTTATTAACATA
TTTTTGCATTTAAGCCAACCCCAACTTGTAAAATTTAACAATTACTGTACCAGCAGTGCCAATACAAACT
TTGTATTCCTAAAATTAGCACCAAAGTAGTGCAAAAATGTGTTAATATGTAGATATCTGTGATATTTACA
AAAGAAAAGTGAAAAGAAAATGAATTTCACAGTTCGGTCAATGCTCACATGGATTAGGCAATGAAACAT
TCTGGAACACCTTTTTATAACTATTCCAAATGAGAATTTGGAAACCATAAAACAATAAAATCCAAACAAA
GGTGCATTAGGATAACTGTAAATGCCTTTAAGTAATGATTTGTAAAATTGTATAAGGGTCTTAAATAAAC
CTAGCATTTTATTACCAGGCACACTGTTAACATTCCCCAGATTTTTACAAGAGGAATTTAGCGAGCTATC
TGTAAGATTTAGCTTAGCTAATCATTTACGTTTCTACCCAGAAATACATATCAATACATTATCAAAGTAA
ATATGGTAGCTATGCACTGGGAGTCCTTTTGGAAACAAATATATCAGATCTTTATCAATAATTGATTAAC
ACATTTAAATACTTCAAAAACCAGGACCTTGTACTATTATACAGAGGGTGCTTTATTCAGATTGTTATAT
GAATTTTTTTCCTCCCATCTTCAGCTTCTTATATCTTCGTTTTTCTTTATCTCACAAAACACAAATTGCT
CCCTAAATAACACTCGATAAGTTATTAATGTTAGTTTAAATAAACTTATTTTTTCTTGGATTGTTGCACG
TTCTTCCCCTTTAGAAAGCTACCTTGAGGATTTTTTTTCTGGTTAGCTTTATGTATGTCCTCAAATAAGA
AAGTTAAGTGCTATTGTTTTCGCAAATGGCTATGTAGCATTGGTTCTGAATCATTTGCTTGTTAATTAAA
GGATAACCCAGATAGAAGTTAAACGGAGTAGTCATGGCCTGCCTTGCTATTTTAGAAAATATTGGCCACC
AGTTAACACTGCAACTTGTCAGATATCTACTTGCCCATCTGAGAGGGCAGGTTTGAAAGTACACAAATAA
AGAATACACATCATGATGACCAATTCATTCAAAAACTTTGAACATTTTTAGGGGGAAAGACATTATATGC
TACATGTTTTAACCTACAAGGCATCATAGAAAATTAACTATGAAAAGATTTGTTGGCTAGCTTTATTTAA
TTACTGGATTTTTTTGTTGTTTTTATTATACTTTAAGTTTTAGGGTACATGTGCACGATGTGCAGGTTT
GTTACATATGTATACATGTGCCATGTTGGTGTGCTGCACCCATTAACTCATCATTTAACATTAGGCATAT
CTCCTAATGCTATCCCTCCCCCTTCCCCGACGCCACAACAGGCCCCAGTGTGTGATGTTCGCCCTCCTG
TGTCCATGTGTTCTCATTGTTCAATTCCCACCTATGAGTGAGAACATGCAGTGTTTGGTCTTTTGTCCTT
GCAATAGTTTGCTGAGAATGATGGTTTCCAGCTTCATCCATGTCCCTACAAAGGACATGAACTCATCACT
TTTTATGGCTGCATAGTATTCCGTGGTGTATATGTGCCACATTTTCTTAATCCAGTCTATCATTGTTGGA
CATTTGGGTTGGTTCCAAGTCTTTGCTATTGTGAATAGTGCCTCAGTAAACATACGTGTGCATGTGTCTT
TAGAGCAGCATGATTTATAATCCTTTGGGTATATACCCGGTAATGGGATGGCTGGGTCAAATGGTATTTC
TAGTTCTAGATCCTTGAGGAATCGCCACACTGACTTCCACAATGGTTGAACTAGTTTACAGTCCCACCAA
CAGTGTAAAAGTGTTCCTATTTCTCCACATCCTCTCCAGTACCTGTTGTTTCCTGACTTTTTAACTATCG
CCATTCTAACTGGTGTGAGATGGTATCTCATTGTGGTTTTGATTTGCATTTCTCTGATGGCCAGTGATGA
CGAGCATTTTTTCACGTGTCTTTTGGCTGCATAAATGTCTTCTTTTGAGAAGTGTCTGTTCATATCCTTC
GCCCACTTGTTGATGGGGTTGTTTGTTTTTTCTTGTAAATTTGTTGGAGTTCATTGTAGATTCTGGATA
TTAGCCCTTTGTCAGATGAGTAGATTGCAAAAATTTTCTCCCATTCTGTAGGTTGCCTGTTCACTCTGAT
GGTAGTTTCTTTTGTTGTGCAGAAGCTCTTTAGTTTAATTAGATCCCATTGGTCAATTTTGGCTTTTGTT
GCCATTGCTTTTGGTGTTTTAGACATGAAGTTCTTGCCCATGCCTATGTCCTGAATGGTAATGCCTAGGT
TTTCTTCTAGGGTTTTTATGGTTTTAGGTCTAACATTTAAGTCTTTAATCCATCTTGAATTGATTTTTGT
ATAAGGTGTAAGGAAGGGATCCAGTTTCAGCTTTCTACATATGGCTAGCCAGTTTTCCCAGTAGCATTTA
TTAAATAGGGAATCGTTTCCCCATTTCTTGTTTTTGTCAGGTTTGTCAAAGACCAGAGAGTTGTAGATAC
GCAGCATTATTTCTGAGGGCTCTGTTCTGTTCCATTGGTCTGTATCTCTGTTTTGGTACCAGTACCATGC
TGTTTTGGTTACTGTAGCCTTGCAGTATAGTTTGAAGTCAGGTAGCATGATGCCTCCAGCTTTGTTCTTT
TGGCTTAGGATTGACTTGGTAATGCAGGCTCTTTTTTGGTTCCATATGAACTTTAAAGTAGTTTTTTCCA
ATTCTATGAAGAAAGTCATTGGTAGCTTGATGGCAATGGCATTGAATCTATAAATTACCTTGGCAGTATG
GCCATTTTCACGATATTGATTCCTCCTACCCTTGAGCATGGAATGTTCTTCCATTGTTTGTATCCTCTTT
TATTTCATTGAGCAGTGGTTTGTAGTTCTCCTTGAAGAGGTCCTTCACATCCCTTGTAAGTTGGATTCCT
AGGTATTTTGTTCTCTTTGAAGCAATTGTGAATGGGAGTTCACTCATGATTTGGCTGTTTGTCTGTTATT
GGTGTATAAGAATGCTTGTGATTTTTGCTCATTGATTTTGTATCCTGAGACTTTGCTGAAGTTGCCTATC
AGCTTAAGGAGACTTTGGGCTGAGACAATGGGGTTTTCTAGATATACAATCATGTCGTCTGCAAACAGGG
ACAATTTGACTTCCTCTTTTCCTGATTGAATACCCTTTATTTCCTTCTCCTGCCTGATTGTCCTGGCCAG
AACTTCCAACACTATGTTGAATAGGAGTGGTGAGAGAGGGCATCCCTGTATTGTGCCAGTTTTCAAGGG
AATGCTTCCAGTTTTTGCCCATTCAGTATGATATTAGCTGTGGGTTTGTCATAGATAGCTCTTATTATTT
TGAGATACGTCCCATCAGTACCTAATTTATTGAGAGTTTTTAGCATGAAGGGTTGTTGAATTTGTCAAA
GGCCTTTTCTGCGTCTATTGAGATAATCATGTAGTTTTTGTCTTTGGTTCTGTTTATATGCTGGATTACC
TTTATTGATTTGCGTATGTTGAACCAGCCTTGCATCCCAGGGATGAAGCCCACTTGATCATGGTGGATAA
GCTTTTTGATGTGCTGCTGGATTGGGTTTGCCAGTATTTTATTGAGGATACTTGCATTGATGTTCATCAG
GAATATTGGTCTAAAATTCTCCTTTTTGTTGTGTCTCTGCCAGGCTTTGGTATCAGGATGATGCTGGCC
TCATAAAATGAGTTAGGGAGGATTCCCTCTTTTTCTATTGATTGGAATAGTTTCAGAAGGAATGGTACCA
GCTCCTCCTTGTACCTGTGGTAGAATTTGGCTGTGAATCCATCTGGTCCTGGACTTTTTTGGTTTGTAA
GCTATTAATTATTGCCTCAATTTCAGATCCTGTTATTGGTCTATTCAGAGATTCAACTTCTTCCTGGTTT
AGTCTTGAGAGGGTGTATGTGTCGAGGAATTTATCCATTTCTTCTAGATTTTCTAGTTTATTTGCGTACA
```

FIGURE 130 cont'd

```
GGTGTTTAGTATTCTCTGATGGTAGTTTGTATTTCTGTGGGATCGGTGCTGATATCCCCTTTATCATTTT
TTGATTGCGTCTATTTGATTCTTCTCTCTTATTCGTCTTGCGAGCAGTCTATCAATTTTGTTGATCTTTT
CAAAAAACCAGCTTCTGGATTCATTGATTTTTTGAAGGGTTTTTTGTATCTGTTTCCTTCAGTTCTGCTC
TGATCTTAGTTATTTCTTGCCTTCTGCTAGCTTTTGCGTGTGTTTGCTCTTGCTTCTCTAGTTCTTTTAA
TTGTGATGTTAGGGTATCAGTTTTAGATCTTTCCTGCTTTCTCTTGTGGGCATTTAGTGCTATAAATTTC
CCTCTACACACTGCTTTGACTGTGTCCCAGAGATTCTGGTATGTTGTGTCTTTGTTCTCACTGGTTTCAA
AGAACATCTTTATTTCTGCCTTCATTTCGTTATGTACCCAGTAGTCATTCAGGAGCAGGTTGTTCAGTTT
CCATGTAGTTGAGCAGTTTGGAGTGAGTTTCTTAATCCTGAGTTCTAGTTTGATTGCACTGTGGTCTGAG
AGACAGTTTGTTATAATTTCTGTTCTTTTACATTTGCTGAGGAGTGCTTTACTTCCAAGTATGTGGTGAA
TTTTGGAATAGGTGTGGTGTGGTGCTGAGAAGAATGTATATTCTGTTGATTTGGGGTGGAGAGTTCTGTA
GATGTCTATTAGGTCCTCTTGGTGCAGAGCTGAGTTCAGTTCCTGGATATCCTTGTTAACTTTCTGTCTC
GCTGATCTAATGTTGACAGTGGGGTGTTAAAGTCTCCCATTATTATTGTGTGGGAGCCTAAGTCTCTTTG
TAGGTCACTAAGGACTTGCTTTATGAATCTGGGTGCTCCTGTATTGGGTGCATATATATTTAGGATAGTT
AGCTCTTCTTGTTGAATTGATCCCTTTACCATTATGTAATGGCTTTCTTTGTCTCTTTTGATCTTTGCTG
GTTTAAAGTCTTTTTTATCAGAGACTAGGATTGCAACCCCTGCCTTTTTTGTTTTCCATTTTCTTGGTA
GATCTTCCTCCATCCCTTTATTTTGAGCCTATGTGTGTCTCTGCACATGAATGGGTTTCCTGAATACAGC
ACACTGATAGGTCTTGACTCTTTATCCAATTTGCCAGTCTGTGTCTTTTAATTGGAGCATTTAGCCTATT
TACATTTAAGGTTAATATTGTTATGTGTGAATTTGATCCTGTCATTATGATGTTAGCTGGTTATTTTGCC
CGTTAGTTGATGCAGTTTCTTCCTACCCTCAATGATCTTTACAATTTGGCATGTTTTGCAGTGGCTGGT
ACTGGTTGTTCCTTTCCATGTTTAGTGCTTCCTTCAGGAGCTCTTTTAGGGCAGGCCTGGTGGTGACAAA
ATCTCTCAGCATTTGCTTGTCTGTAAAGTATTTAATTACTGGGGTTTTTTAAACACCATCTGAGTTTATG
TTTCAAAGACTGGCCCAATATGGTAGCTCACACTTATAATCCCAGTATTTATGGTAGGCCTAGGCAGGAG
GATCACTTAAGCCCAGGATCATCAGCCCTGGCAACACAGTGATACCCCCATGTCTATTATATTTTTTTA
TTTAAAAAAAAATGCAAGACAGGCTAGAGTCAGGGGAATGAGGCACTAGCCTTACTTAAAATTTAGGGG
AATACCAAATAACTTGGTGATCACAGTGTATCATATCTTAATGTAATATTTTAAAAATCAAAATTAAAA
CCAAAAAAAGTCATGAGAAACAATATATCAAAAATTTAAATAAAGATCCAAAGAGGTCTGCATTCTGTCA
TGTTGCTGAACTAATGTTACTATTATTCATTTGACTCTAGGTGAAGAAAATAGGTAAGGAATCATGCTG
TTTTCTTCTTTGTTGTAAAGATAAAAACAGATCTAAACTTAATATCTCCAGCTCATGGCATCATTAGTTT
AGTAATATTTTAGTCAAAGTTAGTGAATAGTAACCATTATTTCCTATCATCTACACTTAGGATATGTCAC
TTAATTTCAATGTCATTATCTTAACTATGAATCTTCCTAAAGTACTACACTACTTGGAAAACTAAAGGGA
AGTTTAAGAAGTAATCCATCATTTCAATTTGCTACATTTGTGGCATATTTCCATCATTCAGGGCTATTT
ACTTGCTTCTGAGTTTATTATATAAATATAGGTATACTCTCAGCTACATAAGACATTTTCTTTTAGTATT
TTGAGATGGGGGAATTTTAAAGAATATGAAAAAAGGAAAAGATCATCTATATTTCTTTTAGATTTTCC
TTATACGTAACATAGGAATAATTTATTTATTGAATAATTGATTTCATTCTATATAGAGCTATCACTACAT
TTCTTTACTTTCCTATGTAGCAAAACTCCTTAAAAGAGTGGTCTACACTTGATATTGTTTCAAACTTCTT
CTTCACATTTTTTCTCTTCTTAAATTTTTTATCATAAAATAACTTCAATTTATCAAAAATCTGCAAGAAT
ACTCATATACTCTTTCTCTATATGCACCATTTGTTATATTTTGCAATCTTTGCCTTACTGCACACATTTT
TGCTTAACACTTTATTGTACATATGCTACTTTATCACTAAATATTTCAGCATGTATTTTCTAAGAATGAA
GGCATTCTTTTGTAACCACACTTCAATTATCAGACATTCAAATAATGTGTTTGGGGTATTTCTGGACAAT
CACTGTGATGTCAACATTCAAGTTTTGAAAGGCACATGTGAAATGAGTATTAAAATATTTATAAATACTG
TCTCATGCATAAATCCATATCCAAAATTGTGCTAATAATGTCATTTATGACATTTTTTCTGATACAGAAT
CCAGTTAAGGGTCATGCATTGCATTTAGTGCACTGTCTCTGGTATTCATTATTATGAAACAATACCTAAG
GCTGTCTTTGTCTTTCATGATATTGACATTTTTAAGAGAGCACAGGCTGATTGTTTTGTGAAGTGTCCT
TCAACAATTTTTTCTAATGTTTCCTCTTTATTAGAATCAGATGTGCATTTGGGGCAGGAACACAATATGT
GTGAGGTTGTATCCTCAGTGCATTACATTAGGAAGAGCATGATGTCAGTTTCTGGTGGCATTAACTAGGG
TTACTTAGGGAAGATGATGCCCCTCCACATTTTTCCACTAAAAACTACCCATTTTTTTCTTCTCCAATT
AATAAGTCTTCTGTGGGTAAATGCTTTGATATTGGGTAATTACCCCATTGCTTTTAAACTTTCATTTAA
TAATTTTAGTATCCATTAATGATTCTGGCCTGAATCAGTCATTACCATATCGGCTGCAAAATGGTAATTT
TCCAGCTCTATTATTTCTTCTACATTTATCAGTTGGCACATTCTACAAGGAAGAGATTTCACTTTTCCTT
ATTTATTTACTTATTTACCTTATCACCTGTATGAACTCATTGGTTCTTACTTCAGCCAATGGTTTACAAT
CCATTCTTTCGTTATTCATTTGAGACTCAAATTTCCCGTATTTTCTCAGAGAGATCCCTTGATGTTGTC
ACTTCTGTCATTTTTAAATGATTCCATCATTTTTTGAGCTCCCCCTTATTCTCTAGTATAACAAGGTGCT
ACAGTTCATCTGATACATTTTCCATCCCTGCCCTAGAATTGGCCATTTCACCAAGATAAATCTGGTTCCT
ATTAGCAAAAAGTCATATTTAAAAACCAGAATCTGGGTGCTAGAAGTGCTCGTTGCTACTTCTAGGCACT
TCTAGAGTGTTGCTGCTTCTAGGCACACAATACAATGTGCTCAAGTACTGTGAATAGTTCATGGCCAACT
CTCAGTCTTCATGGTACCTGACCCATTAGCAGCATTTAATTTTAATGATCGCATCTTCCTCCCAGCAATA
CAATCTTCATGAAGCTTCTAGGAAATGATGCTCTCTTGGCTTTCCTCTGTCCTTATGGAATACTTCCCAG
TCCTCTTTAATTTTCCCTACTTTTCTCTAAACCCATCTAAAGTCAAGGTAGAGTCTAGAACTCAGGACTT
TTTGATCCTTTTCTCATCTGTATCTATACTTACTCCCTAGGTAATGTCATCTGACAACTTTCAAGTTTTT
ATCTCAAGCCCAGTCTTCTCCCTCAAGCTCTGGATTTTATATCCATTTATTTCTACTTAGCACCTTCACC
TGAATCTCTGATAGATGTCTAAATACAACATGTGTAAAACTGAACCACTCCAGACCTGGTCCACCTATAG
```

FIGURE 130 cont'd

```
CCTGCCCTTGAATTATGCCTTTGCAAGCATAATGCAGCCTAAATAACAAACTGATTTTGGTCACTCACTG
CCATCAGGGAGCACCCATTGTTTCCTCTGCCTCTGCCATCTGTTGTGATTTTTGAGTTCCACAGAGGAAA
GGGGGAGATGGGAGAAGGTAGGACAGAAGCCCAAATTACTTTACATATGAGCCGTACATTTCCTACTAGA
CTGTTAAACTGACTCTACATTCAAAATTGGCAGCAGACGTCACTAATGTGGCCTTAGAGTGATTCATATA
ATTTCAGCTGAGATAAGAAATATCTTGACAGACATTCAAATAATGTGTTTGGGGTATTTCTGGACAATCA
CTGTGATGTCAACACTCAAGTTTTGAAAGGCACATGTGAAATGAGTATTAAAATATCTCTACTGGCAAGA
TTAGATTTTTATGGCAACCAGTAAGAGAGAATACACCATTAGAAAGTAAACACTCTCTGCTTCTTCTCAG
GGGCATCCAGGTCACTTTTTGTGCAAGATTATTGATTCCTTTGCCAATTATGTTCCTGGAATATTAGAAA
CCATTTCCTCATGTGTAAACTGGTGTATTTACAACCCTCCTAATTCAGGTGGAAAAATTCATCATACAAG
TAACAGTGTGGGATGAGAACTTGGCCTAAATGTTTGAGTCTCAATTCTGCTGTAGTAGAAAAAGAATAAC
TGCTCATTTCAAATGCAGGCAGAAGTGTGTGAATTTCACTTAGCATACCAGCATCATTAACAAGAAATG
AAATTCTTAATTCATATATTTCATGGCCTTCCAAATTACATTCTGAAACACCTTGACATTTTAGTAAAT
GTAATATATAAGAAATACTAGTTAGGCCGGGTGCAGTGGCTCTCTCCTATAATCCCAGCACTTTGGGAGG
CTCAAGACGAGCCTGGGCAACATGGCAAAAACTTGTCTCCACAAAAAATATAAATATTAGCTAGGCATGG
TGGCACATGCCTGTAGTAGCATCTACTCAGGAGGGTGAGGCGGGAGGATCGCTTGAGCCCAGGAGGCAGA
GGTTGAAGTGAGCCAAGATTGCACCACTGCACTCCAGACTGGATGACAGTGTGAGACCCAGTCTCAAAAA
ATAAATAAGTAAAATTAAAAAAAAAAACAAATATCAGGTATGTTCATGAAACATTTCAAATGTAGAGTTC
AATAGACCATATTTTTAAAAGTATAGAAAGCATCTTTTAAATTTCTCTTCTTTTAATGCATTTATTTTTA
CAGAGTGGAGAAAATTGGCTCTCTTTTAAATATATAAATTTCTTGACTTGATGACTTTCCACAGGTACAA
CATACTCAGGGGAGATTGGCACCAAGAAAAAGGTGAAAAGACTATTAAGCTTTCAAAGATACTTCCATGC
ATCAAGGCTGCTTCGTGGAATTATACCACAAGCCCCTCTGCACCTGCTGGATGAAGACTACCTTGGACAA
GCAAGGGTAAGCTGACTGCCCCATCTCCTCACAGCAGGCCAGTGGCCAAGAGCATGTGCCTCAGCTGATA
GCACTGGTGTTGGAGTCCTACTCTGCCTCTGAGGAGCTCTGTGACCCTGAGCTCATTATTCCATACATCT
GGACTTGTTCCTCTAATAGAAAATGAAATTAACAGAAACATCCCCCTTATGAGGTGCACGAAGTAAACCA
TGTTTATGTGCTGAATATACCCATGCCTAACACATACTAGCCATTTTCATTTTATAAAGGTACAAAACA
TATTTGCACGATACTAAGTAAAGCAAAATTTTGGACTGGCAGATTACTAATGAGGGAATAACTAATTTTT
TTAATTTATTAAATTAGCTCATCGTAACAGCTACACTAAAAATAACCCAATCACTATCAACTCTTAATTC
TACTTTAGGCTATTGATGCACTGCATTTTCCTTTTCATAATTTTTAATTCATTTGAATAAATTTTAATAA
CTCTACAATTACTTTAGTAATACATTGATCTGACTGAGGGTGGAAATTAATGTGTGACCATCTGAAAAAA
GTGTTCAGGTTATGTCTACCCCAAACTGCCAAAGGAATTTAAATTTCAGCAATAAATGCCCCAGTTTAAA
CAGAAGTCGAAGATAGATTTTACAGCTTGCATGCTAAGTGATATTATACTATTTATATACTATTATGAAA
TATATACCACTGGCAAAGCACAGTGCCTCATGCCTGTAAATCCCAGTACTTTGAGAGGCTGAGGCAGCAG
GATTGCTTAAGCTCAGGAGGTTGAGGCTGCAGTGAGGTATGATGATGCTACTGTACTCCAGCCTGGGGTA
CAGAGTGAGACCAGGTCTCAAAAAGAAAGAAGGAAAGAAAAGAAAAGAAAGAAGGAAAGGAAAGAAAGAA
GGAAGGAAAAAGGAAAGGAAAGGGAGAGGAGGGTGGAGGGAGGGAGGGAAGGAAGGAAGGCAG
GCAGGCAGGCAGGCAGGCAGGCAACTAATATATGCCGTTAGAAAATGAACAGCAAGTAATGTCAAAAGAG
CTAATTCCCAATATTAGGCCTCCAAAAGGATAAAAAAATCATTCCTAACAGCTTAAGGTCTGAGATTGGG
AAATTTTTGAATGTTTGCTTGTTTGTTGAGAGGAGAACAAGCCTTAACTTCCCCAGCCCTGGAATGTCAC
TGACAGAGCACTCTTGGCGGTGTCTCTCCTCTAAGCAGCCACCTCTCAAGAAAGGTGGTGTGAGATGTGG
AAAGGACAGAGGGCTGGAAGTCCAGCTATCACAGGCCAAGTCCTAGGGCTGTCTTTAATATTGTGTGAGT
TAGGTAAAAGTCTCACGCAATCTAAACCTCAAAAATAACCTAATATCCCTTCATTTTTCTGACGTGTTGT
GACGGTCTTTTTGTGTCACGCTGAGGCATTTGGATTTTATTGTAGGACATAGGGAAACCATTCATTTGCA
CTAGATGGTAGTATGCTAGGATTTTCAACTTTTTAATTGTTTAATCCACTATATCCCAAGTAAATGTTT
GAGTCTCCAGTGTGATTCATTTGCGTGCTGTTTTTGTTTGCCTTTTCAGCATATGCTCTCCAAAGTGGG
AATGTGGGATTTTGACATTTTCTTGTTTGATCGCTTGACAAATGGTAAGTTACCCAAAAGAATTCTCACT
AAAATATACACCATAAAGTGGGATTAATTTCATGAAAACAAAATTTATTTTTAAACACTGCTATTCCTT
TTTCCTTCTTTCCCCATTTTCATAAACCTACAGCTACTGAAGAAGGACCGGGTAAGGGAAATCAACTC
AGATGAAAATAAGGACTGAATTTGACCTTAGAATCTTAGGACAGTTTCCTTGTGACCTTGATCATCCCA
GAGGAATTTAGAAACCACAGATTAGATTCTTTCTTGCAGAATATTTTGGCCACATCCAGAAGTAAGGAG
TTCATTGTTAGTTGATGAAAACTAGAAACAAAAGCACATCTGATCAGCCCTGACTTTTACAGGGCAGGGT
GCTTATGCAGTTTTATTAAGTGAGCTAAATCTGCCCTGTTGCGGGTATTGCTCAAATGTGTTTGACATCA
TCAGAAGAAAACAATTGCCGAGGAAAGAATATAAAAGCTTAGGCTGCAGCCAAAGGGAAAGCAAACATC
TTCACTGGTGTCACTTCTTAAGTTTTTGTGCCTATAAAGACCTTCCTTAAGAAAATAATAAAAAACCTAT
TATATTTTTATCTGGCCATTAAACAAATGCTGATGAGCTTTGAGAGCCAATGAAAGACATCACATTTAAT
GCTGATGTTGATAGGTCTCTTTTAAGTCATTATATATGGTTTTCTCATCATTCTATTACTTGGCAAACAA
TATGCAGTTGAGAGAAATATAGCCTAAGACCACGAAATGGACCTTTACAGTGTGGAAAGAAAACTAGATC
ATGGAGAAGAATCCCATAATTTTGCATGTCATTTGTTCAAATCAACTGAGAAACGGGTACTGGTAAA
CTAAGTTACCTGTGAACAAAAGAACTTGTTCAATGGTATTTGTTTAAAAGAGAATATAATCATGACCCTC
ATAGACATATGAAATGACCACATGACAGAGATTTTCTTTAACTCAATTAATTAGAGATCCAGTAAGATGC
TACAACTAGTTCAAAGGAGAAGTCAAAGAGCCTCACAAGTATATGAAGTATATACCACACATATCTAAGA
AATGCTGAAATTGATTTATAAGTAGCCGCAAAATCGACAGGGGGAAATAAATTGTATTTCCACCTAACTG
```

FIGURE 130 cont'd

ATTTCATTTCCTGTATGTTTTCTTCCAGTAGTTTCATAGTTTCAGGTCTCATGTGTAAGTCTTAAATTCA
TTTAGTGTTGATTTTTGTATATGGTGAGAGATGAGGGTCTAATTTAATTCTTCTGCATGTGGATATCCCA
CTTTCCCAGCACCATTTATTGAAGAGACTATCCTTTCCCCAATGTGTTTTGGTGCCTTTGTCAAACATT
AGTTGGCTGCAGAAGCATGAATTTATTTCTGGGTTCTCTATTCTGTTCCATTGGCCTCATTGTCTGTGCT
TTTAAAATTCAAAATCATTATTCCTAAATAAACAGTATTTCTTGAATGCTTACAAGTCATTACAGCTTCA
ATTTTGCATCTCTGCTGACTTGAATTCTAAAATAGCTCATAGTCAGATCTCCTCTTGAGTGATTTTCCAT
AGGAAGAAGAATAGGCTGTGACTATCAAGCAATATGGTGGTTTAGATACACCTGTAAATGGAATAGTCAA
TTGGAAGTGACTTAAGGAACATTTCAAGTGGCCATAAGCTCTGTCTTTAAAAAAATACACATATACACAT
GTGTGTGTGTGTATGTGTATGTATCCCTGACACCTCAGTAGGCAGATTCTTTCTAACTCTTAATGTCT
TCATTGTCTTTGGTGAAGGGAGAAGGTCTGAGCTAATTTTACTTGTACAATAAGAAAAAACCTAGGATCA
GATCATAGTAATAATATGCTCTATCCTTGAATAATTTCACTTCTAAAGGGGAAAAAATATTCTATCACAG
AAACTTTATTACAGAGACTTTAGGTCTTATTGTCAATCTTGATATTTTAGTGGTGATCAAAATTAGTTAA
AGGAAGTGACTGTTTTCCTGCAGGAAACAGCCTGGTAACACTGTTGTGCCACCTCTTCAATACCCATGGA
CTCATTCACCATTTCAAGTTAGATATGGTGACCTTACACCGATTTTTAGGTAAGTCCTTTTTTTCACATT
TCTAGCCCCATTCTCTTGAATAATGGCAATGCATAATACTCTTTAATATAAAGTGGTAAGATCCATAGGA
TGATAGATGCATACCTCCAATTAATCTTAAATGGTCTCATCTTACTTTTAAAATATGGCTTGTTCATCCT
AAATCATTTAAAAATTGTTTACTTGATTACAGTTGATCCCAAACAACTTGGGGGTTAGGGGTGCTAACCC
CCTGTGTAGTCAAAAAATCTGTGTATAGCTTTTGACTCTCAAAAACCTAACTACTAATAGCTTACTACTG
TTGACTGGAAGCCTTACCAATAATAAACAGTTAATTAACACATACTTTTTATGTTCTTTGTATTATGTAT
TGTATTCTTATAATAAAGTAAGATAGAGAAAAGAAAATGTTCTTTTAAAAATTACAGGGAATCCTAGCAC
TTTGGGAGGCGGGCGTATCACAAGGTCAGGAGTTCGAGACCAGCCTGGCCAGCACAGTGAAACCCTGTCT
CTACTAAAAATACAAAAAAAAAATTAGCCAGGCTTGTTGGCAGGTGCCTGTAATCCCAGCTACTTGGGAG
GCTGAGGCAGGGAGAATCACTTGAACCCGGGAGGTGGAGGTTGCAGTGAGCCGAGATTGCGCCACTGCAC
TCCAGCCTGGGCGACAGTGCAAGACTCTGTCTTAAAAATAAATAAATAAATAAATAAATGACAGGGAAGA
GAAAATGTATTTCCTATTCATCAAGTGGATGTGGATCATCATAAAGCTCTTCATCCTTGTCATCTTCACA
CTGAGTAGGCTGAGGAAGAAGAGGAAGAGGAGGGGTTGGTCTTCCTGTCTCAGGGTGGCCAAGGCAGAAA
GAATCTGAGTACAAGTGGACTCACGTGGTTTAAACCCATGTTCTCAAGGGTCAAGTGTAGTTATGTTTAT
AATAAATTATATATAAAGAAAACCATCAGGAACATACCGTTTTCAAAGAAGATACTGGTCTGCTGACATA
TTAACAAACCTCCAGCAGCATGCGCCTCAAATAATTTTAATCAGGACATGAGTTGTTGAAAATTTTCAAT
AGGCTTTTAAAAAATAATAATAACTACCATTTATGTAGTGCCCACTATGAGCAGAGTACTTTTGGCAAG
TTATTTCTAACCATTTAAACAAATCTGCAAGTAGGATATTATTATCACCATTTGTCCCATAGTTTAGGAG
AGGTACAAAGAGGTTTCATTACTTGCCCAAGGCCAACAGCTAGTAAGTGGCAGAATATGAGCCCAAGCCT
AGCTCTGTCGACTTGGGAGTGTCCACCATCTTTCCACTGAACTCCATCATTACTCTGTATCAAAAGGCAGCC
TCAGTTCTTATTTAAATGTGTGCATATTCTTATTTATCTGCCAGTGAATTTTTCAGGGGACATTTCTAAT
CACCAAATGACTTTCCTCTGCCATTTACATGTTTCTGGCTTCTTTTTGACTTGCCACATGGCTGTACTTT
GATTTTGGAGGCTGACTTAATGCCATCAGAAGAAAATAACAGGCGTGACAATAATAATGGGAGCCACAAC
CAGGTTTCTATGGTGCTTACATCTGCTGGAAGCTCTTCCAAGGACCTGCATATATTAATAAACACATTTA
ATCCTTACTCCACTTTGAGCTCAGAGCTATTGCTATCCCCATTTTACAGAGGAGGAAACTGAGGGAACTT
GCAGTTAAGTAACTTGCCCAATACAGACATTAAAGTGATAGAGGGTTTAAATATAATTGTCAAATATACC
TGCTGAATAAAAAGTATGTGCAACACAACAGAAATATTTGAAACCAGCCACAACATGGCTAATTTCCAGA
AATCCAAATAACCTCAAGCTGATTGTATTTCAATTGATTGAGCAAAGAAATGGCCATGCATAGGGCCAAA
TAATTTTGATTTGTCTGAAAAGGGAGATACAGATATAGATACTTTGGACACGTGTATCTACCCAGAAAAT
ATATAAAGAATACAAAGACTTGACAACAGAATTAACACTGTAATCCAGAGCCAGATTCATAGCAATGGGC
TGAGAGAATCTGGCCACACTTGCAAATCAGGACAGTCTATACACACTGAATATATTGCATCCTAAGCATC
GCCTTGGTTATGAGCTGAAGCAGGTTAGCGTCTTCCATAAAAAGCAAACCAAAATCGCCTTGCCTGTGTC
TCTACTTGGTTCCAAGAGTACTCTAAGCCTTACATTAGACTGCAGGAGCATGAAAGATGATACTCTAACT
TGAATAAGGTAGAAATAAATCCAAGAAGTCCACAGTTGGATCAAGGCAATACCCTGAATCTCTGCCCTAA
GAGGCCCGGATTTGCTTTCATTGGTATTTGTTATTCAAGTGTTAAACCAGTCTTTGGATATCAGTATTCT
GATGCTACTTGGGCTCTTTGAAGGAAACCTCATTTGTGGCATATTATTTATAAACAGCAGAAACTCAATT
AAACTATAGTGTGAGATAAAGTTGTGCTTTTCCTACATATTTATTTTTCCTATGAATGACAGCCTTTATG
AATGTCAGAAAGGGGGGATTTATGAAGGAGGTGAGAAATCCCAACGCTTCACAAATCCTTTTGGCCTTTC
TCCCCTCTGCTGTCCATCTCTGCTCTCTGCTAAAAACAGCCTAGCAGAACTGCCAAGCTTGCAAACCACG
TTTATTTTTAAAGCATCTCTATGCTGCACATTTTGGAGGCACTGATATTTTAAGCAAAAAGCACCCACA
GTAAGTCTAAGCTAGTATACCACTCCTATTTGGGTTTTAGTTGATTGAGTTATCTGTTTACCTCCCAGTC
ATGGTTCAAGAAGATTACCACAGCCAAAACCCGTATCACAATGCTGTTCACGCAGCCGACGTCACCCAGG
CCATGCACTGCTACCTGAAAGAGCCAAAGGTAAGACAAGACCCAGCTGCCTCCTCAGCCACCTGGAAATG
CCAAGGAAACTACCTGCTAGGCCCAAGTTACCCAACATATCTGAGTAACTATGTTATGTGTCATTAACAA
TGTGAACACAAATTATTGATATTAAGGTTCCAGTATCAGCTCTGAAAATCTTACAATGTTCACGAAAAAG
GATGAGACTCATCTGAGGTTTTCTTTCATATTTTGTATATTTTTGAGGCTGTATTTGGACAAAAAAAAAA
AAAAAAACTTCCTCTCTATGGCAATCTACATCTTAGATACCTTCAACAGTCCATAGAACTAGCTCCGTGC
CTTAGATCTTTGCCACAAACAGCACCAGCATTGAACTTTGTTGGGAAAAGTCTCCTACTGCATGAGTTTT

FIGURE 130 cont'd

```
GATCAACAAATGGAATCAAAGCTCCTCAAGTCTGATGTTCTATTTCCTACTGAACCAACTGGATATCCCG
ATTCAGGGCCCAAGAAAACTTGTAATGTCAAAGACCTCTTAGCAAGCATGTTCTGATGCAATAAACCAA
CCCAAAGTTAAAAATTAAAAACATTGTAATAATGCTCAATACTCAACATTCAGGCAGTCCTTAGACTGAA
AGTCTGTTGGTACAAGGTACAGGATGAGTTTTCTTAAGGTTTCTGGAAAATTATATTCTAAGACTGTTGA
GTTCAATCTGTTTTTAACATCCCCCTACATATGCGGATGCTTTGACAGCAACAACTAAATATTCAGATGT
CAAACAGGCACTCTCAGGGCAAAGCTGGGTGGGTGCCTCATCCCTGCAACATATCCCAAGGACATTAATG
GCTCTGTTTTTTAATTTCCAAGTAGTCTAAACATTGTACTATGTCATACAGTTGTATTTTTAAAGTTAGT
ATTGGATTCCCGTGTCTCTGCTTATTTTCCTAGCTAACCAGAAAATCACAGATTCTCATACATTCTCCCA
CTATTTATTACACATTGAAAAAAATGCAGATCTTGCAAGTCGGCCCACTTCTTTCAAAGTGGCAAAGATA
TATTAGACAGTTGAAATACACAAATGATTTTTAAGTAGGTCCATCATGTGACCAACTTTTTTCTTCATTT
ACACATTTCTCTAGGAGCAAGGCTGATTTCAGGCCCTGTCTTCTACCTATCCACCCAACAGCACTGTTGC
CAACCAGCAATGCCATCACAACAACAAAACAAACAGAGTGGAATAGGAAGAAGGGGATACCAGAATAAT
CTACACAATTTGAGTTTACCCAATATTTTCCACACAGTCCTTTCCTTTTTGCCTGTGATTTCATGTGACT
ATCACCTCATTTAATGCTTCAAAGGGTAAAGGTCTGGCTGATAGGCTTAAACAATGCCATGATGATTCAT
TGTGTTTGATTTAGCCAAAATGATTATGAGCCTATTTGTGAAAATACACCAATCAATCTCCCAATTTGTT
TTTTTAACAGCTTGCCAGCTTCCTCACGCCTCTGGACATCATGCTTGGACTGCTGGCTGCAGCAGCACAC
GATGTGGACCACCCAGGGGTGAACCAGCCATTTTTGATAAAAACTAACCACCATCTTGCAAACCTATATC
AGGTAAGGGAGCCCAACCTGGAGCCAGCCACAGTATGGTCAATCGCCTTAGGCCCGGTGCTCAAGCCTGA
ATCTTGCCCATGGAGAAAGCCTTGTTTTAGGGTCCTAGAAGTTCAAAGACGAATGAAACACAATCTCTGC
CCTCAAAAATTTGTTCAAACTCAGATGCTCAAAATGAGCAAAATCCAAGCAAACTTAATCCCAGTTTGAA
AGAGGTTTGAGGAATTAGCTCATGTCGATACAATTGTTTTTAAAATCTCTAAAGAGTAAATACTTGTGC
TGTTCTTTGTATCCAAAGACCTTACTAGAATAAAGTGAGCCGCTGTTTTTCTTTTCCCATCAGTAAATTT
ATTCTCTAATTCTCTGGCCTTGTCCCTGTAAGGAAAGAGAAGAGAGAATGATCCAAGTGTGTGTGTGTGT
GTGTGTGTGTGTGTGTGTGTTTTCAGAAACAGGGTCTTGCTTTCTCACCCAGGCTGGAGTGCAA
TAGTGCAATCATAGCTCACTGCAGCCTGGAATTCCTGAGCTCAAACAATCCCTCCACCTCAGCCTCCCTA
GTAGCTCAGACTACAGGCACGTGCCGCCACACCTGACTAATTCTGTTTTTCATAGGGACAAGGTCTCACT
ATGTTGCCCAGGCTAGTCTCGAACTCCTGGCCTCAAGTGATCATCCCACCTCAGCCTACCAAAACACTAG
GATTACTGGCATGAGCCACCTGGGACTACAGGCATGAGCTACCATGCCCGACCGAGAAGGATCTCTTTGA
TTATGACTAGGGAGAAATTGGGGTATAGGTCTAGGGACCACATTCAGGATACTACCTATATCAGTCACCT
GTTCAACTGGTCTTAGGATCTCTTGGAGGCTATAGATCCATGTCTTTTAAGATTTAGGGACAAAGTTGAA
GGCAAAGCAATATCACATAGTACCATACAGATATCTTCAGTGTCCTATAGCTGGCTAGAAAAAAAGCTGA
AACTTTTCTTAGCCAAATTGGTGCTTGTCAATACTGAAAATAAAAATTGTTTAAAAGGACTTGAAAATAA
TAGGAAACTTCAATTTTGTCAAAAAATTGTGATCCCTTTATTTTTGGCTATATACCATCACTATTAACTA
TACTAAGGAACATCAAAAAGATGAAAAAAATTTCTTTTAAAAAGTTCAGTTCAACAAACTGTTTAACTAA
CCTTTATTCAACACTTACTATGACCCAAACACTGTGCCAAATGCCTTTGATGTAGTATATTATTAATCTT
CACAATAGCCCAGTGAGGTGAGTACTATTATCATACCTATTTTCCACAGAAAGAAGAATTGATACTTGGG
AAATTTAAGTGTTTTTCCTGAAAATAAACAGATAATTAATAGAACTGGAATTAGAACTCAACTTTTTGGT
TTCCAGAGCCAAAGTGCCTAAGAACTATGCATCCTGCCTCTGAAATTCATATTGATCACCTACCGTGTAC
CAGAAACTAACAGCTCTCCTACAATGCTCCTATTGTAGTAAGGCAGACAAGAGGGTTCTAGAAAGTGATC
GAGGCCTGGTGCAGTGGTTCACACCTGTAATCTCAGCACTTTGGGAGGCTGAGGCAGGCGGATCACTTGA
GGTCAGTAGTTGGACAGCCTGGCCAACACGGTGAAACCCCGTCTCTACTAAAAATACAAAAATTAGCTGG
GCATCGTGGCACATGCTTGTAATCCCAGCTACTTGGGAGGCTGAGACAGGAGAATCACTTGAACCCTGGA
GGCAGAGGTTGAAGTGAGCCAAGATGGCGCCACTGCACTCCAGCCTGGGCAACAGAGGGAGACTCCGTCT
CAAAGAAAAGCAAAGGAAAGAAAAGATAAGTGATCTAAAGTGTGAGAGGCTTGATAGATACTTTAAAGT
ATTTAGCTACAAACAAATGTGATGGGAAGATGGGGGAAGGAGAAACTGATTCTGCAGATAGTTGCAGCGG
GAAAAAAAAGAACATAGAAAAGAATGCTATAAACTGGGCCTTAAAGTGTGAGTAACATTAATAGCTGAG
ATGAAAAGAGGGCATTAGAGTCAGGATGAGCTGATGTACTTTTGGGATTAAATTCCACAACTCCAGAATA
ACTGAAAATGGAATGTCCGGTGGCCTTTAGCTGAGTATGGTCCTGCCATCTACAGCTCCGTCTCTGATCA
GTGTGTTGTGCATATCATGATTCAGTGCATACGCTCTCTTTGTAGTAACTTCAGATTAGTTGTACAGGA
CATGACCTGGATCAAGAAATCTTTACTCTGCATTAAGTTATAGATGAGGAACTGGCAGAAATCTTCAAGT
TTTCAGTATCAAAGGAAAAAATCACGTTACATAATATATAAGCTGAGCAAACCCATTAACGACACATGGT
ATTTAAAAATCTTTGGAAATGTAGCCTTTTAGCCTCTCAAGGGCCCGTTTGCTGAGACACAAATGGGCTT
TCAGGGAGCTATTTGCAAATTTTCATAGGATGTTTGCATGCACATTTTCCTAGGGAGAGGGTCTATAAGT
TACTCTTATCAAATTTTAAAATAAGTTGCAGATTCTGAAAATGTTAAGAACCATGGTAATGAATGAAAAA
AATATATGTACATATACGCACAAAATTATGCATGCGCACATGCACATTTGGTCAACAAGAATACCGTAG
AGAGGATGTGCCAGGAATTATGTGGCTTGGGGAACACCCTGTGCGTGACTTTGCCACAATCCAGACTTAC
TATAAATGAGATAAAATGGAAGAGGGCTTCCTCTCCCTCCTTCTGTTGGCTGTGCTCTTTTAGTTCTAAT
AAATAAGAGGATCATTGCATAACATCCAGCCTGTTATTCTACCCTGAGATAAAGAGAGAGCAGGGCAGCT
GGAGTGAAGGCCAGGTCAGAGGGCTCCCTCCCATGGTCTGTTCTCTGGGCCGGACTCACTCGCTGAACTG
CCAACCAAGTTCAATATGAAGGCACTGAAGGCACTTCTACTTGGCACCTCTCTCATCAGACTGGAAGCAG
TCCAGGTGTCCAGGGTGGACTGGGAGGAAAAACAGCATGTGAGAAATAGAACCAAGAATTTACTTTCTGT
```

FIGURE 130 cont'd

```
TCCTTCACCCTCCAACCCCACACATACAAATTTAATGGTGGGCTTAGCAACTGTGCAAAGTAAGCATTAA
GTTACATACAACGTTGGTGATTATAAATTGTAAAGGAATAACTTTCAGTTCAATTTTAAATTCAACTCCT
TTCAATAGAGTCCAACAACATGGACTCTATCATTTACTCATGACACAGCATCCTTAAAATAATGACTTTA
AAAAATTGTCCCATAAACATTTATTACACTCTATAATGTCTTGCAGAAGTTTATAATCAGCTTTCTTAGT
CATTTATCACAAGCACTTAGAGGGGGGTCAGCATTTTGAACCACTTGTTATTCTTAATGAGTCTGAATCA
CAAACATGAAGTTGACCCAGCCAGGAGGAATATTCCTTCCACGTGGTCCTATGACCCCACCCCGTCCTCA
AACAAACATCTGCAAAGACTAACATAAGCTCACAATTTCTACAGTATGAAAGGTGTTTTTGGAAAGTAGT
GCTAAAATTATAAAAGGAGCCTCAAATTTGACTTTCTGTTCCATAAAGTTTCTGCCATCCCCAATCTGAA
CCCCAGCCTTCCCTGCAGACAGCAATTGGCATCCCCGCTCCCTTCTCTCAGCTATCTTAGGCAGATGCAG
AACAAACAAGAGAAAGACATCTTCAAACAGGCATTAAACAAGGCAGTGCTATCGTTTCTTCAAGGGCCAA
GGTCTTGTTTAGGGCTCAAGGAGCTTCTATTCCACTGAGACCTCCTAGGCTGGGGCTCTCATAGTGTTAC
CAAGGAGACCATTGGCTTGTTAGGGAAGAACTCAGCAGCCTCCATTATCTCCTAAAGTCTTGCACCTTGT
TTCATGAGCAATTAAAAATGAAAACACAGACAATGTTCCTGTTGTTTTTCTTTCTGTATCCTCCGGATTT
AAAATGTTCAATTAACTCTGGTTCCTGGTACCCCAGATTCAGTTTATCATCATCATTTGAAGTATTTTAA
TCAAAGAAAGTGTCCAACAAATAGAGGAAAAAAACAGTTTAAATCTGCCTTGTATGATAGCAACTCTGCT
CTGCCAGATTCTGTTTGCCAAATACCCTCTTGACTTAATTTGAAAACCTGTGTTGGTGGTGTATTAAAGA
CCAGGTGTGCTATTAGCAAACAAGGGATTGTTTTGTTTTTAGGGTGAAAAATACTTGATAATTCAGGCA
CAAAGGGAAACGAAGGTTTTGCCTTAGAAGTTGGAAGGGTTTTGTTTTTTTCAAATTAAAGTTCTAATAG
GTTTTGTTGTCACAAAGGTAGATGCTTACTCCTTCAACTTTAAGATGAAGATTACTCTTAAAACTGCAAG
TAGGAAGGGTTTGAGCCACTAGAACACATTGTCATCAGGATAATGTGAAATTACTGAACCGATACTTCTT
AAAGATAGACAGACATAGTACCTGATGTGGTATTCTAGAACCGGTTAGGGTTTCAAAGGATATTAAATGG
TATCCTCTCACCACATGTTTAGATCTCCATGACCATTTCTGATGCTTTTCTTCTTTTTCTCAGTCTACCT
TTGGTTGATACGAGTCACTGAGCCTCTGTGAAAGATGAGTCTGTAGGAGTAGAGCTGCTTTTTGCTAGGG
AGGATACAGCATTCTTATCTCTGGCAAGTCACTAAGAAACCCCAGTGTATGCAAGCCTGCTCGCCACCCT
TTGCCTCTCCCCTAGGTTCAGGGCACACCAGCATCATCCTCTCATCCACCTACTCTCAGCCTTGCCTGGT
TTCAGCCCTTTTTCCACTATGAAGACAGAAAGAGTTTCCTGAAACTCAAATCTGACCACATCGATTCCTG
CTTAAAACCCTACCATGCCTCAGGATTGAGTCCAAATGACTTAACACAATTTACCATCCCCGTTCTGATC
TGACCCCTGCCAGTCCTTCCAGCCTCACTTCCCACCATTCCCTCCCAGGCTTCTATGCATTGAGGCTGA
ACTTCCAGTTTCCCAAACATATCACTCAATTCTTTATCCATTCAGCAGATACATACGGAGTGCTGAATAC
ATGCTAGGTGCAGGAGTATAGAAGATGAACAAAACAAATAAAAAAGTCTGCTTTTTTCTAAGGGAAACAG
AAAATAAGTAAAATATGTCCTCTATTAGAAAGTGATAATTCATAGATAAAAACAAAACAAGATAAAGATA
TAAAGTATCCCTCTTGCTTACAGATCTTCACACCCATGCTCTTCCTTCTGCCTATTTGAATAAAATGTAG
TATTCCATGGTATATTTTACTCAAATATAATATACAATAGAGTATGTTGTCTGTACTCTCTAATTCCTCT
CTTACTTGCTCATCCTTTTGATCTAAATTTGGACATATTTCCCTCCTGAAAGTCTTCTTTTTCTCTAAAA
ATCCATCTTACAAGCCCCTCCTATGAGATTTTCCAGTACTCTCTTACTTCCCTTATCACAGTATGTGTCA
CTCGAATCGCTATTGCCTGATTAGATGTCCACTTCCCAGACAGATAGTACATTTTGGTCACCTAACTCA
TTCACTGTGATATCCTCAATACCGAGAACAGTTCTGATGTCCAGGGAATATTTAATAGCTTCTCCTGCTT
ATTATTGCAGTCTTACTAAGAATACACAGAGAGTACACCATGCAGAAGGAGTAGCAATGATTAAAAATTC
TTGGAATGATCTTCTCATTGCATCTTGGAATTGACAAATGCAAGCTGATACATGTTATTTCTTGAGTCCT
TTACCTAATCTTGGTTGTCTGCAAATGAGTAGTGGGAGGGAACCCATTGCAGTAATAATTTTAAAATTTC
TTTGGATTTTACCTAAGTCTAAGGATTTCACTACACAAGATCCTAAATCTGGCTTCTATCAGATATTGAC
CAAAAATTCAAATAGGACTCTTTTTCTTTTAACAGTTCTTTTAACTTTTGTAGCTACTGAACTTTGGGGT
TTGGGGTATCAATTACTCAGTACCCATTCAACAAATATTTACCTATTTAAGTGGCACTGTGCCCCATACC
ATGGCACAAAGATGAATACAATACGCTCCCTGCCCTCAATAGCAGTCACGTAGGGCCACAGTTTTCACAC
AGGGTATGTGTGCCCATGGGGATATGTGAAGACTTTCCAAGGGGTACACAGGCATAAATAGTGTTAACAG
AATCCATTTTTAGGTCCTTAAACTGACTTGCCTGGAATGTGCTTGCGGGGCAGTGAAGCCAGTTCCACTT
TTCCACTTAACTTTCACAGTCACCCTGTTTCCACTTTACAAAAGACAGACACATGTCTGACTCATTCTAA
GTTATATTTCATACTGACCTAGGTATAAAAATAGCAAGCAACTATATTAGTCCATACTCAACGCTGCTAT
AAGGACACATCTGAGACTGGGTAATTTAAAAAGGAGAGAGGTTTAATTGACTCACAGTTCTGCAGGGCTG
GGGAGGCCTCAGGAAGCTTACAATCATAGCAGAAGGGGAAGCAAACACGTCCTTCTTCACATGGTGACAG
GAAGGAGAAGTGCTGAGCAAAAGGGAAAAAAAACCCTTATAAAACCATCAGATGTAATGAGAACTCATGC
ACTATCATGAGAACAGCATGGGGGACCACCCCCATGATTCAGTTACCTCCCATCAGGCCCCTCCCATCAC
ATGTAGGGCTTATGGGAACTACAATTCAAGTTGAGAATTGGATAGGAACACAGCCACATATCATTCTGCC
CCCAGCCCCTCCCAAATCTCATGTCCTCACATTTCAAAACACAGTCATGCCTTTCCAACATTCCCCAAAG
TTTTAACTCATTCCAGCATTAACCCAAAAGTCCAAGTCCATAGTCTCATCTGAGATAAAGCAAGTCCCTT
TTACCTAGGAGCCTGTAAAATAAAAGCAAGTTAGTTACTTCCTAGATACAATGGGTCACAGGCATTGGG
TAAATACACCCATTCCAAATGGGAGAAATTGGCCAAAACAAAAGGGTTACAGGCCCCATGCAAGTCCAAA
ATCCAATAGGGCAGTCATTAAACCTTCAAGTTCCAAAATGATCTCCTTTGACTCTGTGTCTCACATCTAG
GTCACACCTGATGCTGGGCTCCCATGCCTTGGGCAGCTCCATTCCTGTGGCCTTGCAGGGTACAACCCCC
TTCCCAGCTGCTTTCATGGGATGGCATTGAGTGTCTGTGGCTTTTCCAGGTACACAGGTGCAAGCTATAG
GTGGATCTACCATTCTGGGGTCTGGAAGACAGTGGCCCTCTTCTCACAGCTCCACTAGACAGTGTACCAG
```

FIGURE 130 cont'd

```
TGGGGACTCTGTGTGGGAGCTCCAATCCTACATTTCTCTTCTGCACTGCCCTAGCAGAGGTTTTCCATGA
GGGTTCTGCCCCTACAGAAACTCATGCCTGGACATACAGGCATTTCTGTACATCCTTTGAAATCTAGGTG
GAGGTTCTCAAACCTCAATTCTTGACTTCTGTGCACCCACAAACTCAACACCATGTGGAAGTCACTAAGG
CTTGGGGTTGCACCTTCTGAAGCAATGGCCTGAGCTACACTTTGGCCCCTTTTAGCCACGGCTGGAGCTG
AAACAGCTGGGATGCAGGGCGCCATGTCCCAAGGCTGCACAGAGCTGGGGGCCCTAGGCCCTGGCCCAGG
AAACCATTTTTACCTCCCTAGGCCTCCAGGCCTGTGATGGTTCGGGCTGCCATGGAGGTCTTAGACATGC
CTTGGAGACATTTACCCCATTGTCTTGGTGATTAACATTTGGCTTGTTACTTATGCAAATTTCTGCAGCT
GGCTTGAATTTCTCCCCAGAAAATGGGTTTTTCTTTTCTATTACATCATCAGCCTACACATTTTCCAAAC
TTTTTTGCTCTGCTTCCCTTTGAATGCTTTGCCATTTAGGAATTTCTTCTATCAGATACCCTAAATCATC
TCTCTCAAGTTCAAAGTTCCACTGATCTCTAGAACAGGGGCAAAATGCCACCAGTCTCTCTTTGCTAAAGCA
TAGCAAGAGTCACTTTTATTCCAGTTCCCAACAAGTTCTTCATCTCCATATGAGAGCACCTAAGCCTAGA
CTTTATTGTCCATATCACTATCAGCATTTTGGGCAAAGCCATACAACAAGTCTCTAGGAAGTTCCAAACT
TTCCCACATTTCCTGTCTTCTTCTGAGCCCTCCAAACTGTTCTAACATCTGCCTGTTCCCCAGTTCCAAA
GTCACTTCCACATTTTCAGGTATCTGTATGGCAGCACCCAAATCTCAGTACTGTATTAGTCCATTCTCAT
GTTGCTATAAGGACATACCCCAGACTGGGTAATTTATAAAGGAAAGAGGTTTAATTGACTCACAGTTCTA
CAGTGCTGGGGAGGCCTCAGGAAACTTACCATCATAGCAGAAGGAGAGGCAAACACATCCTTCTTCACAT
GGTGGCAGGAAGGAGAAGTGCCAAGCCAAGGGGATAAAGCCCCTTATAAAGCCATCAGATCTCATGAGAA
CTCACTCACTATCATGAGAACAGGTTGGGGGACCACCACCATGATTCAATTACCTCTCACCGGGTCCCTC
CTGTCACATGTATGGATTATAGGAACTACAATTCAAGATGAGATTTGGATGGGGACACAGCCAAACCATA
TCAAGAGCAATTAAAAATATTAAAGGAAGTCTCCTGTAACTGAGATATGATAACTCCCCCATCCATCTCA
TAAACAGACACACGGCCAATAAATTATTATTCTTGAGCATAATTATTCTTTCCAAATTTGCAATAAACAT
GTGTTTGACCAATGAGTTTCTGGTAAGGATTATACTATAAACTCAAGCTGGAAAAGTATTTAGTACTTA
GAGCCTGATGTTAGGAAATTTTTTAAAATCAAATTTCAATTTAGACTTTCATTGCAGAGAAATATGATA
GGATGACAATAAAAGATTTTCACATATAAAATTATATTACATTAAAATAAAAATCTACAGAGAAATAGAA
TGAAAATACAAACTCTAGAGGGAAAAGAATTTAATATTTCTGACTTAAATAATAAGTTAAATTATTCATG
TGGATTTTTTTCAATGGGTGCTGAATGGGCATTAAATGCCATTGTTATTAGGTTCCCTTAGACACATTTA
ATACCCAGAAGAGTGATATAGTAAGTTTATATTAAACTACCAACATTCACTAATACACTGGACATTACAT
CTTTTGTAACCACTTATATTTATGATTTTTGAAAGTTTAGATATCAACTCTGAAAAGTGTGAGGAAAGTA
TAGTTTTTCAAAATTCACTGAATGAGCAGACCACTGACATGTGGGAGCAAGGCCAGTGAACAAAGTTGTT
ATAAGGTGTTGTAGACACTAGGATAGAAGTTTCCTGTGGGTGTAGAAGGTCTGGAAGAGGAAGCTGTCAG
TTCTGTTGAGAGAACCAAGAAAGGCTTTCCAAGCAGATCAATGATTTGTCTCAGAAATAAGTAGATAAGG
TCGTGTGTGTGTATGTGTGTTTCCAACTTTATTAAGGAGATTCTCCTCACTCTTTTTGGAGTTATGT
AATCCTTTATTATCATTTCCTATGCCCAAACCAAGCCTTATTATAAATCAAGACATTGAAAAGGCCCTCT
CTCATTAGCTCTTTCAGGATGACATGGGAGACAAATTAACTTTAAATCAACTTGGTGTATTTGTGATTTA
AACAAGATAGAAGTTTATTCCTAACCTTCATAAAAGTTGGGCAGTTGGAAGTCCAAGGAAGGCACAATAG
CTCCACAAAACATTAGAGACCCAGGATTCTTTTAGTTCTACAATCTGTCATCTCTTGGTAGGGCACTTGT
CCTCCTCACCCAAGGTATCTGCTGGAGGTCAAACCATTCCTGCTGCATTCCAGTGAGAAGATAGAATGGG
GAAAAGCAAAGAAACCTCTCTCAGATGACTCCACCTTTGGTTTAAACAACCTTCCTGGAAATCCCACGC
AACACTTCTGCTAACATTTAGTAGATCAGAACTTCATCAAATGATCCCACCTAGTTATAAAGGAGGCTGA
GAAATGCTGTCTTTCTTCTGAATAGCCATAAGCCCATTTAAAAACTGAGGTTCTGTGAGTAAGGAAGAAA
GGAAATCAGAAAATGGGATGAACAAACAGGAGTCTCTGTCATACGTGATGCTTAATCTTAAACCTAAGG
CCATCAAAATGATGACTTGGTGTGATCCTTCCCTTTATGTAACATTCTTCCTCTAACCCACCAATTACTA
CAGCACTTACATGACCATTGTGTTTTCCTTTTATTGTTGTTACTGCTTAGGTTATTTGATATCCCCACTG
TGCTGCCATGTGTCTAATGGCACCTCAAACTCCACATGTCCCACACTGAACTCTACACCTGCTCCACTGC
AGCTTTCCCGTCACGATTAATGGGCACTCCATCCTTCTGTGCTCATACCAGAAACAATGGAATCATCCTG
CAGACCCAGAAATCAACCACCTCTGATGCTACCTCCCCATCCACATCTCCATCACCTCTTACCTGGATG
AGTGCTATTGTCCCAAACAGCCTTCCACTTGTATATTAGTTCCTTCTCACATTGCTATAAAGAAATACCT
GCAACTGGATAATTTATAAAGAGGTTTAATTGGCTTATTGTTCCACAAGATGTACAGGAAGCATGATGCT
GGCATCTGCTTGGCTTCTGGGAGACCTTAGGAAATTTACAGTCATGGCAGATGGCAAAGAGAGTAGGCA
CCTCACACGGCTAGAGCAGGAGCAAGAGAGAGAGTGAGGGCAAGGTGCTACACACTTTTAAACAAGCAGA
TCTCATAAGAACTCACTACCACAAGAACAGCATCAAGGGGATGGTGCCAAATCATTCATGAGAAACCACA
CTCATAATCCAATCCCCTCCCACCAGGCCTCACCTCCACTATTGGGGATTACAATTGAACATGAGATTTG
GCTGGGGACACAGATACAAACCATTTCAACCTGTTTCTCCCCTTACCCCTACCAAAGTCTGTTGTCAACA
TACACCAAAAGTGGCCTTATTTCAATGTAAGTCATAATTTTACTCCTCCCAAACCCTTGCAGTGGCTCCT
TATTTCTCTCAAAGTAAAAACCAAAATGTTTGTAATTGCCAGAAGGCTGTGCCTGGTCTGGTGTCTCATG
ACCTCACTGACTTCATGTCTTCATACTTCCCCTCTCGCTGTGCATTGACCTCACAGCTGTTAGCTCCT
CCCTTGAGGCCTTTGCTCCAGCTGTTCTCTTTAGAATGCTCTTCCCCAGGCAGGAATGACTAACTCCCTC
CTGCCTTCAAGCTTTTGCTCAAATCTCACATTTCCCCATGACTACCTTACCAGCCCTGACTATATCTGAA
AGTGGGGACTCTCAGATGCCCACTATTCTGCTCTTCTCTCCATGCATTTACTATCTTCTAACATGCTATC
CAACTCTTTCCAGCATGAAAGTATTTATTATGTTTATTGTTTATTGCCTGTCTCTCCCCATCTGATATGG
TTTGGCTGTGTCCCCACCCAAATCTCATCTTAAATTCTGTGTCATGGGGGGAACAGTGGGAGGTAACTG
```

FIGURE 130 cont'd

```
AATCATGGGGGCAGGTCTTTCCCATGCCCTTCTTGTGATAATAAGTCTCACAAGATCTGATGGTTTCATA
AAGGGGAGGTTTCCTGCACAAGCTCTCTCTCTTCACCTGCTACCATCCATGTAAGATGTGACTTGCTCCT
CCTTGCCTTCCACCATGATTGTAAGGCTTCCCCAGCCATGTGGAACTGTAAGTCCATTGAACCTCTTTCT
TTGGTAAATTGCCCAGTCTTGGGTATGTCTTTATCAGTAGCATGAAAACGGACTAATATACCATCTCTAC
CACCACTAGTTTCTTGTCTGTTTTGTTCACTGATGTATTCCAAGCACATATCACAGTGCCTAGAACATAG
TAAGTGCTCAATATATTTGTTGAATGAAATCAAGTAATTTGTTCTCTTACTTAGCAAATTTATAGAAACT
CTGTGTGAGGCATAGATTTGAGTGGATACAAAAGGAACAAGGTCGGCTGCCTACTCATACCTAGCTTATA
ATGTAGTAAAAGATAAAGAACTCTAATAGACATCAATGGGACTGAGTTTAATAGGACACAGGACTTCCGG
AATGCCAGAGAAAAATTCAAAATGAGTATAAGACTCAGAAGAAAGCACATTTGCCTTTGCCTGGAATGAT
TGCAGATGGCCTTGTGGAGTATTTGAAGTGAACTTTGAAAGACAGGGGCTGGTTTGATAAGTGAACATAG
AGAAAGAGGTGTTTGCAGATAATAAACCACCTTGGAAGGTATTAGGGTTAGCAAAAGGAAAGGACACCAT
CATATATTAATAATTTAATATTTATGTAAGTTATAGTCTTGCTAACATGATATTTATTTGGACTATAAGA
GCTTTGTTGGAAAGGAGAGGTAAAGGTATTGAGTTATCTCAAACATTTAGGAACAAAGTGATATTTGGA
CAATTTCATAAAGCATTGAACGTCAAGCTAAGGAATTTGACTTAATTTGTCTTACAGGGATCCGTTGTGG
GGTTTGGAACAGGGAACTGGGCAGGTGGATAGCATGATCATACCAGAGGCCAGCAAGCTCCTTGAGAGC
AGAGATTTTGTCTTATTTATCCTTGGATCCCCAGTGCACACCACAGAACCTGGCATATTAGTGGGTGATT
GATAAATATTTTGTTTCAACCAGTGATTAGGGAGAATGTAAAAAATTTTGTCAAATAAACAGGTCACAT
TCTGGCAGCTGTAAGGAGGATGACTTGAAGAAAAACAATGAAAAGGATGGTAAAACTCTGAAATAGGGT
GGCTTCTATGAAAGGAATGATTGGGCACAAGTGACACTATGTAGGAAAAACCAAAAGGATTCAGACACTG
ATTGCAGATGAGGGTTGAGAGTGAACAATGAGTTCTCCCCAAGACGACCTAAATCTACTCAATCATTAT
TCAAACCACAAGATTTTTAGCAATAGAACCAGATTCAGAGGTAAATGCAAGAATTCCAATGTGGGTTTAG
AAACTAACATCTAATTAGAACAATCAACCTTAGTTTTTTTGAGCAACAACTATAGGTAATTTTGGCAAA
TTCAGTATAATTCCAGGTATTTATCAGCTTGTAAATTTCAGGCTTCTGATGCTTGGATGTGGTAGCACAG
AGAAAATTCTTGGGAGGCAGCAAGGGCTGTATGCAGAGCTTAGGTTTGAGTCTGCAGGCATAAGTGAGGC
CTTCCTCAGCTACTCACTAGCTCTGTGGCCTCCCTAAGAAACCTGAGTTTTTTATGACCTATGAATTCAT
GATCAAAATAGTGGAGGGGTATGTGAGATTTAGATGAGGGCATGGAAAGTGCCTGGCACAGAGTTGGTGT
TTGATAAATGTTAGTCTCTCCTCTCTATGCTGTTCTTCTTTTCTTAGTCTCTGGAATCCACCATGGTGCC
CCTATTTCCACCGCGGTTCTGGCCAAAACATGCTTTCATGCATAATGACTCTTCCACAAAGGCTGTGTTT
GCAATCATCTACTCTATTGTCTTTTAATCTGTACCAGCTTCCAAGCTAACCCAATTTTCTAGCATTTCCC
TGGTGCTCATCTCCAAATACAGTTTCACCAGCAAATTTCCTAAGTATCCTTTTATTCTGTCTTCAGGAAG
ATTATTAATGAAGATGTTAAGTCAGGCTGGCATACATCACCATGCTTAAGGCCATCTTCCAGACATTTTT
GTTCCACTACATGGGGATATGGTGTCATTTATCATTAGATCTTGTTACAGCTTTCTGGCCCTTGAAAAAC
TCATGGGAGGGCACTCATGTCCACATCTACTTGAATTAGTCTTGCAAGTGAACACGTGAGCGACTGAATT
AAATGTCATCACAGGATTGAACATCTGTTACATCACACTAATCTATCACTCTTCTCTCCTAAATCTTTTC
AATCAAAACAAATTAGTCTAGCATGTGATTTTCAATCAGCCTTCTCTTTTGTTGTGTGTAGCTCATGCCC
AAAAGGAAATAATAGACCAGTTGATAAAAGTAACAAAATTTCATTACTGCTTCAAACATGGTCAAGTGGT
AAATAAGAATAATGACTCCTTGGCAATTAGTGAAATGAATAGCAATAGGACAGACTCTACAGAAGATGG
ATATGAGACTCAGTCAGCCTCATGAAACTTACCTCATAACAAAGCCTTGGAGATAAATGAGTGTGTGGTT
TTAGAATCAAGAATAGTTTTAGAATCAAGAATAGTTGCAGCTTTCCTGACTTGTGTTTTCCTAATGGAGC
ATTGATTGTGTCACTAACAAGAGATTCTCCTTCCTCATTTGCTGAAAAAGTTGAACATCGTATGGGTGGC
TCAGATACAGTAGGGGCATAATATAATGGGATGGTTTTTAGCCGCACTTCTGACTCCATTTCGTCACCAA
ATTATTTTCCTTGCTTCTTTTCCCTTACTTTTTGTTTAATTGTGGTAAAATACATGTAATATAAAATTTA
CCATCCTAACCATTTTGAAGTGTACAATTCAGTGGTATTAAGCACATTCATAATGTGCAATCATCACCAC
TACCCAACTCTAGAACTCTTTTCATCTTGTAAAACTAAACCCTGTGCCCATTAAACAATAATTCCCTGTT
CCTCCCTCCCCTTAGTCCCTGGCAACCACCCATTCTACTTTCTGTCTCTAAGACTGTGGCTACTCTAGGT
ACCTCATACACATGAAATTATACAGTGTCTCTCACTTTTTATTGAATGTTATTGTCTTAGTCCATTTTCT
GTTGCTTATAACAGAATACCTGAAACTGAGTAATTTACAAGGAAGCAAAATTTATTTCTTACAGTTATGG
AAGCTATGAAAGTCAAGATAGAGGGGCTGTACCTTGGTGAGAGTCTTCTTACTAGCGGAAACTCTGTAC
GGAGTCCTGAGGCATCTCATGGCATCAGAGAGGGGCTGAGCATGCACAAGTGTTAGCTCTTCTCTCTTC
CTCTCTTATAAAGCTACCAGTTTATCTTCCATGATAACCCATTAATCCATTAATCCATTAATAGATTACT
CCACAATCCAATCACCTCTTAAAGGCCCCACCTCTCAATACTGTCACATTGTGGATTAAGTTTCAACGTG
TGTTTTGGAGGGGACATTCAAACCATAGCAACTATCCTTTTATATGTTTTGTAAGATTATAACTACTCTT
GAAACCAAATGGAGACTGAATAAACAAAATATTGCCTGAGGTCAAGAGGAGTTCTATTCTGTATCTATGA
AGTCAATGGTACAGACATAATGTTTCCTAATTAGAACAAAACACAATTGAGTATAAGAAATATTCATCAT
TTAAATGGTTAATTGTTCAGATAAAAAGCATATTCAAAATAACAGGTCAAGGGAGAGATTGAATATAACA
CAGGTTCCCTCAAGGACAGGAATGTTAAGATAATTGAGCAAGGAAGCAATTGTAGATTCCAACTCACAGA
TTTAATCAGCTAAATGCCAAGGTGCTGGTCACAAAGATTACCGGCAGAGCTGCCTGCAAGGTAATGGTTC
TCAAACCTTAGTGTACATATGAATTTATTACCACAAGCCTATCAAATCAGAACCATAATGACTGCGACTC
AGGAGTCTGAATGTGTCACCAGCTACCCTGGTGGTTTGGGCTTAGGAGGTTCTTATCAGCGTTGAGAAAT
GATGGTCAGTGCAGTAGATTAGACCAGAGATTGTGAGGCTTGCCTCCATTCAGTTTGCTAGTATAATCTT
GGATTATGTTATGACTATAGTGACATGGTATCCATTACTACCTATTTCACTGCTTCACTTTTTTTTTATT
```

FIGURE 130 cont'd

ATTATTATACTTTAAGTTTTAGGGTACATGTGCACAATGTGCAGGTTAGTTACATATGTATACATGTGCC
ATGCTGGTGTGCTGCACCCATTAACTCGTCACTTAGCATTAGGTATATCTCCTAAAGCTATCCCTCCCCC
CTCCCCCGACCCCACAACAGGCCCTGGTGTGTGATGTTCCCCTTCCTGTGTCCATGTGTTCTCATTGTTC
AATTCCCACCTATGAGTGAGAATATGCAGTGTTTGGTTTTTTGTTCTTGCGATAGTTTACTGAGAATGAT
GATTTCCAATTTCACCCATGTCCCTACAAAGGACATGAACTCATCATTTTTATGGCTGCATAGTATTCC
ATGGTGTATATGTGCCACATTTTCTTAATCCAGTCTATCATTGTTGGACATTTGGGTTGGTTCCAAGTCT
TTGCTATTGTGAATAGTGCTGCTATAAACATACGTGTGCATGTGTCTTTATAGCAGCATGATTTGTAGTC
CTTTGGGTACATACCCAGTAATGGGATGGCTGTGTCAAATGGTATTTCTAGTTCTAGATCCTTGAGGAAT
CGCCACACTGACTTCCACAAGGGTTGAACTAGTTTACAGTCCCACCAACAGTGTAAAAGTGTTCCTATTT
CTCCACACCCTCTCCAGCACCTGTTGTTTCCTGACTTTTTAATGATTGCCATTCTAACTGGTGTGAGATG
GTATCTCACTGTGGTTTTGATTTGCATTTCTCTGATGGCCAGTGATGGTGAGCATTTATTCATGTGTTTT
TTGGCTGCATAAATGTCTTCCTTTGAGACATGTCTGTTCATGTCCTTCGCCCACTTTTTAATGGGGTTAT
TTTTTTCTTGTAAATTTGTTTGAGTTCATTGTAGATTCTGGATATTAGCCCTTTGTCAGATGAGTAGGTT
TTGAAAATTTTCTCCCATTTTGTAGGTTGCCTGTTCACTCTGATGGTAGTTTCTTTTGCTGTGCAGAAGC
TCTTTAGTTTAATTAGATCCCATTTGTCAATTTTGGCTTTTGTTGCCATTGCTTTTGGTGTTTTAGACAT
GAAGTCCTTGCCCATGCCTATGTCCTGAATGGTATTGCCTAGGTTTTCTTCTAGGGTTTTTATGGTTTTA
GGTCTAACGTTTAAGTCTTTAATCCATCTTGAATTAATTTTTGTATAAGGTGTAAGGAAGGGAAAAATCA
CAAGCATTCTTATACACCAATAACAGACAAACAGAGAGCCAAATCTTGAGTGAACTCCCATTCACAATTG
CTTCAAAGAGAATAAAATACCTAGGAATCCAACTTACAAGGGACGTGAAGGACCTCTTCAAGGAGAACTA
CAAACCACTGCTCAATGAAATAAAAGAGGATACAAACAAATGGAAGAACATTCCATGCTCATGGGTAGGA
AGAATCAATATCATGAAAATGGCCATACTGCCCAAGGTAATTTATAGATTCAATGCCATCCCCATCAAAC
TACCAATGACTTTCTTCACAGAATTGGAAAAAACTACTTTAAAGTTCATATCGAACCAAAAAGAGCCCGC
ATTGCCAAGTCAATCCTAAGCCAAAAGAACAAAGCTGGAGGCATCATGCTACCTGACTTCAAAATATACT
ACAAGGCTACAGTAACCAAAACAGCATGGTACTGGTACCAAAACAGAGATATAGATCAATGGAACAGAAC
AGAGCCCTCAGAAATAACGCCACATATCTACAACTATCTGATCTTTGACAAACCTGAGAAAAACAAGCAA
TGGGGAAAGGATTCCCTATTTAATAAATGGTGCTGGGAAAACTGGCTAGCCGTATGTAGAAAGCTGTCAC
TGCTTCACTTTCTTTCTTACATTTAGCGTGGCCTGACTGAGCTATTGGAAGAGGGGCAGAGGCAGGAGTG
AATGATGCTGGAAATAGATCCTCATTCAACCCTGCAGCAGAGGGTGAGCCGCAGGCCCTGCTGTTCTCCC
ATCATCATCACAGCCTTGAGACTAGACCTCATGGTTGTTTATCTTTTGGGTTTTTTTTCCTGGTCTGC
CTCTGGGTCATCAAGTACAAACTGGAGGGAAAATGCTAGCGTCCGTGGAGCTGTGTTCAGCATGAAAGAT
CAGTATCTGGCTTCCCTCTCATTTATAACTCTTATTTTCTTTCTTTCTAGAATATGTCTGTGCTGGAGAA
TCATCACTGGCGATCTACAATTGGCATGCTTCGAGAATCAAGGCTTCTTGCTCATTTGCCAAAGGAAATG
ACGTAAGTGCTGCCGAGATGAAACATACTGATGTGCATGCAGTAAAGATAAGCCACTTTCTCTAGGGCAG
GCTTGGGACCTTTTGCGTGAATGGCAGAGAGCCCCCGGCTGTACTTCCTGCCTGCACTGAGCTGTCTAT
CAGAGGAGATTTGGTGTCAGTTACAGCAACCCAGAAACCAAAATCTCTCTGTGTGCTTTGAAAGGGCCTT
GCAGAGTCAATGACCTACAGTCAGGAAAAGGGATAATAAACAGCTCTCAGTTTTCACACGCTTCAGTATC
AGTGCTCGACTTTGCCAAATTCCCGACCTTTAGTTTAGCAAAATTGTCCTTCCATGTAGCTCCAAATAGT
AAATATTTATCAAGAAGGAACCCAGGCATTCTAAAGCTAGAGTTCAAAAAGTATATTTTGTAATTGCTA
GTCTCAGCAAAAATAGAAGTCAGAAATTCTTTTCTAAAATGTCTTTTGCTAAGTAATTGAAATGGCCCTA
GCATTTTTTTCACCAATTAATTTACCTTACGTCTCTTGCACTTTAAACAGAAGGGGAGACACTCATTTTC
TGGTTCACTATTTGATAGCCATGGTATGTAGGCTGAGTCCCACTAAATCTGAGGCCATTGTTTCATTTTC
CTGGTGGCCCCAAGTTAGCTGCTAATACTGTCTTCCAAGGCCACCATTAATTCTGATCTGTTTAATGAAC
ACGTGCAGAACCCAAGAAACCTAGGTGAAAAGAGTACATAGATTGCTGTACCCTTCTTCAAGACAAGCAC
ATAACTTGAGGTCAAGGACCAAGTGCTGTCTCCAACTGAACAAGCAGTATACTCTGGGTTGTGGATTGA
TTCCTGGCCCTCTGATTTGATCTCATGCTGTTTCCTAGCACCCAGAGGAATGTGAAATTTGCAGGAGGAA
TTTCAGTTCTGATAAATTTTTACTCCCTGGAACTAAATAAAACCAGTTCTCGTGCATGGAATAAAAACTT
ATGCCTCTTACTAGAATAATAAATTGCAAAGATTGAAAGAATTAAATGCAAAAGAACTAAAAACTAGAG
CAAAAGATCAAGTGAGAAGAAGAAAAGAGGAGGTAAGGAGAGAGACAAGGAAGAAAGAAGGAGAAGGAAA
GGAAGAATAGTGAGGACAGGAAAGAAGAAAATGCAAGGGAAATGGGAAAGGACTCTGGGGTGACCAGACT
TCTCCTGGTCAGTACCTGCATTCATCCTGTTTGTTACTCAATATTTCTTTCCTAAAATATTCATTTCACA
TCTATGGATTCCAATGAAAAATATATTTTATGTGTCTTTGTGGAACACAGTGTTATAAATTGTTTTGC
CAGAAGAATAATTGTTATACAATAATATATGTGAAAACTTTATTACAAAAGCCATTATCATAATCATTAT
TATTCCTTCTATCACAGGTAAATGCTTTAATGTCATTTTTCTGATTTTAAAAGTAGGGCAGGTTAATTGT
AGAAAGTAAGGAAATTCAGGAAAGTGTTAGTTTGAACTATGTGAAGTTGCTCTTTTTAAGGGCCAAAAA
CAGGAGACTTTTAGCACTTTCATATGTTTCAGCTTGATATGAAAGAGAAACTGAAACTGCTAGTAATCC
TGCCATCCAGGTATAGTTCATGTTAACCTGGCTAGTTTATTTTCTTTTAGTCTTTTTTCAATACAAACTT
ATTTTAACAAAATATGATTATATTTGGGGAACTTATTTTACAGTTTACGTCCTGAAATTTTTTATTTACA
ATAAAGACTTTTTTCCAAATCATTAAACCTGTTAAATTAAAATGATTTTGTCAGCCGTATGGCATTATTG
TATACCACTACTGCCTTTCATTTGGAATTCAAATGGTTTCCAATATCCCAAACTTTGATACTCTGTTTTC
TCAGGAAGTATTTGTAGATAAAAATTATTGGTCAGAAAGGTCTGAACTTTTAAGTTTCTTGTATATTATC
CAGTTGTTCTTCTAAAAGGCTGTATCTACCTGTATTCCAACTGATGGATTGTAAGAAAATGTACCAATGT

FIGURE 130 cont'd

```
ACCATCACCAAAATTGAGTTTATTTTTATCTTTTTAAAATATTTGCAAATTTGACATATATGTATGTATA
TACACAAATATATATGTAAAGTGGTTTTCATTAAATTAGTATGCATCCTTTACTTACAACCAAGATTGAA
ATTTTTCGTATATTTGCTGATCATTGCTATTTCTTTAGAGAACACATTTTTATATTTGGTCTCTTCCTAT
TTTCCTATCAGTGTTATTCATTTGTTAGAACTCTTTGTATATTAACTACAGTAACCATTTGTTATATGTG
GTAAATATTACTTGAAGTTTTTAGTTTGCCTTTTGATTCATGAAACATTTCACCTAATTAAAATAATTTT
ATTTTCCAATTATAAATTCAGTAAGTATTCATATCTTCAAAGAATTCATATAATTTTGAGAAGTATAAAT
AAAATATCAACCATAATCCCATTATAGATCTTTTCAGTTTATTTTCTGTGACCATAGAGATCATGCTTTA
CATGCTTTGCATTTTGTTTGTAGCATTAAAAAGATGACATTTTTCAATGTCAATTACTATAGCTGTACAT
TGTACTTCATAATTGCACAATATGAATGTACCATGGTTTATTTAACTAATCTCATAAATTTTTGTGATTT
TTTTCCCCACGGAATGCTTCATTATTGTAAATAACAATAGAATACGCATCCTTGTAACATATCTTTACT
AATTATATCTTTACTAACATGTTAATGTTAATTTGTAGATGGACTGTTGGTCAGATTATTTATGTTCATC
AAATGCTTTTTCCACTAATTCCTAAATTACCCTCCAGAAACATTGTACTAATTTATACTCCCTAACAAAG
AATGAGGGAACCATTTTTCTCGTACTATTGATAGCATTGGGTATTACAATCTTTCAATAATTCAGCAAA
TTACTTAGCAGTTACTTTTAATCCTCACCAATAAAATGGGAGAAATAATATCACATTGTGGTTTTAATT
TGCTTTCTGCTATACTAAGAATATTTAATATCACTTTATTTTTGAGATATTTGTATTTCTCTTGTGAA
TTTTCTGTTTTATATAATTTTTATGTTCAGAACTGGATTAAAGATGTAGTATGGCTTAAAAACAAAAT
GTTTGTGGTGAAACTATAAAGCTTTTAGAATATGATGTAGGGAAATTTTCATCAGAGTTGGGAAAGTTT
CTTAAAGAGGAAAAAAAAACTAGCCATAAATAAAAGATTTATAGATTAAGCTACATTAAAAATTAAGA
CTTCCTGGTGGCACTGTGGTTCATGCCTGTAATCCTAGCACTTTGGGAGGTGGAGATGGGAGGATCACTT
GAGGCCAGGAGTTCGAGACCAGCCTGGTCAACATAGTGAAACCCCCATCTCTATTTATAAATTTAAAAAT
AAAATTAAAATGATAAAAATTGAGACTTCATCAATAGACATCATAAAGACAGCTAAAAGACAAACCACAG
ACACAATATTTGCAACACGTAGCTGACAAAGGACCAGTATTTAAAATATGCAAAGAACCTCAGAAACAAT
AAGAAAAAGACAACTTAATAGAGTAGACAAAAACTAGAGTAGAAACTTCACAAAAGAAGTACAAATGGCC
AATAAAGACATGAAAATATGTCTAGCCTCATTAGTAAACAAAATTCATATTAAAACTACAGTGAGTTGCA
TGACATGCCCATCAAACTAGCAAAAAATGTAAAGGGTAAGAATGTAGAACAATGAGAATCTCATCTGCTA
CTGCTGGGAGCAAAAATTTATACCATCATTTTGAAAATAATTGGCATTATCTAGTAAATTGAAGATAAAC
ATACCCTGTCATCCAATTATTGCATTCCCAAATATAGACCCCAGGGAGACTTCTGCACATGCGTAACTAG
AGGTATATAAGAATATTTACTGTGGCTTTTTTCATAGTAGCCAAACACTAGAAAAAACTCAAGTGACCAT
GAAAAGTAGAATGGATAATGGAATGGATTTCATTATCAATGGAATTTTATACAGTGGCATACACTGTAAC
AAAAAAGGATCAACTATAGCCTACACATCATGAAGGAATTTCAAAAACATAATGTTTAGCTAAAGAAGTC
AGTCACTGATACATACCATATAACTTAAAGTTCAAAAGCAGTTAAAATTAAGTTGCGTGGTTTATAGATG
CACTCACAGGTGGTAAAATCATAAGTAACAAGAAAATTGTTAAAACAAAGAGCAAGAAAGTGGTTACTTC
CAGGCTTGAAAGGAAAGGGGATGTGATGAGACAGGCAACATGACCTCTGGGGTACTGGCAGGCAGTGTTC
TTGACCTGAGTGGTGGTTACAAGGTGTTCATTTTCTATTTATTCATTAAATTATGTATGTATTCCCTATG
CATTCTACTTAAATATATTTCATTTTTAAAGGTAAATTTTACAAATATTTATGGATTGTTCCTTTATTAC
TTTTTATATGTGAGGGAAAGCTCCAACTTGCTTTACCTTTCTAAGATATCCCATTTTCTCTATACCATTT
GTTGACTAATATATCTCTTGCCCACTGGTTTGTAACAGTGCCTTAATTAGTTTTTGTGTTTGAAGTTCCA
GAATCTCTTCCTGGCCTATGTATTGTGTTCCGTTGATGGATCTTTCCATCCCATGGTACCCTTTACTATT
ATTGTCTTCATTTTTATTACTATTGTTATGCCCTTTTCTCTCTCCGTGCACATCTTCATGTTTGAACTCT
AAAAACACACCGCCAATCTCATGATTCTACAAGTCTTTTGTGTCCTCCCTAAAACATGCATTTCTATTTG
GCTTTCAGATTTTTTCACCCATAGAAATGTCTACACTACCACAACTTTGTTTTTCAAGGTTTCAATCACT
TTATACAGTTCTTGGCATGCTTCCTGTCCAAGGACGCAACTGGTGGGTGGGAGACTTGCTCTCAGGCAGT
GAAGGACTGGCACATTGTGTAATAAACAGAATCAAAGGCAGAAATTAGATTACAAGCCACCTGATGATGA
TAAAATCAATCACCCTCATCAAAGGGATTTGCTTTGTGTGTGTTTTTCTCTTTCATTCTTGTGGATGCAG
ACAGGATATTGAACAGCAGCTGGGCTCCTTGATCTTGGCAACAGACATCAACAGGCAGAATGAATTTTTG
ACCAGATTGAAAGCTCACCTCCACAATAAAGACTTAAGACTGGAGGATGCACAGGACAGGCACTTTATGC
TTCAGGTAAACGAAACAATAAAAGCCATTCTTTTGCTGAGTGAAAACACTCAGCTGGGCTGGGTGTGGT
GGCTCACATCTGTAGTCCCAGCTACTTGGGAGGCTGAGGCATGGGGATCACTTGAGTCCATGAGTTCAAG
GCTACAGTGAGCTATGATTGCACCACTGCACTCCAGCCTGGGTGACAGAGTGAGATCCTGTCTCTAAAAA
AACACAAAACAACAACAACAAAAATCCACTCAGGGCCATGATCAATAATTTTAGCACATTTGAGAAGGAG
TTATCTCCGATGGTATGAGTTAGAGCAGTGACCTATTTTAGTAAAGGCTTTGAAATGCATGAAAGTTATA
AGTGGTTCCCAACTAAGCAAATCTGGGTTTTAGGTCAACAAGTTGATAAAGCTCATTTTCTTGTTCAG
TAACTGATTTATCACAGAGTAATCCCGCTGGATGCAGTAAAGGTCTACCGCATTTGGTGGCTTGGTATAA
AATCAGCTACTGCAATACCCACACATTTTAAAAGACTGTTTCTGAAACACAAAAGCATATTATATTAACT
ATAGTACATACAAAAATTGGAAAACAAGTGACCTCCCTTTACCTTAAACCTATTTAACCTGCTTTATTTC
CTTTTACTACCTAAACTTCTATTTTCATCTGAGTCTTAAACATTTTTATCTGGTCTTATTTTAGGCAGC
AAAAAATAAAATTGAACTGAATTGAATTACATTGGATCAAGTCCATTCCTTTCTGTTTTACTCCACGGCA
AGAAGCCATTTGTGACATGACAAATTACATCAGGGCAGAGTGGATGTCACAAATAAAAATGTGACCTGGT
ATCCAAACCAGAACCTTCTTTCTTGATCTTCCATTTTCTCTTGTCTTCCTTCTTTTTGGTGCAAAA
AAACATAGTGAATGGACCTAGACTCATCTAGATAGATGAGATGGAGCTACACCTGGAGATTGAATGGTGC
AGTCTTTTTTGTTCCAGGCTTTCATGCTACCCTTTGTAGCTGTCCAAAGTGCTCCATCTTTGCCAGGAAA
```

FIGURE 130 cont'd

```
TACCCTACTCCCAGCAGTAGAACTATGACTCCTTCCTTATTTCTTTCCAAACTAGGCTTCTAGTCCCTGA
ATGCCACAAGGATCAACCAGGTGTCTGATTTGAGTGACTAAAGCCAAGTTGTGAATAGCTGAAAGATTTG
GCCTTGAACACTTGCATTTCGAAAGAAAGCCTTGCTAACTCAAATGCATTCCTTAAGGCAGAGGCTGGAG
GAGGCTTCTCTGACACTTACCTCTACTTCAACATGTACTGGTACCCCCACTAACCAGGAAATAAATATAA
ACAACTAAATTTGCAAGTTGATATGATCCAAGGGTCTTCCAGACCCCAACATTGCTATCTGTTCTGTGAT
GCCAAGGAATTGGGTCAAACCAATGGACACTGCTGGTCTCTTGGTAGCAGGTGGTGGTTAAAAGAGAATC
TGCTTCTCTGGGAATTCAAGGTAACCCTCATAGGGTCATCATTACTGACAAAAAGCTGGCATCTCAGATC
CAGACCAGTGTGAGGCAAGTCAAGAAGGCCCTAATTTAGCTGTGCAAACAAAGCATTCCTGGGTTTGATA
CGACTTCATTCCCTGACTGGCAGTCTGAGCTTACACATGCAGACATAAATGCCAACACACATAATTTAAG
TGATGTATGGGGTTTGTCAGTGTGGCTACTGTGAGAGTGAGGTCCAGATGACCTCACTTGAGCCTGGCCA
GGGACCATGCAACCTCCCTGCATGCAGGAGGTGGAGCTACAGAAGGAGCCAGGCCATGGCTTTCCTTGGC
CTGCCCACCCAAGTCTCTTCCAGCAAGCTCCATGTCCTTGGACTGTGGCTCTTCTCTCCTCACTGCTATA
AAGCCAGCATTCTCAATGCAGGCTTTGTATCATGGTGAATAAGTGCAGTTTCCTGAAGAGGCATGTCAGG
GAGGTACTCTGTAAATATGGGCCTGGTACTGTGAGCAGACTGAACAGCTTGATAGCCTCTTTGGCTTGGG
GTGCTTTTGCAACTGAAAGAACATCCTCTCACAATTTCTCCCGCCCTGTCATTTCTCAGATCGCCTTGA
AGTGTGCTGACATTTGCAATCCTTGTAGAATCTGGGAGATGAGCAAGCAGTGGAGTGAAAGGGTCTGTGA
AGAATTCTACAGGCAAGGTTAGTAGTGATCCAACAGCTGAGATTTCATTGCCCTGTCTTCTTTTAGGCAT
TTATCCTAATAAAACAGGAAATGGCTGATCTATCATGACATTTGTTCTCTCATCAACTCTTGTTATCCTA
ACCTTTCTCTTTTACTCTCTTGGAACTCATCCAACCCTTTTCGGAAAAAGTTAAAAATAAATAACATTG
ACGTATTGACTTACTACAGAAACAGGTAGTAATGAGGCAAAATAAAAATGAGCAAAAGTGGGACATTGAT
TATAAATGGCTCTCCTCTGTGGATATAAGAATGTGTGGGATAGTTTGATTTTGACTTTGACCTTCATTTT
AATGAGCTGAGTGCAGCCTAAAGGCTAAATGTCATTTGAGGTCAATGTTTTCCACTCTGACAGAAGGACT
TAGACTCCTTTTGTATTCCTTCTCCTTGCTTTCTTAAAAAAAAAAAAATAATGAAATTGGACACAGCTGA
CCAAAAAGTGAGTTCTTCCTTTCAAATATAGTTTCAACAGTGAGGTAGAAGGATTTTGCTGTGAAAAGAC
AAATGGCCCTGAATTAGGGTATAATTTTTAAAAGATTAACCTCATTCAGAAATAAAGCAATGAATTAGCA
AGCAGGATCTTGATGTTGGGTGGGGTATCAACCTTTAAATACAGCCTTGTTTCTTCAGGCTGGGTTTCAA
TGTGCAGGATGTTTGTTCAGGCATCAACAGTGCCCTCATGCTAGTGACAGAATCAGGTTTGAGAGGCTGA
GAACAAATAAAGCTTGAAGTGTCCCACATACCAGCTCTGTGGGGAGGTCAAATAGCAACAGTGAGCCTTT
TGGAGAAGGCACCATTGAAAGATGTGTCAATGACATCGTGATGGCCCCAAAGACAGAAGAATTGATTGAG
CTCATGTGGGGCCAGAAGTCTCTACTCACTGTATCTTTCTCTCAGAATAAAAGTGCTCATGTAACTCCTA
CAATTCTGTATATAATTTCACTTGAATTGAGTAAAAGTGGTTAGAAATCAAAATCTCAGCTCTAGTTGCC
CCTAAATAAAATCTCCAAGGAAGGTAAGACAAAAGGAAACATGATGAAATTGGAGCTAGGGGGCTTTAAA
TTAGATATAATCAATATTTTCTTTACTGTTTGATATGTTGAATATTGAAATAGCATAGTGAGAGAGGGGC
TAAGATCTCTGTCCTTGCAAATCAAACAATGAAACAGAGGAAAGAGTCTACTCTAGCCCACTTGGTTTTG
ACTCAATCATGCCCAGCATGATTAAAGTACACAAGTCAGCATCGACTGCAGTGTAAACCTTTTATTTTCT
CATCTTGCACCTTATTTGGATTCTGAGCACCTTGGGGCAGGACCATGTCACTTATGTAGATAGTAAGGCC
CATAGTGCCAGTAAATCAAAGTTGTCAACTAAGTACAGTAAATGGTATCAACCAAGAAATGTAACCTATA
AGATCTCTTTTCTTGGGCCTGGTGCAGTGGCTCATGCCTGTAATCCCAGCACTTTGGGAGGCTTAGGCAG
GTGGATCACCTGAGGTCAGGAACTTGAAACCAGCCTGGCCAAATGGTGAAACTCAGTCTCTAATCAAAAT
ACAAAAATCAGCCGGGCGTGGCGGCACAACCTGTAGTCCCAGCTACTCGGGAGGCTGAAGCAAAAGAATT
GCTTGAACCCAGGAGGCGGAGGTTGCAGTGAGCCAAGATGGTGCCACTACACTCCAGCCTGGGCAACAGA
GCAAGACTCCGTCTCCAAAAAAAAAAAAAAAAAAACCCTTTTCTCAAAACTGCTTATTGTCCTAGTAATA
TATGCATGCATTATAAGATGGAAAAACCTAGAACATTTGTAACACTGATCTCTAAAGGCAGGCTTCCATG
TACCTTCCTCTGGCATGTTTCCTGGCAGAGGAAGAATAGAAAGTATATCTAGTCCTTTTATTTAATAGC
CTTATGGTCTAGTAGAAATTCTGCTTGTTTAAGAGAAGATTATAGGCTGGGCATGGTGGCTCACGCCTG
TAATCCCAAGACTTTGGGAGGCCAAGGCGGGCGGATCATGAGGTCAGGAGATAGAGATCATCCCGGCTAA
CACGGTGAAACCCCGTCTCTACTAAAAATACAAAAAAAATTAGCCGGGCATGGTGGCGGGCACCTGTAG
TCCCAGTTACTTGGGAGGCTGAGGCAGGAGAATGGCATGAACCCGGGAGGCAGAGCTTGCAGTGAGCCAA
GGTCACGCCACTGCACTCCAGCCTGGGTGACAGAGCGAGACTCTGTCTCAAAAAAAAAAAAAAAAAGAAA
AAGAAAAAAAAAAGAGTAGATTCCCTGGTCATCCAAACTGCCTGTCCTCCCTACTGAATTATTATTTTTT
TAATTCTATAAGGATGACTTGTGTCATTTTGATTTATCTTTCAGTTTAAGATTTGGACTCATCTCAGCTC
ATTCCAGCCTGCTCCTGGCAGGCAGGCTTCCACAGACTACTAACTGTCCTGGACAAAGTACCTTTAATGT
GATTCATGATGTTAAGCAAAGGAAAACCCTTAAAATCAAGGTTGAGGACACAGGGGGAAAGGAAACAAG
AACCCATGAATTAGAAAACTGTTTCATTCTCAGAACAGAGATTAGGACTCCAAATACCATATATCTCCC
TCCTCTCCCCGAAAAAACCTTAAAAAATTAGACTTTGTCCTCTTGTAACTACAGATTGATATCATCTCAA
CCTAGTTTCCTAGAACATTTTATTGAACATCTGCTTCCAGCCTTGTCTAATCCTCAACAAAACTGATTAT
CCTATGTGCAAAGCCCCATTGGAGATATTATGAAGAATGCAAAGAACTACAGGTAGTCTATGCTTTGTAC
TCTCAAAGTACTAATTAGTATAGTTTCCAGAGGAAAGAAACTATGCAAATTTCCCCTTTATATTCTCTAC
ATTGGTTAGCAAAGTGTCTGAAACATAAACGTGTTGAATAAGTGAATGAATAAATGATCTAATTGGAAAA
CCTCTAATGATAGTGGTCACAGGAGAAGATCCAGTACCTTGAAAGGTAGAATCTGAGCTCAGTTTTGAGT
GATGTGCATTGTTCTATACTTTCCAATATGGTAACAAGACACATGTGACTGGTTAAATTTAAATTAAAAG
```

FIGURE 130 cont'd

```
TTAATAAATAAAAAATAGAGTTCCTCAGTCTTGATCATATTTCAAGGGGCTGCCACAGTGGGCAACGTAG
AGAACATCTCCATCATTGCAGCAAATCCCATTAGAGAGCGCTGGTCTAGATAGAATGGAATGGAAACCAC
TGAGGCCGGGATGCACCCTGCCTTGTAGACCAGCTCAGTCTCATAGAAGATAAGAACGAGAGGATTGTGG
AGGCCCCTGGGCACCAGGCTACAGTAGAGAACATGACAATGGGAGTTATCTCAGAAAGTGCATTTAGGGC
AATATATACAGTTGAAGTGGAAGAAGAATTGGAGGAAGAAAACTAGCTAAGAAGCAACAACTAAGAATAA
ATTATCAACACACCAGACCAGGTTAAAGCAGAGTGAAAGGGGGCAAAAAAAGTTCTTCTAAGAGGGAGAA
ACAGGATGTGAAACAAGATTTAAGAGGAAGAAACAAGCAGGGACCCTTGCAGGGTCCCCAGCCAGGCTCA
GATGAGATGGAGGGTGAAGGGAAGGGAGAAGTCAAAGACAACTCCTCCAAAGTGTCACACTTGACTGAAA
AATCACTATTAACAGAATTACGGAGGTGAGGAGTGAAACTGGCTGTAGGAGAGTTTGTCTTAATATTATA
TGGTGTTCTGGCCTGCCCTCAGAAGGCTATGATCATCTGGAGTTGAAGAGTTAGGGTGGCCAGACTGCCC
TGAACCACTCAGGTTAAGCCCGAATGATTTCCTCACTTCAGCCTTGAGGATTACCAGGCACAAGAGACCC
CAGGAGGCAGACTACAGTCTTAAAATGACAGAACTGCAGCCTCTGTAGGGCTTCAGCTCAATGGTTAAGT
GCAGACACTTTGAAGCCAAACTTCCTATGCTGGAATCCAGGCTCCCCACTTTACTAGTGGTGTGACCTAC
TAGCAACATACTGGGTCAGCATTTAACCCTCCTGTGTCTCAGTTTCTTCATCTGTAAATGGGGATTAT
AATAAGGTTGTTATTTGGATTAAATTAATTAACATATGCCTGGGAGGAGGGCTCACACCTGTAATCCCAA
TGCTTTGGGAGGCTGAAGCAGGAGGATTGCTTGAAGCCAGGAGTTTGAGACCAGCCTAGGCAACGTAGAG
ATCCTATCTCTATTTAAAAAAAAATGAACAAAACAATATTAGCCAAGAGTGGTGGTACATGCCTGTAGT
CCCAGCTACTCAGGAGGCTGAAGCAGGAGGATCCCTTGAGCTCAAGCGTTCAAGGGTGCAGTGAGCTATG
ATGACACCACTGCACTCTAGCCTGGGTGACAGAGTAAGAGCCTGCCTCTTACAAAAAACAATGACAATTT
TTTATTAACATATGTAAAATGCTTAGAACGTGCCTGGCACACGGTAGTCACTATATAAATGTTGTGTTTT
TATCTCTTCTACTTTAGCAGAGTAGATTCATAACTGAACCTTCCACTCATTAACCAGATTGTTTTTTCCA
ACACAAAAATTACTCAATTTGTTATGCTCAGGAAGGACTGATGAAGTATTTCAATAAAGTTTTGTACAAT
ACATTTCTCCTTTGATCTTCTATTAGGTTGGTGCAAATGTAATTGTGGGTTTTGCCACGGAAAGTAAGGG
CAAAAAAAACACAATTACATTTGCACCAGCCTGATAGCTGACCAAGGCATTAAAAAAAAACATTTTGAGC
TGGGTGCAGAGGCTCACACCTGCAATCCCAACAGTTTGGAAGATGGAGGCAGGAGGATAGCTTGAGCTCA
GAAGATTAAGACTAGTCTGGACAACATAGCGAGACCTCATCTCTACTAAAAATAAAAATTTAAAAATATA
CATTAGCCGGGCATGGTGGTGCATGCCTGTAGTCCAAGCTACTTGGGAGGCTAAAGCAGAAGGGTTGTTT
GAGCCTAGGAGTTTGAGGCTGCAGTGAGCCAAGATCATGCCACTGCACTCAAGCCTGGGTGACAGAATGA
GACTCTGTCTCAAAAAGAAAAAAAGAAATACCATTCTGACCTTTATACTTTTTTTCACCTTCAGTTGCAT
TAGGTAAAATTCTAAGGAATCAGAATGGGAGATTCTGATTAATTTTGTGGTTACAGAGTGAGGTGCTACT
CAGATGAGATCTTTCTAGTCCTTCTACCTCATTTCCTACCTACTTACTGTTCCTGGTTGTCCTCAGGTGA
AACAAGACTAGGGTCAGGCAGCGTGAAAGTAGAGGAGGGAGAAGGAAGGACAAAACCTGTTTTCTTAACC
TGTCACTTAAAGCCATAACTTTTATTTCATGTGAGGAAATTTCTCATTTGTTTTCTTGTTTTTGTAGGTC
TTGTTCAAAAGTTTATTCTAGTCCCAGAGCACACCTACTAGCAATAAGCCATTATGAACGGTCATTGGCA
CTGTGGTATTTTAAATTTTTACGGAAACTACTGAAGTAAGGCAGAGCAAGTCGGTGCTGAAGGGTCCCTA
AGGGATAACAAGTCAGGAAACAGTAATTCCCAGAATAACTTCTTCCGACGAGGTCATTAAAATTATTAAT
ACTCATTTTATAAGTTCTAGATTACCAATGTGTTTTTTTCTTTCTTTCTTTCTTCTTAGGTGAACTTGAA
CAGAAATTTGAACTGGAAATCAGTCCTCTTTGTAATCAACAGAAAGATTCCATCCCTAGTATACAAATTG
GTGAGTTGAATTCAGTGTTAATTCCAAATAAATACCTTTGGCACATCTCACAAAAGTGACAAAGAAAAGA
TCTAAACACAGCTTTCAAAAGATCAGCACTGGAGGTTTAATCAACATCCTTTTGAATGGCTGAGTCCAAA
TTAATACTTTAATCATGACTAATCTACTAGCTAATTATCTATTGAGAACTTATGAAACCTAGGATCGAAG
CTTTGTTATAGGCCCTTAACTAACTTGTATTATTTTAATTTGGTAGTTTAGAATAGAATCAAAACCAAAA
AGAGTAGAAGAAAAGTAACAGGAATCAACTATTCATACTCTCTGCAGGGCTTGAAGGTGGGAATCAGCAG
AATCTGCCTTTAGGACCCTTCCAATCTGGGTCGCTACCCCTCATCCCTAATGCTCGCTCCCAAGAACCCA
ATCTCTAGGCCTAGAGCTTGTGAGCCATGCTATCCCGCCGCATCCTGGGATTCCCAGTTTCACTAGTCCT
TCCTTCAAAACTTATTTTCAGGTTATTCTCCTAAAACCACACTCTCTTTCAAGTGTCACTGGTGGGAAAC
TGTTGAAGTATGATGCCAATGCATCCAAAATAATTATTGCTTTATCTAATTAAGTTATGCATTAGACCAA
GAAGCAAATCAAACTGTGGAAATTTTAGGCACTTTAGCGGAGGAAATATTTTTGCTTCGGTAAGACTTTC
TATCACACCTTAAGACACTCCATCACGTCCACCCACCTTTAAAGCAAGTCTTTCTTTTCCTTGCAGTTCC
CTTCCATTGAATCCGAACTCAGAACTTTAACTCTTTTCCTTATAAACTCTGACCCTGACATGTACCAGTT
CATGTTTTATACCTGTTCCTATAGACTTCAGACAGCTGAACGCATTCACAGTGCTACAGACCTTTGCAAG
GCTCAAAGTTTAATGCTTTGACATTGGTAGGGAAGGGGGTATCTGAAAACATAAGCTGAAAATTAAGAAA
ACCAGGGTAAGTTAGAATTACATAATATCACTGAAGGTCAAATCTAATCCACCGTCCCACAGTGGAGTCA
TAAAATCATCCTCAGGAAATAAGGACAAAATAAATCTAGCTATAAAGATTTCAATGGAATATACAACTAT
TAAAATAGGTATGTTCGATTATTGAGCATTTTTTTTTTCAAATTGTCCTTAATATTGTTATGTAGTTTT
CACAATCAAACCAATTCCTCCACCCCAAAGCTGGGAGCTGGGATGGTGGCATAGAAAAAATACAACCCA
GAAAAGATAATACAGAGTTGCTGGGTGGCTTGCAAGGGAATATCAGCAACAGAAATGCAGCCTCAGCCTC
CTGGGAGGCAATTCTCTCCTATCAATTGCCTTAGCCATGGAGGTTCTGCAGACGTGATTCAAAATTAGAT
GCTAACCAAGTCCTAATCCTGAGGCTCCCTGTGTTAAGCTCCAGCTGGAAAGAAATTTACCAGGCAACT
GTCAATGACATTTTGAACCCCCCAAACAAAGGACTCACGTGGTTCAGCACACAACCTGGATTTGTGAGA
CAGACCTGATTTCAGAGATTCTGTCCTGTTGTTGTCATGAGAACACACTTATTTTGTCAGATCATATGTC
```

FIGURE 130 cont'd

```
CTGATTTTCAGCTCAGGAAAATGTGGTTACCATAGATACCTCTTTTAAAAGGGGCTGGGGGTTGAGTGA
ATAGGGAAATCCTATGGATGCTACACCAGCACACCAATAATAAAGAGAAAGGGAAGGTGATTATAAAACA
ATCCTTAGTACATAGATCTTTCTCTGCCTTTGCTCCACATCTGCCAGCTCGTAGAGGTTGAGGGTTGGGA
AGTGGGGTGGCAGGGACAGATCAGGCTAAGCCAGAAAAATCCAAAGAGATAAATGGAACTTGGTGGATGC
TACAGGCTCTAGCCCCCAAGACAACAATTTTTCCAGTGGGTCTTCAGTAATGCAGCTATTTCCTCTGTCC
TTATTCCTCTCTGACTGAAATGTTCCCCTGTTTTCCTGCCTCAATCCAAAATGAGAATTTTCTGAGATC
TACTCTCAGGCTTAGATCTGATTTTTCTTTTTAAGTAATTTATATCTACCCAAGTGGAACTAGGGCTTAA
TATCTCCTCCCCAACTCCACGCTTCCCTCTCTCTACCAAATTCTACATTTTAAAAGGAAGATATTAGCCA
GGCGGGGTGACTCATGCCTATAATCCCAGCACTTTGGGAGGTTGAGGCGGGCAAATCCCTTGAGGCCAGG
AATTCAAGACCAGCCTGGACAACAAGGCAAAACCCCATCTCCACAAAAAATACAAAAAAATAAAATTAGC
TGGGTGTGGTGGCATGTGCCTGTAGTCCCAGCTACTCAGAAGGCTGAGGCAGGAGGATCACCTGAGCCCA
AGGGGTCAAGGCTGCAGTGAGCCATGATCATGCTACTGCACTCCAGCCTGGGCGACAGGGTGAGACCCCA
TCTGTTAAAAAATTAATTAATTAAAACAAAAAAAGGTATTAAATCAAATGAAGCTCTAATTGGTGAAATC
TATAGAAGGCTAAAGAGAAAGAGGTTTTCCTTCAATCCTTGTCTACTCTGAGGCTACCATTCCTCCCTAC
TCCCCCTTCCTCCCCGCAACCCCCCGTCACCCCACCATCCCTCCAGGAGGACAACAGCCCAGCAATGTCA
GCTCATCCCTTGAGAAAAGGGAGGTTGGCAGAACACACTGATGGAACAGGTTTCCAAATCTGATAATGTG
GAAGCCTTCCTTAATTTGAAAAACTGCCTCTTGGTGTCTATTCAGACTTTAAAATCAGTTTCCTACCTAG
CATAAGAAGTCTTTATATCTGAAAGTATAAATACAGATATAGTGCCAGGGTCACTTAAGAAAATGAGGCT
TTTCTTTTTTTCGAGTTGGATTTTAAAATGTTGGATATTTAACTTTTTTATACTGAGATAAACTTGATAA
ATATTCACACTTTGAACTTCAGAATAGTATAATTTTGCAAAGCGTCTTTTTAGATATCTAATATCTCATC
TCTTTGAAGGTGAATGATATTAGAAATTAAATATGGAGATTGTGGAGGAGGTAAAGAAAATTCAAGAACA
GCAAGCAAAACGTGAAATCCTCATCTGCTGACACCCTGTACAACCTTACCAAAATTCCAAATACAGACAT
CAAGTCACTGGTTTAACTTTCCCCCTCCAGTTCAGGTTCTCTACTATGATCTCACAATCTTTAAATCATA
TTTCACATAAGATGAGACAATGCAGAAATGTACAATAACAGTGTGTATTGCTGCATCCCTCTTCCATCTC
TATGGCATTCTCAAAGGCCAAGTGTCTGCTGTTTGTCCAACAGAAAGATAATCAAACCTATCCTTGTAAT
TCACATGCCTGTAAACATACAGGATTAGTGTTGGAAATTTTTGTTAGGCTGAAAAACATTTGCCTTTCTC
CCCACAGCTACACATCAAGGAAATACAACAAAACCTAAATAAGTCCAAGTTTGTGATGATTCCAACAGTT
CTTAGACTGAAAGCTATCTTTTCATAATAAACAAGTCATGTTTATTATGAAAAGCACATTAACGCGGCAA
AACGCGATTAGAAAGTAACAAATCTTAAATATGTAAGAGAACAGACATGCAAACAAAGAAGTCTCATATC
AAACAATCTTATCTAGTCATTAAAGCTGGACTTTCATACAGGTAAAAATCTGTATTGAAATGAGTGAAC
TTTAAACTTAGTTATTTAACATAACTGAAAGCAAGACAGAACTGTAAAATGATCATCTTGAAAAAGATAT
CCCACAGGGTAAGGGTATGAATTATGCAGCTGATCTAAATTCGTGAGGTGTCCTTTTCTGGTGTCATTTG
CCCTCTCCATCCCTTCTCCGCCTGCCTTCTTTAGCTCCAGCATACACTTTTTTTTTTTTTTTTTTTTTTT
TACTTATATGTCTTTCTCCCTCTGCAAGTAATAGCCAGTATTCACTGGGAGTTTACTATGTGCCAAGAGT
TTTCTAAGCATTGTACATACATTAAGTCATTTAATTGTCATAACAACCCTACGAGTTTAGTATTCTCTTT
AGCGTCTTTTTGCAAGTGAGGAAACTGAGGCACAAAGCCATTCAGGGACAAGCCCAAAGTGACACATCTT
ATGCTCCTAGGCTGAGGGTAGCCACCATTATCTTGCTTGCCCTTCTGGCCCCAGAGCTGGAAATTTTTAT
TAGGCTGAAAACATTTGCCATTTCTCCTCACTGGTACACATCAAGGAAATACAATAAAACCTAAGTAAGG
CCGGGCACAGTGGCTCAGGCCCGTAATCCCAGCACTTTGGGAGGCCGAGGCGGGCGGATCACTTGAGGTC
GGGAGTTCAAGGCCAACCTGGCCAACATGGGGAAACCCCATCTCTACTAAAGATACAAAAATTAGCCGGG
CGTGGTGGGTCCCCAGTCATGCTCGGGAGGGAGTAAGGAGCGGGTTTCACCACGCTGTGATGCTGAGCCT
TGACTTGCCTGTTCTAGGTTTCATGAGCTACATCGTGGAGCCGCTCTTCCGGGAATGGGCCCATTTCACG
GGTAACAGCACCCTGTCGGAGAACATGCTGGGCCACCTCGCACACAACAAGGCCCAGTGGAAGAGCCTGT
TGCCCAGGCAGCACAGAAGCAGGGCAGCAGTGGCAGCGGGCCTGACCACGACCACGCAGGCCAAGGGAC
TGAGAGCGAGGAGCAGGAAGGCGACAGCCCCTAGGGGCCGGCCCAACTTAGACGCGGCTCTCCTCCGGCA
GGGCCCCCAGAGGGCAGAAGCAGCGTGGAGGGCCCTCACGCAGCAGCCCAGCCACTTTCTGAGTGTTGT
CCTGGGGCTCTTTGGAACGCCATCTTCCTCCCACTTACCTGCCTCCCCTCCTTTTCGCAAATGTACAGAA
GCCATTTGTCACCTCAGCATTCGCTGCCGAAATGAGCAACTCCATTCAGTAACGTGGGAGCTGATCCCAC
GGGCAGGCTCTCCCTGCTCCAGGAGAAGACTAGGAGGAAGAATGAGGTGCTCCTGCCGTGTCCGCCTTGT
TCCGGGTCGCACTGGAACAGGCAGCAATTCCTAAGTCCGGAGCGTTTGAGCGTTTGCTATCTGACTGCTG
ATCTGCGTGACAGAAACACCAGCATATTTGCAACGCCAAGGATATTGGTCTTAAGTGCAAGAGCACAAAT
GAGAGTGTGAGAGAAAGTACCTTCTATTTTAATAATAATATTATTATAAAAATAATAAATCTTTTTAACT
TTTATATTTTATGCACTAGACAATGGATCTGCAACTTTGGACTAAGGTCATTCAATGTACCCAAACTTGA
ACAGGGGGTTCATTGTTTTGCTATTGACTTTATTATGCCACTTTGGGGCAGAGACTTGGCATCTTCGCAG
TTTAAGAAACCACGTTTCCTATCCAATCCGAAGGGAAGGTGCTGTACAGTTCATTCCTTTGCACCATTAG
CCAATCTGTCTTTTATGGATTCTGTGACATGTTTATATTCACCCATGTACATTTTCTGTAAATACCAAAC
GCTACTGATTCCCATGCCAAAATACATGAGTATTATGGGATTGCTACCTGTATAAACAATGGCACTGTGA
AAATACTGTTAGTTTTAATACAAGAGAATGCATTTGTAAATATGGTATAGAGTTTATTAATATACTATTG
TTTGCAGATAAAGGCCTTAACTTTAAACATCTTTCATCTTCTGAAAGCTGCCCAACTTAAATCCTCATAG
ATGTCTTTCTCAACTGCCTTCCCATGTTCATCTGTATGTTTTCCAGCTAAGGTCACAAACCAAAACTGAA
TAAAGTCTTTGAGGAAACATTTTGGAAACTTCACATGCATTCCGCTTGAGACCATAGTGTTTAATCTATG
```

FIGURE 130 cont'd

```
GCACCAAGCATCGTTTCCTCAGATTAATGAGACCCTTCAACAAGCCTGAATCAGTCACTTTTCAACACAG
CGATGTTTTAACAAGCCAGCTGCTAAGCTTGTGTTTATGTGACTCTTGTTACAGATCATGGCGGTGCGTC
AGCCTCACAGGAGACATAGCAGGTCTCAGAAACCTTCTATGACCCTGTCATCTAACCATCAGGGAATTCC
CTGCTCCCATGCCACACATTTGTCTATTATGGCTATAGTACCAAAGTACTTTTGGTGTTTGGTTGGTGTG
CATTTCTTTAGTGTCGATAGTAACTGGATTTTTCTTTTTCCTTAATCTCATGTGAACAACTACCCAACTG
TTTAGCTGAAGTTCATATTATTTAAGTAAAGAAAATATTTCAGTTTTATAACAGACTTTACCTTCCTGGC
AGGTCATTGTAGTTAATTATGTCTCTAGCTTGGAGTGTCACCTTGGAATTTCGTTGCCATTTTTCTCAG
ACACCTGGCCGTAAAATCAGTTTGTTACAGCATTCTTCTCTAGGCTGCTAAACGCTGTGCATTGAACCTT
TTCTTTAGAAGTTTCAGCGTAACTAATGTTAGATGAAAATTGTTGATGCCCCTTTCTTTTTACTTTAAAC
AATGTGGTAGTGGGAGAATGACTGTTTCTGCCACTATCAACCTGATCCTCATGCTGATAGAATGACAGCT
AGCACTTATTTCCTAAGTGCAACTGTTTTAGAGATTTTTCTCCTAACATGCAAAGGAAATACTGATTGGC
CTATAATAAGTTCCTATAGGGAGACTGAGGCTTGCAGAATTAAGGTTCAGGGGAAATTTTGGAAAGTTGG
TTGTATTTTCATTGAAGTAGGAGAGATTATCAGATGGTGCTAAAGAAAGTGTGAAGATCTTATGAAATAG
GTGGATGGTAAGTTGAAATTATTGATGTGGGTAAGAAGGGAGGTTGTGGAAAGTTAACACTAGCTTTGTA
TTTTTTTTTCTGTAAAACTGTGAACTGATATATTTTCCTTTATCACTTTAGTATTCTGCAGTTCTCAGCT
TGGTGAGGCTCCAAAAGAGAATATGTCAGATGTATTCCTACTTCCAAACCTGTCTTACTTTGGTTTGATG
GTACACATAGGGCTTTTGAACAGTCTATTTTTAATGTATATGAGGTCAAATCAAGGAAGGCAATTGCTGG
GGACAAGAAAGTAGAGGTAGGAAAGAAGACACTATTTTAGCTAATGGGGTTTCTTGGGACTAAAAAATG
GCTTTGTTTAAATTATAATTATATAATAATTTAAATAAATGAGATTGGAGGTATTCTTAGTAGTTCTGAG
TTGATAGTTTACATTACAATTAGGTCTTGAAGAAGAGCTCACAGAGAAAAAACTACCAAATATCCAATGG
GTAAGCCCATGATGTAGCCACTAGTACAATAAAAATCTGAAGTAAAATGAGGCATAAACTTGATGCAGCT
GCCTCCCTCATTCAACTGGGGAGTTCTTGAGTTCCTCATTTGTTGGTAAAAAGAAAAAGAATGTGAAAAT
GTCTCTTTTTTTCTTGGCTATTAGTGGCTGTCTTGCAATATTTCAATAGGAGTCCAATTACTAGTTAAAA
CACTGGCGGGGTGCGGTGGCTCACGCCTGTAATCCTAGCACTTTGGGAGGCCAAGTTGGGCAGATCACAA
GTTCAAGAGATCGAGACCATTCTGGCCAACATGGTGAAACCCCGTCTCTACTAAAAATACAAAAATTAGC
TGGGCATGGCAGTGCGTGCCTGCAATCCCAGCTACTCAGGAAGCTGAGGCAGGAGAATCGCTTGAACCTG
GGAGGTGGAAGTTGTAGTGAACTGAGATCGCACCACTGCACTCCAGCCTGGCAACAGAGCTAGAATCCGT
CTCAAACAAACAAACAAAAAATCCCACAGCTATTGGATCATCCACAGATTTTTCTTTACAATCTTGTTC
TCCTTGTCCATGGACCATCAATAGTTGACTTGCCAGGTTTAATTCTTTCATTGCTTGAGAAGAAAGGAAT
CAAAGGACTGTGTGTAGTAAGCTGACGGTAAAGTTAAGATTAAATTAAGACAGAGAGAGAATACATATCA
CTGCCAGGCCTGATAGGAAAAATCTGCTCTTCCTTTTAATAACAGTGATGAATTGTCAGGACCTTATTTA
GGAAACCCTGACCTACCCATAACTCCCTGCTAGGCTAAGTAGAAACCAGGTTATTTCTCCCTGCTTATGG
CTCCCCGCAAAGGGACTTGCAGCGTGTCCTGCAACTTTGTCTTCAGATAGTGCTTCCTACAAAACTAGGT
CTTGTTTTGTAATCTTTTCTCGTGTTGAATCAGATCTGCTTACTTATTTAGGTTTGGTTATGAGCTTGTA
TCTCACTGTATTTCTCATGCTTTGTTCTTTTAAACAAATCCTTTAAACTGTGTCATTTTGTATACACATG
TGAGGTTTGAAAAAAAAAAAAAAAAAAAAAGAACTACCTTGTGAGTTTTGCTCAAAATGTGGCCTAAGT
AGCCATTGGCATGTCTAGATGAACAAATAAAAATAAAGATAATTTCTTTAAAATATCACAAGATGAAAAT
ATCCTAATTCTCACCAGGTAACATGTTACCAGTCAATGAATTGGATTCAATAAAAGGATCCCACTGCTCA
GGAGAGGAAACATTCGAGGAAAGAACACAGATGCAAACATGGCCCACGTGACTCATTCCACTTTGGGGGC
TACAGAAACGCCCATGTCCATGAAGGTATCACCTGCTCGTTAGTGCCAAGTTAGGGAAACAGGGCCACCA
TTCAGCTTTACATTTCCCCAGAGTCCTGATATTTTCTGACTCATATTTGTCAAACTCATATGAATGAGA
ATGAGGTACAATGTTTTAAGTTGTAAAAACATAGCCAACTCAGGGCAAGAATTATTTGTGAAAAATATGG
TCTCACATTTCAGGATTACTGGCCATGAAGAACAATAGAACAGTTCAGGCAGAACTGTTCTATTCTAAAT
CTGGTATTCTAAATCCATCTGGAAATAGAGAAGAAGAAGAACACTGCCAATGTTTCCAATGTTTTCTTGT
ATCTTTATGTATTCTCCCATATTCATTTTATTAAGATCTGTGTTCAGAATCTCTCTGATTCCTTAATGAC
TCCCATGTTTGAATGCAAAGCTACTTTTTCATTTGTGGATGTTCTATATCACAAAGCTAATATCAAAAGA
GATGCCCCACTAGTATTTCATGTAAAGGTCAGGCATGGCTTTCAAATGTACACGGGAACCTAGCTGAAAC
ACTGTCAAATAGGCCAAGCCTACATGAGCACTTAGATTTCAATTAAAGAAATACTTATTGAGGAGCTACT
ATGTGCCAGACATTGTGCTAGATATTGGGATTTAAAAAGACCCAGTCCCTCCAGGAGCATTCAGACTTGT
GCCAGAGACTGGTGTTACCTGTGAACACTTCTTAGAGAATTTGTGAACAGCTATGATTGCTCAAATGCAG
CTAAAGCTCCCTCCTGGCATACAACACAATAGAAAGCAGATACACTTCCAACACAGAAATGGATCCCAAT
CCTAGTTCTGTCACTAACTTATCCTCTGACTAGACAGAAGTTACTAAAACTGCTATAAAATTATTTCAAG
ACAGCTGGGTGTGGTGTCTTATGCCTGTAATCCCAGCACTTTGGGAGGCCAAGGTGGGGGGTGGATCAT
GGCGTCAGGAGTTCGAGACCAGCCTGGCCAAAATGGCGAAACCCCATCTCTACTAAAAATACAAAATTAG
CCAGGCGTGGTGGTGGGCTCCTGTAATCCCAGCTACTTGGGAGGCTGAGGCAGGAGAATCACTTGAATCT
GGGAGGCAGAGGTTGCAGTGAGCCAAGTTTGCGCCACTGTACTCTAGCCTGGGCAACAGAGCAAGACTCC
GTCTCAAAAAAAAAAAAAATTATTTCAAGACAATATTTTTTATAGTATTGTTGTGGCAATTAAAGAGTT
GGCATACAAAAAGGCATCAAGCCTGCTCGCTGGTACATGGTAGATGCTCAATAGATACAGGTTCTCCCTT
AAATTACAAACAACTTGCCAAATAGCCGTTCTTGCATGAATAAGAATGGGGAGAGTTTACAGTGGAGAAA
ACACAGTAAAGAGTTGGTTTCACATTAGGAAGTCAAACTTCTAATTAAGCCAGAGAGATTATTAGAAAAA
AAAGTTTAAGTTGTAGCTGATAATGGTTTGAAAATGTAAGATTGGCTTGTCTTAGTCATCTAAGCAATGA
```

FIGURE 130 cont'd

```
TGCATCATTGATTCCATTGCCTGAAATTCAAATTCTCATATTAAATGTGCTGATATAATCTTTAGTATTT
TCTTTCCTTTTAAGGAAGCAGTGCAGTAGGGTTTTAAAAGCATTGTCAGGGCACAGTGGCTCACATCTGT
AATTGTAGCACTTTGGGAGGCTGACGCAAGAGGATTGCTTGAGTCCAGGAATTTGAGACCTGCCTGGGCA
ACCTAGACCCCATCTCTACAAAAAAAAATTTAAAAATAATACATAAAGTGTTGGCTTTGGACTGGGTACA
GTGGCTTACCCCTGTATCTTAGCACTTTGGTAGGCCAAGGTGGGAGGATCACTTGAGGCCAAGAGTTCAA
GACCAGCATGAGCAACACAGCAAGACCCCTGTCTCTTGCTGTAAAAAGTAATTAAAAAAAAAAATGTGGG
CTTTGGAGTCAGACCAGAATTTAAATCCCTCATTATCATTAACTACCTAACCCTAGGCGATTTATTTAAT
CTCTCTGAGCCTCCATCTCCTCATGCATAAAATGATAGTAACATCAACCTCCTGGGTGGTCATGAGGATG
AAAGTAAATAACATACATAAAATATATAGCATAATTTCTAGCAAAAAGGGAGTACTCAAAACATGTAAAT
TCCTACATCACTTAAGGAAAAAATATCTACAAAGTGGAAGTTAGGATGCATCTTTCACTTTCTATAGATT
GTGCCAATTTTTGTGCAAATGAAAACAAGTTGCATTAAGAGAGACTGACAGTGACTCTATCTACAGGTGG
CCAGGTCGGTCATAAAAATAATCCTTGTATTATGGACAAAAAAACTATTTTAAAATGTGATTCAAGAAAA
AAGACAGTGACCCAGAGGTGCTAAGGATACACTGGTAAGACCAAGGACAAATAAGGGACTATTTCTTGTG
GTTTTAAAGTAAATATTCCTCAGCTCAGCGAGAGAGAACTAGTCCATCTGGTTAATCTAAGACTTTCCTG
GAGTTGACAAGAATACAACCCTGGCTAGACAGAAGCATTAGTTAAATAAGCAAAACTTGATAACCTGTCA
AGTTTTCATGAAGTCCATTCAAATCCTACAATTCCTATCCATCAGAGTTCCTGGTAGCCCTTTCCCTTGC
CACCTCTTCATCAGATCCTTTCTGGCCACTGACAATAGAGGCTGAAGACTCCCAGGCAGTCTCTGCAAGT
AGGTGGCCCTGGGCAACATAGGAAGACCCCATCTCTACTAAACATTTTAGAAAATTAGCCAGGCATGCTG
GAGCACAGCGGCGGTCCCAGCTACTTGGGAGGCTGAGGTGGGAGAATCGCTTCAGACCAGGAGTACAAGG
CTGCAGTAATCTATGATTGTGCCACTGCACTCCAGCCTGGGTGACAAGACTTTGCCTCAAAAATTTAATT
TAATTTAATTTTAAATTTAAAACTCAATTCTAAACTAACATTTTCCAAATTGCATAAAAATGTATGTGCC
CAAAGATGTCTGTTAAGTGTTCCCTGAAAAAAAAAAATGGATTCGTAGCCAAAGAATTATGAGAAACGAT
GAATTAAAGACATAGGTTTTGCTCAAAGATATTTGTTAAGTGTTCTCTGGGGGAAAAAATGGCTTCATAG
TCAACGAATTTTGAGAAACAATGGATTAATACATAAGTTTTGCTCAAAGATGTTTGTTAAGCGTTTCCTG
GAAAAAAAAAAAAAGGCTTCATAGTCAAAGAATTTTGAGAAACAACGGATTAAATGCGTAGGTGTTGCTC
CTGTCTGCTTCCCAGAACTCTCAAGTGCTAATGGACATCTTCAACAAGGTGATACAGATGACATTGTCTG
GATCTAGTTTTGATTTCTTATCACAAAAATCTTCCTTAACTATTGCAACCCAGGATGATCTATCATTTTA
TCATTAGTGATTGTTAGCTGTTTTGTATTGTCATTAATGATGTATGTGTATGTGTTCTGCCCAATTTGAG
GTATAATTTGGCATGGTGGTTAACTTGCCCAAGTTTGTGGCTTGACTTTACCACTTAGTAGGTATCTGAC
CTTGGGAGAGTTTTCAAACTTTCTGTGCCTCAGTTTCTTCATCTGTAAAATGGTGATAAAAATATGACCT
ATTTCATAAGGGTTTTGAAGATTAAGAGTTGAGGCATGGAAAGCCCTTTGAATGATGCCTGCCACAGAGA
AAGCACTAAGTATTAGCAAAAACCATTATCTTCTCCCTTCATCCCCTCTTGACTTGACTTGTAAGCTCT
TTGATAACAGGGATAACTACCCTTTTAAAAACTACTCTTGGCTGGGCACAGTGGCTCATGCCTGTAATCC
AAGTACTTCGGGAGGCCGAGGCAGGTGGATCATGAGGTCAGGAGTTCAAGACCAGCCTGACCAAGATGGT
GAAACCCCAACTCCACTAAAAATACAAAAATTAGCCAGGCGTGGTGGTAGGCACCTGTAATCCCAGCTAC
TTGGGAGGCTAAGGCAGGAGATTGGCTTGAACCCAGGAGGCAGAGGTTCCAGTGAGCTGAGACCACACCA
CTGCATTCTAGTCTGGGTGACAGAGCAAAACTCCGTCTCAAAAATCAAACAAAAAAACTATTCTCCATAG
CGTAGCACAGGACATACTGAATAAATACGTCTTAAATGAAAGAACACATTTTTGACTGACAAATTGGAAA
TCATATCAGATTATGTTAACATTTAAATCCAAACAAGTAAACTCCAATTGTAACAATGAATGTCCCAATA
ATTTGAATGCAGATGCTGTTTTTTCAGGTCCACAGTTGCTATCTGGTAGACCTTTAGCGTTTTGAAGAAC
ATAGTTTGGGAAAACAATAGTTTTTTCTCCTCTCAGTTTATGAGCATACTCTTCTGAGTGGTGACAGTAG
AAATAATTTCTCTGAAGGACTTGATATCCAAAGATCTCTAGATTTTTCTCTATCCAACTGGAAAAGAAAC
CTACAGAAACACCACTAAATTGCTTCCTTTGCGGGACAAATATGAATCTATTGTAATGCACAATCCAAGA
GGAGACAGAGACAAATCCCAGTGCTCATCTTTAAAAAAGAACAGGGAATGGCAGATGAGTCTCTTATTTT
ATCCTTGTTAAAAGCACTTCAGATTACACATAACCTACTCCTACTCTTCTTCCCAGTAAGCAATTATATG
TGCATTTTTTAAGTTGTCAGCAAAGTAAGCCTAATGGACCAAAATGTATGATCAGTTTTGGGGATTATTT
ATTTCTTCCTTCTTCCCACTGCTATAATTTACTTTGAGCCTTTTTTTTTTTTAACAGGAGAGTCAGACT
TTACATTTCAATGAATTCATTTTCTCAGAAACATCTGTCTCAGTCCACATTTGAAAAAAAAAAACTTCTA
CATGAAAACAAAAGACCTATAGTGTTATAGAACAGCATAAGTGAGAATTATACTCTGTAATTATCAGTTT
TCAAGTATTAACCTTACTGAGATGGAGACAACAAAAAGTTCTGATCTTTCAATACTTGAGTTATGTAACG
TTCTGAAATATTTCTGAGATGCCTCTACTGACTTTAGTTATTAAAAATGTGTTATTTAGAAATAGCTTA
TCAAAAAATACCTTTTGGCATCTGGAGCTTTATCTTAAACTCTAACGGGAAGCTTGAGATTTTTTTCTC
TTATCAGTGTGGCTTTTTGTTGTTTGAGACCGAGTCTCGTTCTGTTGCCCAGGCTGGAGTGCAGTGGT
GCAATCTCGGCTCACTGCAACCTCCTCCTCCCGGGTTCAAGTGATTCCCATGCCTCAGCCTCCTGAGTAG
CTGGGATTAGGATTACAGGCACATGCCACCATGCCCAGCTAATTTTGTATTTTTAGTAGAGACGAGGTT
TTACCATGTTAGCCAGGCTGGTCTCAAACTCTTGACCTCAAGTGATCCACCCTCCTCAGTCTCCTAAAGT
GCTGGGATTACAGACCCGAGCCACCATGCCCAGCCTCCGTGTTTTTTAGTAGTAGGTTTCCAGTTCTCA
AGTATGATTTAGTGAATGTTCAGCCCCACCACCAACCTGCAGAAATGTCAGGCAGCCAAGCACAGGCCCT
ATCCCCACAGTGATTGTCTGATCACTGCACAGACTGTGAAGTCCCCAGGTACCAGTGCCAGCCTCTGAGG
AGGATAAGATGAGAAGAGACTTCAACAGGGTGGGCAGGCCACAGTGCAAGGGCTGCGTGCCAGGACCTCA
TTCTGCTGAGAGTTGGGGTATGTACAAGTGTCATTGAGAAAGGCCTAAGATTGTGGAGGGAGGTGGGTAA
```

FIGURE 130 cont'd

CCTGACTTGAATATCTAAAAGGTATGTGACATGTCAATAAAGCTTCATTTGGGCTAGCAAGCAAACCAGA
AGCAATTAACTAGACATCACTGTTTCTTCTTGGTATAGTCAGAGCTAAGTGTTCTAGGAACACTTAAACA
TTTTTGTACATATTATTGGTAAAGGCTCTGACCAGATGTCAATGATATTGGCAAACTTTGTCCATATAAA
TCAGGTGACTTGTAAGAAGTGTTCACTGAGGCTTAATTTTATTTCAGAAACAACGGCATTACTGCCTAGT
TTACAATTTATAGTGAGCATTAGAGCTGATGTCATATGTTCCTTGCACTGTATTGACACGTGTGAACAGC
AGGCATTGGCCAGAAACAACGCTGGTGCCATCTATGTTCCATTTGCAGCAAGAGATTACTCAACTCTTAC
TCTAACTCAAATGAGACTGTCAACGAAGATAGGAGGCATGGAGGAGAACTGACAAGAGGAGAAAGCTTAT
ATTGATTCCGTATCCTGTGAGGGAAAATAAGCATTTAAGGAAGAATAACCAAGATGAATCAAATTACTCA
CTGAGTATGAGTTTTCTAGGGCTGCCCTAACAGATTACCAGAGTGGCTTCAAATACAAAAATGTATTCTC
TCACAGTTCTGGAGGCTAGAAGTCTGAAATCAAGGTATCAGCAGGTCTCTGAGCTCTCTGAAGCTACCAG
GGAAGAGTCCTTCCTTCCTTCTTCTAGCTCCCAGAGCTCACCAGAAATCCATGCCGGTCCTTGAGTGGTG
GCAGCATAACTCCAACCTTTGCCTCCATCATCACAGGCCTTCGTCCCCATGGGTCTGTTTTCCCTTCTTA
CATGGACACGAGCCAGGGACTAGGGCCCACCCTAATCCCATATGGCTTCATCTTAACTAATTACATCTGC
AAAGACTATTGCCAAGTAAGGTCATATTCTGAGGTTCTGGATGGACAGCAACTATAGGGGGCAGTATTCA
GCTGAGGACACCTAGACACTCCTCACTCCTCACTCACTCACCCAATGCTTTACCTCCTACAGACACTCCT
CACTCACTCACCTTTACCTCCTACCCATCCCCGGTACACATACACACATACACACACACACACACACACA
CACACACACACACACACAGTCCATACGCATCTGTCAGACTCTTTAACTTTTTATTTGGAGATAATTGT
AGATTTAAATGTTCTCGTAAGAAATAATACAGAGTTGGAACTTGGGGGTAAGTAGTCAAAATGAAAATAA
AAGAAATAGAGAAGCTGAGCACAGCTGCTGATGCCTGTAATCCCAATACTTTAGGAGGCCGAGGCAGGAG
GATCACTTGAGGCTAGGAGTTTGAGACCAGCCTGGCAACATAGCAAGACCTCATCTCTATTAAATTTTT
TTTTAATTAGCTGGGTGTAGTGGCACACACCTGTAGTCCCAGCTACTTGGGAGGCTGAGATGGGAGGATC
ACTTGAGCCCAAAGGTTGAGGCTGCAGGGAGCTGTTTCACACCACTGCACTCCTGCCTGGGGCAAGAGAG
TGAGACCCTATCTCAAAAAAAAAAAAAAAGAAAGAAAGAAAGAAAGAAATAGAGAGATCCTGTGAACTC
TTCATCCACTTTACCCAATTTTCCCCATGGTAACGTCTTGTATAACTATATTACAATAACTATATTACAA
CCAGGAAATCAACATTGATAAAAATCCGGTAACAATTCAGACTTCAGCAGTGTTACATGCATTTGTGTGT
GTTTACATGTGTGTGTGTGTTTTTGTGTGTGTATCATATCTTGCAGATTTCACCTGATTGACAGCA
TTGAGATAGAGCGTTTCAGGTTTGAGATGTGGTTGTTTTACATATTTGGAGGTAGAGTGAGGAAGTGTG
GAGAAGTTTCATGGAAGGAGGAACAAAACACATCTTTGTTTCTCTCTTCCATATCTTTTCCTTACTAATT
CAGATCTGGCTCAGGAAAAAAAACAACTTTTTAAAATCCCAGTGGCATCAGCCATCTGGAGATGACAGTA
TGATTCTTGTTCTACTTTTCAGCTTCTTCACTATTTCATCATTGATTTCCCAGATACTTTCATTCATTCA
TTCATTCATTCATTTGTGCAACAAATATACATGAAGCACCAAGTTTGTTAGGTGTTGGGGATGCA
ATGATAAATGTCTTCTCTGTGCTTACAATAAAGTGAGCAACTAGGGAGAATTCATAATAGCAAATCATAA
TTAGTGAAATAACAGAAGTAGGAGCAGATGGGATCACATAGAAGGGAAACCACATGCAGGGTATGAGAG
AAGTCAGGAAGCCCTCCCAGAGGAAGGGATGCCTAAGTCAAGATATAAATAAAGAGTGAGGCAAGGGAG
GAATCTGGGAAGAACTGTTCCTGACCAAGGGACAATAGTTGAAGTGTTTCTGAGGATGAAAAATATTCCC
AGAAACATCAAGAAACTGAAAAAAAAATTAGCGCTCAAGGGAGATATGTAGGTAATTGTGCAGATAATAA
GGAAAAGTTAAAGGTATAGAAAATGATAGGTGCACCAGTTCCTGATAAGGATGGGACTCAGAGAGCAGGA
GGCTTTGGAGATGAGGTCGACTCACCACCATTGTGATAGGTGGGAAGGAGATGACGCCATGTGGGACACA
ATTATGTTCATGCATTTTGTGGCAAAAGTTGCAGAATTCTCATCTGGTGACCTCTACATTCTGGGTCCAG
TACAATGCACAGGCATCTGCTGGAGTGAAGGGGCCAAAAGTGGGAGAAAAAAGGGAGGAAATCAATAG
CATATCTGTATATGAGAGAGTGTTGACTCAAGAAAGAAAGAGCATAGCAGAGAGTTCACTGAAGAAAC
TTCACATGATCACGTAGAGCACCAATGCTAGAAGTCGGGAGTTGATAGCCACAACCATCTTAAACATCCT
GCAGCATCTCCAGCAGCTCTCAGCCCCGGATGAAGATGAGAAGGTAGAAGTCAGATTCTTCCAAGGTTT
GGATCTTTCCCAGAGGAAACAAAGTAGAGCAGCAAGGCAAGGGAGTTGATTGTAGTTGTAATTTAAGCTG
AGTAGAAAAGGCAGTAAAGATGAGAAGCTGTTGGATAAAGGCAGAATCAAGAGATGAAAGAGCCTTAGAA
GACATGCTGAAGAAAGAACCAGAGAGAGCTGGAAGGTTAGGCTTGTGTGGTCCAAGGCTGTGGAAGGT
CTGAATGTATTATTTTAGAGGTGAAGTGGTTTGATGTGAAGACAGGTCCAGGAGCTTTGGGGCAGACAG
CTTCAGGAGTATGGAGAAGTTTATTATAGTTAAGGAATCAAAAGTACGTGGTGGTAGGTGAGTTATCCAC
TTGGTTACTGAAGTCACACAGGGTATTGGCAGGACTTGAAGTGAGAAGAAGCCTGGAGCTTCTCCAGTAA
CTGAAGTGGAAAGAATGAAATGTCAAATGATGCCGCAGACATGAGGTGGTAGCACCCACGGCAAGAACCC
CAAGGGAGACGTGTTCTCAGCTTGAGTCCTCACTGAGGGTAGAGGACTAATGGTCTAGAAGTGGCAGTAA
CACGCTGATCCCATGTCCCAACACTGACATGAAGGACAGTTGGTAATAAGTAGCCTCCATTTGAGAGGCT
TCCATAAGGCAATGTTGTCAGGGACAGTTTCAGATAAAGGAATGTCTAGTGCATACAGTGGTTGTAAGA
GTGTTTATATCCTGGTTTGGGAGTTCCAGGGAAAATAATAGAAGTGTCAGGAAGGAGGATTGTGACAGGA
AATGGTAGGATCCAAATCATGGACGCATGAGAATGTGGGAAGAGATAAGTGAAGGAATCATTCTTCTTA
GGTGGTAAACAAGGGTTACAGGGATGCGAGTTAGGGTGGATTAAGCTGGCCACTAGACTGCCAACAGAAT
TAGTCCCACCATCCCCCCTGCAGATGGGAGGAGGCTCTCAGGGATTCACATAGCCCTGCCAGATGTACTT
CCAAGCCTTAAAAGAAAGGGGAAACTCTTAGCTGTTGGAAGAAGTGACCTTTGGTCTGGATTGACTGTGG
TGGTCTTGGGGAGGTTGTGGGAATGAAGTAACTTCCACTCAGGTACCCAGGGAGTGGTGAAGGACACCAT
ACCCAGAAAGCACGGGCTGGGAGTGGGCGATGAGTCTAGGCTCTTTGAGGGAACAGTGATGACCAGGAAA
TACTGGCACACAACCTGCTCTGCTTCTCCCTCTGGGACTCCAAGCTCAGCATTGCTATGGTTAGAGATTC

FIGURE 130 cont'd

TGTGTGCAATCTGCAGGTGGTAATAAGGATCTGTAGCTAGCATTTTTCAATCTCCCTTCATACTACATCC
CCAGAGGTCAACTGAGAGCCCAGGCAGCTTGCTGTTACAGGGAGGGCCATCAGACATGTCAGTTTTCTGA
ATGAAACAGAGTCCTGGTATGTTTGAAAAACGGAAAGAAATCTGTCTTCAATTAACCAAATGGTCATTCT
TCAATAACGGAAAAGATAAGGTGGCAGCAAAGACCAGAAGTGGGCACTAAAAGGTATGTGATCTTTTTTT
TCAGGTGAGACAAGGGTCTATATTCCTATCCATTACAGGTGGGGTCATTTCTATGACTCAAATCTGAACA
AAATACAGGTAGCAATCTAAATTCAATCATGACAATAAAATACTTTCCATTTTCCAAGTTCGATGGTAAT
ATTTACATTTAAAAAAATAATTTGTTCTTTTTTTGTTTTTAAAAAAGACAACATGCTCAAGATTACACAG
AATCTGGAAAAATCACTTCATCTGAGAGATCAACTGATAGTAAAAAAACAATGTTCTTACATAGTAACC
CAATTCAAGAATATCACCATGGAGTCTAACATGGTGTTTATTTCAAAGACAATATTCAAGTATGTCATTT
AGAACACTATGTCTAATGTGTCTGTAAAGAAGCAAACACTGCTATCCAAGATCATTAGGACAAGTAGCGG
CGCCAGCTGGGAGAAGACCCCATGTGCCATTAATAAGGTGCTGATGGGAAGGGTGCCTGACAGGGAAGGC
CAGCCGAATGAAATTAAACCACCACCCCAGAAATGCCCCCTTGACAAAAGAGACAAGAAAGCGATGGTG
GTTGGGGACCTAGGTGGTGGAGGTGGTGGTACAGGAGGGGGTGGGGGTGGAAGAGTTGGCTGGGGGTGGT
GGAGGAGGTTAGGGAGGTGGTGGGGAGGGGAGAAGGGCAGTGGCGAGGCGGTGATGGTAGAGGAGGTT
TCCAAGGCAGGGGAGATTATGGTGGAAGAGAGGGCTGTGGTGGAAGAGGCTATGGAGATCCATATGGAGG
AGGAGGAGGTGGTGAAGGTAAATAATTTTTAATGAACACTTCCAATTACACATTGAAAACCCAGGCAATC
CCTTTGTTAAGGTACAAATCAAGCAACATCTAGATTTTAATCCAAGTTCAAGGTCCTATGCCCAGTTCCC
AGACACACTCAGTTGCGAAAGAAAAGAGGCTCAGAAAACAGCTAGAAAAGAGGTTCTACTCAAGCTGT
CTTACATCTGATCAGAGTTGGCTCCCAAAAGCAATGGAGAGCATGAAGAAAGGAGATCACTTAGACAGC
ATCCTCTTTATGCAGTGATTTCTTATTAACCCTTAATGTAAGAAAGAGACAATTCTTAGAATTCAAGAAT
TTGCTAAAAAACAAAATAATTTTTCCCTGAAATTAACCTTTGTGTTTGAAGCTTCCAAGCCTTCCTGGA
ATTATTGTTTATTATTCCAGAGGGTTCAGTGAAGATTTTCAAATGCAACTACATCCTCTGCTAACGTTAT
ATGCAGAGGCCTTCTTCCTCCTACAATGACAGGGTGTATCACGCAGTCTTCTCTAGAAGCAAAAGTGCAA
TATGATATTCTACTACCAACAACAAGGACCAATTCAACCAGAGTTTAGTTTCAAAATTAAGACTCACTTT
ACATGAGATCTACTCTCAACAAATATTTAAGTGTACACTATATTATTGTTGACTGTAAGTATAAATGCCT
ATTTTTCTTATAAGAACTCTGACATCTCAAAGTTGTAACTATTCATTTTCCAATCACGTAAATAACATGT
AGAGGAAGGATCGCCATCAAAGACTTAACACAATTTATGGAAGGGAGAATGAGAAAGAGCCATTTCCTAA
ACCAAACTCAAAGGGATTCAAGGACCAGGGAGTCTGTAGTCTTGAGTCAAATAATTAAAATGTGTTCACT
AAGGGGACTATAATATCTTATCAAAACATAAGAATAATTTTGGGCTAGATGCAGTGGTTCACAACTATAA
TCCTAATGCTTTGGGAGGCTGAGACTAAAGGATTGCTTGAGTCCAGGAGTTCAAGACCAGCCTGACCAAC
ATAGCAAGATCCTCTCTACAAAAAAATTTAAAAATCAGCCAGGCATGGTGGTGCATACCTGCAGTTTTAG
CTACCCAGGAGGCCGAGGCAGGAGGATCACTTGAGCCCAGGAGTTTGAGGCTGAAGTGTGCTATGATCAC
ACCATTGCACTCCAACCTGGGCAACGGAGAGAGACCCTCTGTGAGGGTTATCCGTGAGGCTTCCACTTAA
CAGTAGACTATTAGTAGTTAAGCTTTTGGGGAGTCAAAAATTATACATGAATTTTTTACTGTGTGTGGGT
GGCACCCCAACCTCCCTGTTGTCCAAAAGTTAACTGTATTACAATTCATTCTGCCAACGCGAGTCTTTCT
AAAATGCTAATGTAATTAACCTTTTTGCAGTCATTTAATGATTCCCCTTGTGGCTTTTCAGATGGATTAG
TCCATTCTTATGCCGCTAATAAAGACATACCTGAGACCGGGTAGTTTATAAAGGAAAGAGGTTTAATGCA
CTCACAGTTCCACATGACCGGGGAGGCCTCACAATCATGGTGGAAGGTGAAGGAAGAGCAAAGGCAAGAG
GCAATGTATGCAGGGGAACTCCCTTTTATAAAACCATCAGATCTCATGAAACTTATTCACTATTATGAGA
ACAGCATGGGAAAAACCTACCCCCATGATTCAATTACCTCCCACCAGGTCACTCCCAAGACATGTGGGGA
TTATTACAATTCAAGGTGAGATTCAGGTGGGACACAGAGCCAAACCATATCATCAGAAATCCAGTTCCT
TGGGTTAGAACCCTAAGTCTTCATAATCTGAACCCTGCCAATCTCTATAGCCTTCTCTTCATGCACTTTC
CCACCCTCCTCTTGCCAGCCACCCCATTCGCCCAGTCTTAGGCTCCAATCATTCTAAACACCTGCAGGTC
TCCAAACCCACCTGCTATTTCCCACCTACGAGGCTTCCAACAAAAGCTCCCTCCACTGGGAATGCTCATC
CTCCAACCCACCCTTTCTGAGTTTTCCAATTCAAATAACTACCTCTGTCTGATGTGGCTATCCTCCTTTA
GACAATCATAGCGCCCTCTATCAGGGCACTTCCTACCTAGTATCTTCATCACTGATTATATGTATGTTTC
TCCGACTGGACTTCGAGCAACTTGAAAATATCCATTTGCTATTTAAATTCAACACCTAAAACCACAGTG
CTTAACAAAAGTTTGTTGAATAAAATAATGAATGAATAACCCATGGGCAAATGATTTAATATATGGAAAC
CAGATGGGCTGGCTGTAAATGGTTTTATGAGCTTTATTCCTTAAAGTTGATGTTTTTACATTTTAGAAGC
TAGAGAAGTTTCCAGAGTAGTGAGAATGAAAGCAAGGTTCGCACTGATGAGGAAAAGTATGTGAGGAGAC
TTAAAAAATATCTATGATTAATTAAAAAATTTAATTTTTTAAAAGGCCGAGTGTGGTGGCTCAAACCTCTA
ATCCTAGCAGTTTGGGAGGCCGAGGTGGGCCTCGGCCCAAGAGGAAGATCACTTGAGTCCAAGAGTTCAA
GACCAGCCTGGGCAACATGATGAAACCCTGTCTCTATCAAAAAAAAAAAAAAAAAAAAAGAGAGAGA
AAGAAAAAAAGAAAAAAAACTATGATTTTATAAATGTGTTGTGAGAAGGATTTTTATAAAATGCTATTA
AACTGTTTGTTGAGTGAATAAAGCAAGCATTACTTGACTGCCCTTGGGCCTGTGTCACTGAGGAAGTGAG
CACACACCAGGAAATGTTTGGCAGACTAAGAACAGGACACAATCATTGCCTCCAGGGGGTACTATCTGGT
TGAGAGACAAGACATGCAGGATAACATTCAATGAAGACCTCACAGAAGAGAAACGTCTTGCCTTGGTCTA
AGTCAAAAAGACTTCGCAGAGGATGGGGCCTTAGAACTGATTTTGAGAGAGGATCTGTGTTAGTCTGT
TCTCACACTGCTAATAAAGACATACCCAAGACTGGGTAATTTAATTTGTAAATAAAAAGTTTTAATTG
ACTCACAGTTCCTTATGGCTGAGGAGGCCTCAGGAAATTTACAATCATGGCGGAAGATGAAGGGGAAGCA
AACACCTTCTTCACAAGGTAGCGGGAAAGAGAAGTGTAAACAGGAGAAACGCCAGGCACTTATAAAACCA

FIGURE 130 cont'd

TCAGATCTCATGAGACTTACTCATTATCACGAGAACAGCTTGGGGGGAACCGCCCCTATGATTCAATTAC
CTCTACCTGGTCCTGCCCTTGACACGTGGGAATTATAGGGATTACAATTCAAGGTGAGATTTGGTTGGGG
ACACAGCCAAATCATATCAACATCTAAATGAGAGTGACAGTGAGTGAGAAGGAAGAAATCTACACTAAAG
TGTAGGAAGTAGACTTACCACAAGTAAGGGCAAAAACTTGCCATTGTGTTCACCTGGTGGTGAGTCCATC
AACAAGATGAAGCTGAAAGTAATCATAAACAGGACTATAGGGTCAGCTGAAAAGCTACAACAGGTTCAAA
TACATAGGATCTTGAATGCCTAACTAAGGGCAAAGGGCAAACGTCCTCCTAGAGTGGTCAGAACATGAGG
GAAGTGGTGTTGACTATGTAATTGGCCCGCAAGCCTACTGAAAGATAAAGAAAACAGAAAGCAATCAAAA
TATTTTTGTTACCATAGTAATACAAGCACTGAAAGGGAAAATTGGAATGCTCCATCTTCAGGGAGACCT
CATTGAATGGAAAGTCTCCACAGCTGGTGGAAGGAGGGGGCCGTGGGGTGTGATCCAGCCAGACTGCAAA
TCTAAGAGTCCAGAACACAGACCAGCATGGCAGAGGATGGGGTAGCACAACAGACGAAATATCCAAGCAG
AAGAAATCCTAAATCTCTGTGAGGAAGGTCCATATTGAAGGAACACATTTGTGTAAAAGAGACAATGCAT
TATCACATAATCAAGAAAATTAGCCTGAGTTGGCCGGGCGTGGTGGCTCACGCCTGTACTCCCAGCACTT
TGGGAGGTTGAGGTGGATGAATCACCTGAGGACAGGAATTCAAGACCAGCCTGGGCAACATGGCGAAACC
CCGTGTCTACTAAAAATACAAAAATTAGCCGGGTATGATGGTGTCACACGCCTGTAATCCCAGCTACTCA
GAAGGCTGAGGCAGGAGAATCACTTGAACGGGGAAGGCGGAGGTTGCAGTGAACCAAGATCAAGCCACTG
AACTCCATCCAGCCTGGGTGACAGAGCAAGACTCCATCTCAAAAAAAAAAAAAAGAAAAGAAAAGAAAAT
CAGACCAAGTTAGTAATAATGATATTTAGGCAACTATAGAAGTTGCCACATAATAATAAAGGGGGACTTT
GATGCCGTATCAGGACAAGATGTAGAGCTGAGCTTTCCTTAAACAACAATGACAGCTTCACCGGGGCAGG
ATGAGCTGCCAGGGCACCTGGTGAATACAAAAGGCCTGAGAGGTGAAAAGGCAAATCCAGACACTGAGGC
TAGAAACTTTAGACAGGTGCCTCCAATCTAATTATGCAGAAAGTTTATTCCAAACTGATAAATAAGTTCA
TATTTCTTTATGTTTGCTTTTTTCTGTTTGTTTTTCACCTACGTTATTTCACTGGCACCTCAAAATGACC
CTGTCATGTAGATGGGGTAGGAATTATTATCCTCATTTTGTGACCAAGGAAACTGGAACTCGACATTAGT
AAATCACTTGCCCAAGATCCCACAGAGAGTCAAACATGGAGCTGGGTCTTGAGTTCTTATTTCTAGTTCA
GCTCTCCTTCCACTATAACAGGAGGCCTCTCTGAATTAAGGCTCACCCTACAGAAATAGAAATTAAGGAA
GCGTGCGGAATTAGGAGGCATCCTGGCAAGGCTACAGCTCCAGGCCCTTGTGGGAGAAGACAAGTCAGCA
AGCAGCAGATCTATGGGGAACCCTGGAAGAGGATGGCAACCTCAGTCACCAGGTATCCCTTGGGGTGACA
GCAAGTGGGCAGGGTCACCAACTCATCCCAGTTTGCCCAGGTCTGTCCCCATTTTCAAATCGGAAGTCCC
GTAGCCTGGGAGCTTCATGCTGGTGATCTCAAGCAAACCAACATAGTGGTTGGGAGCCCTGTGTAGGAGC
AGAAGCTCTGGAATCAGAAGCAAGGCCCAGCTTTCAGACCACGCTGTCACAGGACAATGCATGCAGCCTT
CAGTGTGTCACTTAACTCTCTGAGTTGCAGTATGGAGATGGAGTCTCTGAGTTGCAGTATGGAGATGGAG
TCTCTGAGTTGCAGTATGGAGATGGAGTCTCTGAGTTGCAGTATGGAGATGGAGTCTCTGAGTTGCAGTA
TGGAGATGGAGTCTCTGAGTTGCAGTATGGAGATGGAGTTGGTCATTAGCACCTGCCCCTTCTTCACCTC
CCGCCATGATTTAGTTGAACCTTTTAAGTTGCCTCTTTTTTTAGTCAAAAAGTGTCACATATTTGTATG
GTTCTACCTAAAACTTCATACTGCAATTAAGAAGACAAACGAGGCTGCGTTTATGAAAATACTTATAAAC
AGTAAAGAGCTTATAAATATAAGTTATTATTATCATTATTACCTAAAAGAACCCTTTATTATCAATAGCA
AAGTGGACACAGGCTGGAGTGACCATGAGCTTCACTCAGTGGGAAAGCCTTGTTTTGTAATATTTTTAAG
ACTTCCAGGAAAAATCACTGTTCTTTTACATTTTCTCATGTAAAATTTTTTCCTGCCCCAGATTAATGGT
CATTCAGATGCCTACCAGATAGACAGCAAACCAAGAAACCATAGGGTTCTGACATCTGGTTCGCTCTTA
AAACAAGAACACATTTCTAAGGTTGCACTGTAGATATGTATCACGATGGGAATAAATACATACATTCATG
AAAAGACTAGTGAAACCAAAAGCAAACCACAAAAATGACCCTAGTTAGGACACTGGGAAATATATTGGGA
AATGTAATGACCCCCCCCCCATGGAGGCCATGTTAACTTTGTGTTACCCAGAAAAATTTGTGTAAATAA
TTGATTGGGAAATGTCATGATATTGCCTCTGTCTCACACACATCTCAGAGATGCAGAAAAAAGAAGAC
AGAGCTCCTACCCTCCCATTCCTTATAAAAGAAAAAGGAAAAAACAAAAAGCAAAGTCCTACAGAAAGG
GCACAATCTATCTTCTGAGCCAGACATGAGCTCAGACAGGGAGAGAAATTTAGAGCTGTTGAAATAAACC
CCTTTGGCCAAAGACAGCTCTGTGTATCTTCTCTAACTTCACAGAACACTCACAGGCTATCTATAATATG
TATACAGCTTCTAGAAAATCTGACTGCTTCAAACACACATGCTGATTTGGTGACAGTGACATAAACAAAA
CATACATGGAAAAATCCAGGGCCCCAAGCAAGTAGTCTTGGCAGCCGCGCTGTAAGGAGGGTTCAGCTAA
CATACCAGTCTCCCAAGTGGAGGACAGCATGGACCAGATTCCAGGGGCTCGTTTCTGCTAATTGAACTAT
ATTTACATGACTCGATGCTGATGTGTTAATTTGCAAATAATGCCCTTATAACATGGAAAATGTTCTCCTT
ATAACCCTGAAAATGGTCATCGCCTTTAGGGAAAGAAATTTTTCTCAAGCTCAGAAGGAATGGCACACTA
TTTTTGACACATTCAGCACTCATATAGTAGCTTCGGGAGTTAATATTGCTGCCAAAACCCCTTTAGAACA
TGGAAAGTGGGTCTAGAGCCACCGCCTATTAGTCAGTGAGAAGGGACACCTGCTCCTCCCTCCCAACAC
TTGTTTGCCAGCCACAGTACATTGGCAAGGTCCTGGCAACTGGACCTTGGCTGTGGGCTCTCCATAGGAC
AGGGCAGGCAACTGCAATCACCCCATGCCCCAACCCCGCAGACACACACACACACACACACACACACACA
CACACAAACCTGGAACTATGCATATTGCTGCAGTCTTCATAAGAGGCAGTAAAGAACTCCACCTTTAGAG
AAAATAAATAGCATAAGTCCAAGGAGGTCTCAAATTCTGGCAGCAAATCAGTGGCAAGTTATACAGGGAA
GCAAAGTGAGAACTGACCACAACTGTCAGTTCCATCTGAAACCCACTGATCTGAGGTGCAGGGCCTAAAA
TGTGAAACTTTCTGAGGCCTCATTGAGGTTTTCAGAGAGTCTATCCAGAAGTCCAAGCATACAGTAATGA
TGATGAAGAAGAGGAGCAAGAGAAAGAGGGGAGAGTAGGTAACCTTTACTAAGCACTTCCCAAGGCATTG
TTTAGGAGCTTTGCATGTATTAACTGACAATGACCCTATGCAGTGAGAGCTACTATTTTTTCCAGTTTCT
ACGTTAAAAAAAAAGTTGAGAACCAAAGGGTTAAATCATTGTCAGGGTCCATGAAACCAGGCCAGCTGGG

FIGURE 130 cont'd

```
TCCAGAGCCTGACAATGTTGTATGGTCATTCAAAGGCTCCTAGAAGAGTCCCCTCTACTTGAATACCTCG
AAGCAGGCAACTCTGCATCCCCAGCCAGCCCTGCCATCAACGTCATCAGTGTGAATGTGCGCAACTGCAC
ACATTCTAGCCACGGTTGCACCTCTGGGAATTTAAGATACACATGTGCATGTAGGCAGTTATTTGTTGGT
GCATGGTTATAGTTCATACAGAAAATAATCCGCATTTCCATCAACAGATAACTAGTTAAATTCATTGCCA
CGTGGCCACACAGGATACTAGTCTATAAAGCTGGCTTCTCCCTTCCACTCCCTGCAACCCTGGAGGCACG
TGGCTTCATCAGTGGATAGCACTGTGATGGGAAGAAAACTGTGCCCTTTCCTCCAAGTGGAAGCAGGGCA
CTTGTACTGCAAGCCGTGCAGCCCCATAGCCTCGCAATGAATTACCATGCAGCAGCAATAAAAAGAAAG
TGGTGCGCACACATCCACGCACAGAGTTTGCGCAGACCATCTCTGGAAGGACCTGTGGGAAACTGATGAC
CGCATTTGCCTCTGAAGAGGAGACCTGGAGAACTGGGGGTGGGAAGGTGTACTTTTTACTTATAAGTCTC
TTTGTTGTGTTTGCATTTTACATGTATGTGTAAACCAAGCATACCTTTTAAGAAAGACTAAAATTTCAAG
TTAAAAATTCCTAGCCTGGGCCGCATGACAAAATCCCTTCCCTACAAAAAAATACAAAAAATTAGCCAGG
CATGTACCTGTAGTCCCAGCTGCTTGGGAGGCTGAGGTGACAGGACAGGCTTGAGCCCAGGAGGTCAGGG
CAGCAGCAAGCTGAGATCATACCACTGCACTCCAGCCTGGGCAACAAAGTGAGACCCTGTCTCAAAAAA
ATACAAAAAATAAATTTAAGAAAAATTTGAATAAACCAGCAAAAAATAAAATATTCATTAATAATCAGTC
ACAAGCAAAAATTAGAAAGGTAAAACAAAAAAACTAAGTGTCCAACAATTTGGGAAATGGAATACAA
AAATTAGCTGGGTATGGTGGCATATGCCTGTAATCCCAGCTACTCAGGAGGCTGAGGCAGCGGAATGGCT
TAAACCCAAGAGGCGGAGGTTGCAGTGAGCCGAGATTGCACCACTGCACTCCAGCCTGGGCGACAGAGCG
AGACTCCATCTCAAAAAAAAAAAAAAAAAAAAAAAAATTGGGGAAATGGATAAGAACATAAGAGGATATGTC
TTCAGTGCAATATCATGTCATCATTAAAAGTTGGGGAAGCTATGTAGCAACAAGGGACATGTTTAGATTA
CAATGTCAGTGAAAGAGCAGAATGCCAAACTGTATGTTCCATGTGATTACAATCACGATAATATGAAGAA
AATTGTCTTCTCTTAGCAGCTAGAATAAGTATTTCTTAAAGGTGGGGATAGGGCTGAGTGAGCTGAGA
TCGTACCACTGCACTCCAGCCTGAGCGACAGAGTAAGACCTTGTCACAAGAAAAAAAAAAAAAAGAGGC
AATAAGAAGCAAATATGTTCCAGCTCTAAAAGGCAGTTGGAAATCTTGCAGAAGACAGTGACAGCAAAGA
TTAGTAATGAAACCTCCACGTTTATCAGATCCTCAGGGTGCTTAGGTTTTTCTGCCACCATGTCCAAGC
CCCTCACTCCTGGGATCAGGTAAAAGTGAAAAAGCAGCATGAGCTGCAGGAGAGAGGGATGGATAGGCAG
CAGGAGGAGGAAGGAGTTATTTTTTATTTCCTCGTAGGACGGAGTCTCACTCTATCACCCGGGCTGGAGT
GCAATGGTGCAATCTTGGCTCACTGCAACCTCCGCCTCCCAGGTTCTAATGATTCTCTTGCCTCAGCCTC
CCGAGTAGCTGGGATTACAGGTGTGTGCCACCACACCAGGCTAATTTTTGTATTTTTAGTAGAGACAGGG
TATCACCATGTTGGCCAGGCTGGTCTCAAACTCCTGACCTCAGGTGATCCACTCACCTCGGCCTTCCAAA
GTGCTGGGATTACAGGTGGGAGCCACCGCCCCGGCAGACTGGAAGGAGCATTTGGAAAACACCTTACC
CTACCAATGCATCTCAAATAGATAGCTGATCCTGATGGAGAAAATAAGGCTCAAAAACGGAAATAACAGG
TCTTTCTCGATTATATTCGTTCTGTAGAGTATATAACTAGACAGTCATAAGGCTGCTTACCTCAAACAGC
ACATGTGATAGCTAAGTAGGTAGATAACAAAGAGCATGCAGTATTTTATAAACCACAGTTCAATCCTTTC
TCCTCTGCTCTTCTCCCCCACTCCTGTTCCTCCTTCATCCTTCCACAGAATGTAGGATTCACAGTG
AACCACTGAGCCTCAAGCCTGATACTTGAACAGATCACAACTTTCCACATCACTTACGCCTCCTAAGCCT
CAGAATCTCCATGAATAAGATGGGAACAGTACCAATATTCAGCTTTTGAGGTTATCTTGAGCATTAAATG
AGATCATGGATGTGAAAGGCCGCTGGAATTTTAAAGCATTCTATAACATTATTTTATCAGGGGCAAAAAA
GCTTATCCTGTTTCAGAAAATGCAGAAAAATATCCCCAAGAAATATGATGGCTAAAATACACAATTTTGG
GATACCACATAATTTTATAACATTAGAAATTCAAATGTTAATAAACTTAAAACTATATATTACCATCTTG
TTTTTATTTTATTCCCATATGTACTTATAAATAGAATCTAACTTAAAGAAAAATAGGCTAATTTGACTCC
TCTTTTACTTTAATTAAGGCCTCTTAGAAGTAATAATAAATAAATAAATAAATAAATAAATAAATAAATA
AATAAATAAATAAAATATCTTTAAAAGAGAGGTTGTTGCTTTAAAAAAGGGACGATGTTATTTCCTTGAA
GTCACCTTTCAAAATGCAGCAACAAAGTAGGCTTCAAATTAAATTGAGTGGAAAACTCAGCGATAGCGTC
CTAAAAATTCCACGCACCTTAATCAGAATATTTCCCTTTGTTTTTTATTTTCTAGGTAAAAATATTCT
TTTTTTTTTTTTTAGACCCAGGTTGGAGTACAGTGGTGGGATCTCAGCTCACTACAACCTCCACCTCCTG
GGTTCAAGCAATTCTCCTGCTTCAGCCTCCCGAGTAACTGGGATTGCAGGCACCTGCCACCACACCCGGC
TAATTTTTGTATTTTTAGTAGAGACGGGGGTTTCACCATGTTGGCCAGGCTGGTCTCGAACTCCTGACCT
CAGGTGATCCACCCACCTCGGCCTCCCAAAGTGCTGGGATTACAGTCGTGAGCCACTGTGCCCAGCAAAA
ATATTCTTTCTAAGTTTACCTTTCTTTTTCATCATATTGAATATAAGCATATTCATGATATTAATTGGTA
AACTGCTGTGCATTATCTTTACTATTATTACTATAAATAAATTGGTGTTAATCAATTGTAAGTGAATATT
CTAAATGAAATTCAATATCTAAACCAGGTCACAGAGCCATGAGGTCATCGCCAAAGCCCCTCTGGTAGTG
GTCCACAGTCATAATCCCAATCATTCTGCCCATCTCCTCTACCCAGCACATATTTAGAGCTGTTGGACAG
AAAGGACCTCCAAGGGAGGCCATGGCAGGAGCTCATGGCCTTACAATGCATACAACTCCAGGCTGAACA
GCTCCTGGTCTTAGAAGGCCCTCTTGACTCTGAGCCTCTATCTACCATCCTTTGACTTCCAGCCATGAAC
CTAGAGCTTCCATCTTGAGCAACACATAAATCAGTCCCCCTCCATGTGAAGAGAACTACCATGTTCCCC
ATCAGTATCCTCTTCCAAATTAAATACATCAAATTGCATTAACTCCTCCTTATAAAACAGGATATCCTGA
CTCCTTCGCCATCCTGGTGAAACTTCTCTGGATACAAACTTCTCTGCATCTTCCCAAATGGATATACTAT
TCCAAACATCCTCTAAATTATTCTGTGTACAATGGAATTCACTCCTGTTATGAATGAATGTTACCTATAT
AATTGTAACATAAATTTGCATGCATTGTATTGTTTGCTTGTTTTGAGAAGAGGTGTTTGTTTTGGAATCT
TTATCTCATTCCAGGCTTATGTTGAGCTTGGTGCCTTATAGTTGGAATTAGCATGATTATATGAATAAAT
TTGTCTTTAAAATGTTCAGGAAATATCTTAACATTTTTACTTAAATTCAGCATTCTTACATTCCTCAAGG
```

FIGURE 130 cont'd

```
TCAAAGAGAAAAGAACTACATAGGTCTTAATACTAAGTATTTTCAGAAAGGATGCCACAAATCTCTATAA
AGAGTAAGGGACTTCTGAAAAATGATGCGTAGTCAAAGTAAAGATTATTTTTCATCTTCAAAATATATAC
TAGCTAAGTGTCTTGAAGGGGACATTATAAGAAAATAGACTGACTAGGTCCTGTACCAACTGGTGATAT
CTCAAATAAGAAAGGTTTTAGCAAAACATGTGATAATCATAAGCTAATCTAAGCAAGAGATGCAGTTGGG
GTGAGCTTTAAAAGTGTTTTATTCTCTCTCTAGCATGGTACCTGGAAGACAGTAAGCATTTTGGAATCAG
GCCTTGTTTCAATGCCAGAGACACACCTGTGAATAAAGCAGACACAATTCTCTATCTACACACAGCTTAC
ACCTGCACACATAAGTATGTATATGGTGATGGTAAGTGTCTGTCTTAGTCCATTCTCACACTGCTATAAG
GACATACCTGAGACTGGGTAATTTATAAAGCGAAGAGGTTTAATTGACCCACTGTTCTGCATGGCTGGGA
GGCCTCAGGTAACTTACAATCATGGTGGAAGGGGAAGTAAACACTTCCTTCTTCACAGGGTGGCAGGAGA
GAGAAGTGACAGCAAAGGGGAGAAAAAGCCCCCTATAAAATCATCAGATCTTGTGAGAATTCATTCATTA
TCATGAGAACAGCATGAGGGTAACCACCCCATGATTCAATTACCTCCCACCAGGTCCCTCCCGTGACATG
TGGGCATTATGGGAACTATAATTCAAGATGAGATTTGGGTGGGGATACAGCCAAACCAGATCAGTGTCAA
TGAATTCATAAAAGCAAAATTCAGAAATTCATGTTCCCCCTCATTTTCCATCAAAGAGAACAAACCAAGA
CTAGGCATGGTGGCTCCCACCTCTAATCCCAACACTTTGGGAGGCTGAGATGGGAGGATCACTTGAGGCC
AGGAATTTGAGACCAGCCTGGTCAGAAGAGCAAGACCTGTCTCTACAAAAATAATAAATTAGCCAGGCAT
AGTGGTGCACACCTGTAGTGCCAGCTACGCAGAAGGCTAAGGCAGGAGGATTGGTTGAGTCCTGGAGTTC
AAGGCTGCAATGAGCCATGATTGTACCACTGCACTCCAGCCTGAGTGACAGAGCAAGACCCTCTCTCTAA
AAAAAAAAAAAAAAAAAGTATAATTATACTTTTTTTTCAGGCACAATGCTGAAATAGAAATGTTTCATGGT
TCATTGTCTTGAGGGATCATTGATGTTCTATGAATTAATTGGGCAAGAGAAAATATTTCAGGCTTCAAAA
TAAAATAAAGAATAAACATGACATCTTGGATTTGTTTACTTTACAAAATAAGGTCGACATACTTAGTCAT
TTGTGCAGCTACCATAAAGGAGCCTAGGTAAGTAATGTATCTTTTAAAAATACACACATTTTATATTCTC
TAAGTATTTAGTCATAGGGTTTTTTTCTAAAGTCTGCATTGTATAAAGAAGGAAATTGAGGCCAAAAGAC
ATTAAAAGACTTGGCTAATGTGACTCAGTAAATGAGGGTCATTGCAGGGGCTAGCTCTCCAGTCTCCCAT
GCTCAGTACGCTCTTTCTACTCACTCCAACTTCTACCTGTGACTTCAGACAGAGGAAAAAGAGATGAGCA
ACTCTAATAAAATGCACAGATCATTCTTTTTAATTTAATTTAATTTTTATTTTTCCATAAGTTATTGGG
GTGCAGGTAATATCTGGTTACATGAGTAAGTTTTTAATGGTGATTTGTGAGATTTTGGTGCACCCATCT
CCTGAGCAGTATACACTGCACCATATTTGTAGTCTTTTAACCCTCGCCTCCTTCCCACTCTTTTCCCCAA
GTCCGCAAAGTCCATTGTATCATGCTTATGCCTCTGAGTCTTCATAGCTTAGCTCCCACATATCAGTGAG
AATATATGCTGCTTGGTTTTCCATTCCTGAGTTACATCACTTAGAATAATAGTCCTCAATCTCATCCAGG
TCACTGCAAATGCTGTTAATTCATTCCTTTTATGGCTGCATAGTATTCCATATATATATATATATGGTT
TTATATATATATATATATGTGATATGATTATCACATATATATAGATATATATGTATATATCATGGTTT
CTTTATCAATTTGTTGATTGATGGGCATTTGGATTGTCCCACAATTTTGCAATTGTGAATTGTGCTGCTA
TAAACATGTGTGTGGAAGTATCTTTTTCGAATAATGACTTCTTTTTCTCTGGCTAGATATCCAGTAGTGG
GATTGTTGTAGCAAATGGTAGTTCTACTTTTAGTTCTTCAAGGAATCTTCACAATGCTTTCCACAGTGGC
TGTACTAGTTTACATTTCGACCAGCAGTGTAGAAGTGTTTCCTGTTCACCACATCCATGCCAACATCTAT
TGTTTTTTGATTTTTTGATTATGGTCATTCTTGCAGGAGTAGGGTGGTATCGCATTGTGGTTTTGATTTG
CATTTCCCTGACCATTAGTGATGTTGAGCATTTTTTCAAATGTTTCTTGGCCATTTGTATATCTTCTTTT
GAGAATTGTCTATTCATGTCCTTAGCCCACTTTTGGATGGGATTGTTTGCTTTTGTCTTACTGATTTGTT
TGAGTTTGTTGTAGATTTGCACAGATCATTTTAATATGTTTTTCTAAAACTCTAGATCTGAAATCAGGTG
GAAAGAAACAAAGTTGGAATTCTTACAGAAAAAACTTGCCCTAAGCACTATGAATCTAGTGCTCAACAC
AGCATATGGTAGATTAAATGGTCAAAAATCAGCAGAACTCAACAAAATGTTTTCATTCATTTCAAACTGA
TTATCACCAGTATTAACAATTTAGGCAGACAGATTCCTGATGGCAGGCATGTGCCATTAATGAAAGAGAA
ATTAACATCAGTGATATTTACCTTCCATCTGCTTTTTTAGTGACTGAATTTGATCATAATATTCAGTTC
AAGTAGAAAATAACAGATGGGTATAAAAGTCCCACGTACATTACTTCTTGAAGAATATAGGAAAACACAT
GTATTTTTACACACTACTTCAATGGCTTTTGTCAAAACCAACCTGCTTTTAACTTAAATAGTCAAAAAT
ATTTTCATCTTTCTTCAAATTTTACTCTATCATCTGTTAAAACTAACTTTAAATCTTGGATCCAAACACC
TATCCAGGCAATATTGGTCACAACATATGTTGATTATTTTAAAGTCTTATGACTGATTTACTGACAACAC
TCTTACCAGGAATTCTGAAAAATGAGTAAATTCTTCAAAATGAGTTGTATTAGTTCTCACACTGCTAATA
AAGACACACCCAAGACTGAGTAATTTATAAAGAAAAGAGTTTTAATGATAAAGAGGATATCACCACGGA
TCCCACAGAAATACAAACTACCATCAGAGAATACTATAAACACCTCTACACAAATAAACTAGAAAATCTA
GAAGAGATGGATAAATTCCTGGACACATACACTCCCAAAACTAAACCAGGAAGAAGTCGAGTCCCTAAAT
AGACCAATAACAAGTTCTGAAATTGAGGTAGTAATTAATAGCCTACCAACCAAAAAAGCCCATGACCAC
AGCCAAATTCTACCAGAGGCACAAAGAGGAGACAATACCATTCCTTCTGAAACTATTCCAAACAATTGAA
AAGAAGGGACTCCTCCCTAACTCATTTTATGAGGTCAGCGTCATCCTGATATCAAAACCTGGCAGAGACA
CACACACACACACACAAAGAAAACTTCAGACCAATATCCCTGATGAACACTGATGCAAAAATCCTCAA
TAAAACACTGACAAACCAAATCCAGCAGCACATCAAAAAACTTATCCACCATGATCAAGCCGGCTTCATC
CCTGGGATGCAAGGCTGGTTCAACATACACAAATCAATAAATTGTAATCCATCACATAAAAAGAACCGAAG
ACAAAAACCACATGATTATCTCAATAGATGCAGAAAAGGCCTTTGATAAACTTCAACATCCCTTCATGTT
AAAAACCCTCAATAAACTAGGTATTGATGGAACATATCTCAAAATAATAAGAGCTATGTATGACAAACCC
ACAGCCAATATCACATTGAATGGGCAAAAGCAGGAAGCTTTCCCTGTGAAACCAGTACAAAACAAGGAT
GCCCTCTCTCACCACTCCTATTCAACATAGTGTTGGAAGTTCTGCCCAGGGCAATCAGGCAAGAGAAAAA
```

FIGURE 130 cont'd

AAGAAAGTGTACTCAGATAAGAAGAGAGGAAGTCAGGCCGGGCACGTTGGCCCATGCCTGTAATCTCAGC
ACTTTGGGAGGCCGTGGCAGGAGGATCACGAGGTCAGGAGTTCAAGAACAGCCTGACAAGATGGTGAAAC
CCTGTCTCTACCTAAAATACAAAAAAATTAGCCAGCCATGGTGGCAGGCACCTGTAATCCCAGCTACTCA
AGAGTCTGAGGCAGAGAATTGCTTGAACCCAGGAGGCGGAGATTGCAGTGAGCCGAGATCACGCCACTGC
ACTCCAGCCTGGGCAACAGAGTGAGACTCCATCTCAAAAAAAAAAGAAAGATGAAATCAAATTGTCTCTG
TTTGCAGACAACATTATTTTATATTTAGAAAACCCCATCATCTCAGCCCAAAAACTCCTTAAGCTGATAA
GCAACTTCAGCAAAGCCTCAGGATACAAAATCAATGTCCAAAACTCACAAGCATTTCTTTACACCAACAA
TAAGCAAGCAGAGAGCCAAATTATGAATGAACTCCCATTCACGATTGCTATAAAGAGAATAAAATACCAA
GGAATACAGCTACAAGGGATGTGAAGGACCTCTTCAAGGTCCTCTCTTATTTCCAAACCACTGCTCAAGG
AAATAAGAGAGGACACAAATGGAAAAAATTCTATCCTCACGGATAGGAAGAATCAATATTGTGAAAATGG
CCATACTGCCCGAAGTAATTTATAGATTCAATGCTATTCCCATCAAACTACCATTGACATTCTTCACAGA
ATTAGAAAAACCTACTTTAGGCCAGGCGCGGTAGCTCACGCCTGTAATCCCAGCACTTTGGGAGGCCGAG
GCAGGCAGATAACCTGAAGTCGGGAGTTCCAGACCAGCCTGACCAACATGGAGAAACCCAATCTCTACTA
AAAATACAAAATTAGCCAGGCATGGTGGCACATGCCTGTAATCCCAGTAACTCGGGAGGCTGAGGCAGGA
GAATTGCTTGAACCCAGGAGGTGGAGGTTGAGGTGAGCCAAGATCGCACCACTGCACCACTCTAGCTTGG
GCAACAAGGGCGAAACTCCGTCTCAAAAAAACAAAAAACAAACAAAAAAAAAAAACTACTTTAAATTTCA
TATGGAATCAAAGAAGATCCTGTATACCCAAGACAATCCTAAGCAAAAAGAACAAAGCTAGAGGCATCAC
GCTACCTGCCTTCAAAGTATACAAGGCTACAGTAACCAAAACAGCATGGTACTCATCCCAAAACAGACAT
ATAGACCAATGGAACAGAACAGAGGCCTCAGAAATAACACCACACATCTCCAACCATCTGATCTTCGACA
AACTTGATAAAAACAAGCAATGGGGAAAGGATTCCCTACTCAATAAATGGTGCTGGGAAAACTGGTTAGC
CATATGCAGAAAACTGAAACTGGACCCCTTCCTTATACCTTATACAAAAATTAACTCAAGATGGATTAAA
GACTTAAATGTAAAACCCAAAACCATAAAAACCCTAGAAGAAAACCTAGGCAATGCCATTCAGGACATAG
GCATGGGCAAAGACTTCATGACTAAAATGCTGAAAGCAATTGCAACAAAAGCCAAAATTGACAAACGGTT
TCTAATTAAACTGAAGAGCTTCTGCAGAGCAAAAGAAACTATCATCAGAGTGAACAGGCAACCTACAGAA
TGGGAGAAAATTTTTGCAATCTACCCATCTGACAAAGATCTAATAGTCAGAATTTATAAGGAACTTCAAC
AAATTTACAAGAAAAAAATCAAACAACCCCATCAAAAAGTGGGCAAAGGATATGAACAGACACTTCTCAA
AAGAAGACATTTACACAGCCAACAAACATATGAAAGAAAGCTCAACATCACTGATCATTAGAGAAATGCA
AATCAAAACCACAATGAAATAACAATCTCACGCCAGTCAGCATGGTGATTATTAAAAAGTCAAGAAACAG
ATGCTGGCGAGGCTGTGGAGAAACAGGAATGCTTTTACACTGTTGGTGGGAATGTAAATTAGTTCAACCA
TTGTGGAAGACAGTACAGTGATTCCTCAAGGATCTAGAACCAGAAATACCATTTGACTCAGCAATCTCAT
TACTGAGTATATACCCAAAGGAATATAAATCATTCTACTATGAAAACACATGCACATGTATGTTTATTGC
AGCACTATTTACAATAGCAAAGTCATGGAACCAACCCAAATGCCCATCAATGATGGACTGAATAAAGAAA
ATGTGGTCCATATACACGATGGAATACTATGCAGCCATAAAAAGGAATAAGATCATGTCATTTGCAGGAG
CTTGGAAGAAGCTAGAAGTCATCATCCTCAGCAAACTAACACAGGAACAGAAATCCAAACACCACATATT
CTCACTCGTAACTGGGAATTGAGCAATGAGAGCACATGGACACAGGTAGGAGAACAACACACACCAGGGC
CCGTTGCGGGATGGGGAAAAAGAAGAGGGAACTTAAAGGATGGGTCCATAGGTGCAGCAAACCACCATGG
CACACGTATACCTATGTGACAAACCTGCACTTTCTGCACATATATCCCGGAACTTAAAGTAAAATAAAAT
AGATAAATAAATAAATAAAATTAGATTAAATTTTAAAAAAGAAGAGGTTTAATGGACTCACAGTTCCACA
TGGCTGGGGAGGCCTCACAATCATGGTGGAAGCCAAAGGAGGAGCAAAGGCATGTCTTATATGGTGGCAG
GCAAGAGAGTAGGTGCAGGGAAACTGCCCTTTATAAAACCAGCAGATCACATGAGACTTACTCACTGTCA
CAAGAACAGCACGGGAAAACCCCACCCCCATGACTCAATTACCTCTCACCAGGTCCCCCCCCACGACACT
TGGGGATCCAGCAGACACCACCACCACTTCATCCCACTTCAAATGTGGTCTCCCATGCTCGAGAAGCAGT
ACTCACCTTCTGGTCTGCAAAGCGCCATCCTGGCATAATTTGCCTTGGCATTTGTCTTTTAACGAGTATT
TTAAACGATCTTTTAAACGAATATAATATCTTTGGAAGCCCTTATTTGCATGTATTAGTTATGATATACC
TAATAAACATTCCACCACTCTAATTTACCAATCTTTACCAGTTATAAAAGCAGAAACTATAATCATGTCT
TTCAAAATAAGCCTTGGGCTGTTTTGTAGCAGTGAAATCGATAGTTGTACTTAACCTAAAGAACCTGTGA
GAATCCCACTGCAGTGTTGAAATTTAACAATTAAGCAATACTATCCCTGGCTTTCATCATTGAATTTCAC
AAAATATGTTATTTGCTGGGAAAACAGTTGAATCGGCCTGATGACGTGAATAATCTCAGGCCTGACAAGG
ATATAGCTGTATTATAATTCCTTAGTGTCCTTAAATGTAAGCTACTTTGCAATTAATACTAAATCTAAC
CTCGCTTTTTCCGTAATTTCTATAATTTCATCTGAACGTAGTAACAGGTTAGCAGGGGGCCACCAGCCTG
GGCGCTCTCGGTGTTATACTGTCCTCTCGTGGTAAATATGGAGAACTGCAGCCTGACGGCTTTTTCCTCT
TTCAGTTTCCTGTTCCATTATTTTGCCGTGCTATACATATCCTTGTAAACTGCCTTAAATTCTTTCTAGG
ACACAGCAAAATCTAAAATAAATAGATAAACAAATGTATAAGATGAGAACTGTTGACTAGGAGCTTAAAA
CATGGGTTGGAAAACCCATCTGCTTGGGTTCAAATCCCAGCTCTTAAAGCCCAGCACAGTGGCACGCACC
TGTAGTCCCAGCTTCTTGGAAGGTTGAGGCAGAAGAATGGCTCAGGTTCAGGGGAAAAATAAAAAATGAA
AATTCCAGCTCTGCCACTTAATCAGCTGTGAGAACCTGGGTTATCTACTGGGGTGGAGATAGTCTCTCTC
TATGCCTAGCTCCTCATCTGTAGAATGAAGATAACAATAGCCTGCATTGCATAGTGCTGATATACCTCCA
TGGCAAGCACTAGGAACAGAACTACTACTCCTTCTCAAAAACAAACAAAAAACAAAAAACCAAAGTGAGA
GCTTTATCACCTAAAAGGTCAATTACAGCTTATTCTTAAATACAGTGGAACAGAAGTTCTCTGGGACCTA
CAGACCACTTCCCCACTGTGTCCAAATTGGACACAGAGTGCAGAAAACTGAAACTGCAACCCAGCTGAGC
TGTGATTGTGTCTTTTTTCACTGGAAGAAGTAAATCATAGAATGTTAGTGTTGTACATTGGACTTTGGAG

FIGURE 130 cont'd

```
CACATTCCGTTTGGCCTCCTCATTTTACAGTTGAGGAGTTTGAGGCCCAGAGAAGTGATAACTCAGTTCT
CCCGATGCATTTCCATGATGCGATCACTGCTTCATGCTCTGAGTCCTTGTAAACACAGGAATTTCCAGGA
AGAGGAAAGGGCAAAGCTGTGATCAACCAGCCATAGTTTTCCCAGCCCTAGTTTTCCCCATGCAGCTGCA
GAAGTCACCGTGGAATGACCCACGAGCAAGGCCACAGGCACAGACACTTCGGGAGCTGACAGGAATAGAT
CTTTAGAGACAGGAAGGCTTTCCTACCCAACCCCACCATCAATTTTTAAAAGCAAGCATTTCCCACAAG
GTAAATATAAGAACTAGTCTGGTCAAAGGATAACAAGGCAGTAGGTACTGGAAATTCCGGACAATTTGTA
CTACTCAAGCTAACTGCAATGCAAGACAGGCTCTGGAACTTAAGGCAAAGCTATTATGTCCGGCTCTGCC
ACAATTTTAGAATCCGCGTCCCCTGTAGTGGACTGTGATGCACCACCATGTTCTGTCCTCAACAGAGGTT
GTCCTCTGACAACCCTCTCTGAAAACTGCCCTCAGCTCAAGAAGGTTGCTTTGTTCAAGGTCAAGCCCCC
CAGTACTTAGTCAACGAGAAAGTGTAGAGACTCAGCACTCCCAGAGTGATGGGGACCACTCCAGAGCCC
CTGGGGTTCTGCTGAGGCCCTGCTGAGATTGCATCACAGCCCAGCTGCCCCCTCACCTGAGTATTATCCT
GAGGACACGCCCAGAGAGATGTCCTGCACATTCATCTCTACTCAGAGCCTGCTTGCCAGAGAAACCAAAT
CAACAGCCCTTTTCTGATATAAAATCTCACACGTCACTCTTCTTGACCTGTTCGGGTTTTGTGGGGTTTT
TTGTTTGTTTTTGTTTGGTTGGTTGGTTTTTTTGAGGGGAAGAGGATCAATTTAAAATAAATCCATTGTA
TACTTAGCCTCTCCAATCTGAGAAGAGAGTGTGCTTTATATCTGGCAAAACCTGTTTAAAATGCTGTTTC
CCGATTGCTACCACCTAAATTATCCTCCGTGTAAATGGCTGTTTCTCCCCAAACCTAATTCCAATGGATG
GAACGTTTCTGTTCCCCCAAAATTCACACGTTGAAATCCTAACTCCCAAGGTGATCGTATTTAGGAGGTG
AGGCTTTTGGGAGATGATTAGGTCAAGAGGGCGGAGTCCTCGTGATTGCGATTAGTGCCCTTGTAAAAAA
CCCCAGAGAGCTCTCTCACCCCTTCAGCTACGTGAAGACACAGCAAGAAGATGGCTAGGCCTTCTATGAA
CCAGGAAGCAGGCCCACCCCAGACACCAAATCTGCCAGCACCTTGATCTTGGGCTTCCCAGCCTCCAGA
ACTGTGAGAAATAAATTTCTGTTGTTTATAAGCCCCTCTGTTTACGGTATTTTGTTATAGGAACCTTAAT
GGACTGTTGGAAATTTTTATTTAGATTTCATAATTAAAACACAAATACATAGTCATTATAAAGTATGAC
CTTTTGATCCGCCATCCCCAGGGGGCCCATGCCACTGTTTCCAATCTGGGTCCTCTCCAGATTTTGATAC
ACACTCCTAGGTAGTCACGTCTCCCCTCCCTGCTTTGAAAACCACTACCATCTGCATATCAACCAGTCAA
GATTTTGAACATTAACTTCTTGCAGTCTATATTATAAAACCCTTTTTAAAATTTTTCCAAATATAAAATA
CTATTAGAATGTTTTGTGAAACATCCTTGCTCAAACACCTTAGTTTGAGGGCACTAACTAACACCCAGTT
TGGAGGGAAATGAAACCCACTCAAAGGCATTTGAGGAAGTGGGAGAAGGGACTTCTCCAGGGCAAGCAAG
AGAAGTGTTTCAGAGTCAGGAAAGGAAGCTATTAACGTAACTTGCAAGAGAAAGCTGCAGCATTTACAGT
AATTTCATCGAATTTTAAAGTAATCAAATCTGAATTTTATAACATTTGGCATGAGGTCATTTATGTATAG
GCTCATGAGGAAGGCCTAAACTGAATCCCCAATCCTCAAGAATTCTAAAGTGAACACAACAGTTACCGGG
AGCCCAAAATTAGGCCACTGCAGATTTTAGGGCATATGGTCATGTCCTCCCAGATACCAGGAGTTATACT
TCGAAACACAGGGAAGCATAAAGTCAACTCAATTCTAATGCATCACTGGTGTTGAAATGTGCTTTGGGAA
GGCAGGAAATCCATTCTAACGAAGAGCAAAAAAGCCCACCAAAAAGCCAACTTGGGGTTTGTCAAGAAAT
GATATACTTCACTTGGCAGAGGATAGTATCTTCCAAAGATTCCTGCTGGTTGTTGAAGGATTGTTGATTA
CACATTTTTGAACAAGGAAACTAGAACACTGAAAATGCAAGCCTACCTACTTGGGAAATAAAAAAAGTTA
TTTCAAGAGAAAACAAACTCTTATTACAAGGATAATGAGAAAAGTCAGCGTGGGGAAAACGTTTAAGAGG
GGCAGGAACAACAGCAAGAACAAAAACTATTGGTAGCTAGATAAGAAATGTCAAAAACAATCACAGGCTG
GGTGCAGTGGCTCATGCCAGTAATCCCACCACTTTGGGAGGCTGAGGTGGTGGATCACTTAAACCCAGG
AATTTGAGACTAGCCTGGGCAACATGGTGAAACCCCGTCTCTACAAAAAATACAAAACGTAGCCAGGCAT
GATGGCATGTGCCTGTAGTCCCAGCTACTCAGGAGGCTGAGGTGTGAGGATCACTTAAGCCCAGGAATTG
GAGGCTGCAGTGAGCCATCACTGTACCACTGCACTCCAGCCTGGGCAACAGAGCAAGACCCTGTCTCCAA
GAAAAAAAAAAAAAAATCACAGAAGGAATAACAAATAACAGGCAGGCATTGAAACTACACTACGACAGGT
GCAGCAACTCATGCTTATAATCCTAGCACTTTGGGAGGCCAAGGCAGGAGGATCACTTGAGGCCAGGAGT
TCAAGACCAGCCTAGGCAACGTGAGACCCTGTCTCTACAAATTAGCCAGGATGGTGGTACACACTTATAT
TCCAGCTACTTCAGAGGCTGAGGGAGGAAGAGCGCTTGAACCCAGGAATTTGAGCTTGCAGTGAGCCATG
ACTGAGCCACTCACCCCATCCTGAGCAACAGAGTGAGACCTTATCTCTAAAAAAAAAAAAAAAAAAAAAA
AAAATTACACTACTATACTTGCTGTATCATTACAAATGCTTTGGCTGCATGTGACAGAAAACACACGG
GGCATATTTTTCTCATATATCTTTCTTTAAGAAGTCTGCAAACAGGACTTGTTGATGTTGGTTCAACAGC
TCAGTGATGTCATCTCTGTGATTCTAACCCTTTTCTTCATGGTCATAACTGCCACACAGCCACTCCTAAC
TGGAGCTGTTGATGTTGGTTCAACAGCTCAGTGATGTCATCTCTGTGATTCTAACCCTTTTCTTCATGGT
CATAACTGCCACACAGCCACTCCTAGCTGGGGCTAGGCAAGCAACTCTCTACCACAACAACAAGAAAACT
GTAGGAAACCTGGGCTTTGCTGAAAGTGAAGAGCTTGGCAAAATGGGTGGGGCTGAGTCCATTCCAGTGG
TGACCTCAGCTCCCTGGCTGTTGCACACAGTCTGAAAGGTCCAGGGAAACATGTAAATTTCCATATCACA
TTAGTATGTGGGAGAAGAGGGACAAAATATCTGTTGCAAACTTTATGTTTCATTTCTATTATCCAAGAAAC
TCTACCTATGGCATTCCTCACAAAAAACAACAACAAAAAAGGTCAGACTATGTGGTGAGAAAACATGAA
TTTTGGTTGCTACAAAACACAAGCAAGTTCAAAAAGAATGTTTATTTTAAGCTCTATGTACAGAAGAACA
GAGTATAAACGTAAAAAGGAACAAAGGAAACAAAAATGACAGGCATACATATTTACATAGCAAGTGTAGG
CAAAATGTGTCAAGAAGAGTCTTTAAATACATCTACTTTTAGCCTTTAACAGTCCAAATCAGTTTCTAAG
AATAATTTATCATCCAGGAAGAAGTTTTGGAAGTTTAAAGCTCAACCTTAAGTTGAGTTTAAATCCTTGA
GTTTAGAAGGCTTGTGTTGCTGATACCTTGGTCAACAGCTTTTGTGTTGACCATTTCTTCTTTAGTTCGC
TGTCCTTCTGACTGTGAAATGTGATGTCCAAACTGAAATAAAGCAAATATTTAACACAGAAATTATTCTA
```

FIGURE 130 cont'd

ATGTCAAAAAAAAAAAAGAATGGCAAGACAAAGGCCAGATGACCCTCTGAGGTTTCATTCACAATATTTA
TTTACCGTATTTATTACTATAATACATAGTTATTTGGCTATGTATCAGGTACTACGCTCAGAGCCAAGGA
CAAAAGTGAACGAGACACTCTCAGCGGCACAGACTGAGCTCTTAGGCAACTAAAATTTGAGTCCCTATGT
GCCCAGCCTGAAATTAAGTGCTAAAAACTATGTAAAAAAAAAAAAAAAAAAAAAAAAGAAGATTATCTAAA
ATACTTGTAATTGGCTGGAAAAAGTGCTAAGAGACACTGAACTAATAGCAAGCAGTAAATGACAACCTAG
AAACACTTCGTTTATCCACTATCACTGGGAAACAGTGTGTTCCACCTACGGGAACTTCTTACATAAATGC
ATCCTCAAATTTTCAAACATCCTCAAATTTTAAGAAACCAAGTTCTAGTCTCTGCTCTGCCCCTTAGATA
TGGGATTATAGGCACTACAGGGATCATTTCCCTCACATTTTCGGGGGAAAAGGGATTGCTGCTGTGAAGA
TCTAGTGAGATGAGTAAAAAAGGTACTTTGCAAGTTACAAACTGCTCTACAAATGTTAAAATTAAACATT
TATTTTAGACACACTTGCATTTTTATAGTAATAGTTCTAAAGTGTCTTCTTAAATAGTTAAAAGAATATA
ATTTTCTAAGTCAACATGCTAAACATCAGATATATACACACACACACAATGGTGAGCACAGAGGCTGC
ACACACTGGAGTGGCAATGTGTGTGTGTGACAAGTCCCTCCACTCTGTTACACTCTTTTTCTTTTTTTGT
TTTTTTTGAGACTGACTCTAGCTCTGTCGCCAGGCTGGACTGCAGTGGCACAATCTTGGCTCACTGCAAC
CTCCACCTCCGGGTTCAACCAATTCTCCTGCCTCAGCCTCCTGAGTAGCTGGAATTAATTACAGATGCG
TGCCACCACACCCGGCTAATTTTCGTATTTTAGTAGAGACGAGGTTTCACCGTGTTGGTCAGGCTGGTC
TCGAACTCCTGACCTCATGCATGATCTGCCCACCTCAGCCTCCCAAAGTGCTGGGATGACCACGCCCGGC
CCTGTTACACTCTTGGAGGGCTCAATGCATCTGAGTTTTCCAGTCTCTTCCTCTGCTGACGTCTGTCCTT
CCTCAGTGCTATCTAGCTGACTTTAGATGCTGTTCCTCTTCCACACTCCTGTCATTCTCAAGGCTTATTC
TTATGTGTTAATACTACCTCAACTAAATTAAGACATGTGAAAACCACCCCAAAATTAGAATTACTTCTAA
ATTTAAGAAAAGAGACTTCAAGTAAGGAGTAATCTTAAGGCTCAAATGCTTAAAATCCAGTGTTTGTCAT
CCTAGGCATCCAGTAAGTGCTGTCACTAAAGATAACTATAATCCCATTTGCTTTTTTACATGCAGAGTTA
ACATTATATTCAACAAAATATCCAAAGTCTGTATATTTGACAGAGAAAAATCTTGGCGTATTCACATTCC
ATATGGTTAGGGGGAATCTATTGCACCATTCTTCCCTGGCCCTCTCAAACTGTCAGACACCCAGTTCATA
CTGCAGATGGCAACATCAAATTGGCACCTAAGATAAGTCATTATAAACATATGCACAAATATTTTCAAA
TTAAGTATTTTATTTCAAAAGAGCTCATGATAGGCTAAAAGTGAAAATGAGCATATAAAATTAACAACAA
AAAAACCCCAGAAACATTAGCAGCATCAATAAACAATTATATAGCCCATTCTGCACAATTACTTCAAGAG
AACTTGAACACAAAGCTGTAACATAAACAACACATCTGAGAAAAACTGAAAAATTAATTTTACATTAGTG
TAGCTTACCCTTGAAGTTTCTGGACTAGAAAATGGGGAAGATTCCCAAGATCTATTCTCTTTCTCAAAAG
AATCATCTTCTTGAAATGCAAATTTCTGTTTAAGTGCATGAGATATTAAAGAAACTGGATCCCAATGTGA
ATTCTGTCTTTTCCTCTTATGAATGGGTCTACCGCCAGGTGACCTATTTTTAAAAAAAAAATTGAATT
TATTAAAACTTGGATGTAATTTTAGCTCCTTGTTGACAAACATGGCAGGAATACAAGCATATCTTACAAT
TTAATTAGTCTTCAAGAGATTGAAAATAATCTAATCTTCAAGAAATTTTCGCAATGAAATAAGGAAGGCA
CAATGAATGAAGAATCAGAAAACCAAGAACCCATGTGACTTGAGACTCTGCCATAACCTTGTTATGACCT
GAGATTTGTCAGATGTCACTATGCTGAAGATCTTTATTATGGTAATTTTCTAATTTCCTAATGGGTAGGA
AAATTCAAATAAATAAGAACTTTTAAAAGGACGAGAGTTCATGCCAAAAAAAAAAAAATTACGCAAATTG
TTCATTTGTTTGGTTGTTCATTCATTTAATCTTCATTGAATGCCCACTACCACATCCGACTCCATTTTAT
GCTTTGGGAGTATTCTGCTCCCAATTCTTACAGCAAGATTATCATCAATATACAAGTAAGATCATTTGGC
TGGTAATAAGAGCTGTGAATAAAACAAAACAGAGGCTGGGCACGGTAGCTCATGCCTATAATCCCAGCAC
TTTAGGAGGCCAAGGTGGGAGGACTGCCTGAGCCCAGGAGTTCGAGAGCAGCTTGGGTAACATAGCGAGA
CCCCATCTCTAGAAAAAATTTAAAAATTAGCCAGGCAACTACTTGGGAGGTTAAGGCAGGAGGATCACTT
GAGCCAAGGAGGTCAAGCCTGCAGCAAGTCATGGCACCACTACACTCCAGCCTGGGTGACAGAGCAACAC
CCTGTCTCAAAAAAAAAAAAAAAAAAACTAAATTAAAAAATAAAAATAGGGAAATGTAATAGTGATTAGG
GACAGAAGCACTTTAGATATGATCAGAAAAAAAGCCTCTTTAAGGAAGCAACATCCTCTTTAAGAAAATG
ACAAGGGTCAGTTTTAGTGTAAACATCTGGGGCTGCATCAGGAAGGAGCTTGGCATGTGTGAGAAACGG
AAAAAAGAAAGCAACTGCAGCTGGAGTGCAGTGGGCAAACATGGGGCATAGGAGAGGAGCTCAGCGAGAG
AAGTGAGGGCTGGCTCCTGGAGGGGCCTACGGACACAGCAAGGGCTCTAGAACTGATTCAAGCACAACGG
AAACCCACAGAAGAGTCTGAAGCAGGAGAATGGCCTGATCTGACTTCTGGTCACTATCTGCAGAATAAAT
AAGGAGGCAAGAATGAAAACAGATCACTGAGGAGGCTGCTGCGAAGTCTAAGCTAGATAAGAATGGGCT
TAGCCTGGGGAGTTGGCAGTGGAGGTCAAGAGGTCCACAGAATTGAGCTATGTGCTGATGGGAACGGTGG
GAGATAGAATGGAAAATAAAGATGAAGGATGATTCCTAGATATTTGTTTTTGTTTTTTGAGACGGAGTC
TCGCTTTGTCACCAAGGCTGGAGTATAGTGGCTCACTGCAACCTCCGCCTCCCGGGCTCAAACAATTAAT
TCTCCTGCCTCAGCCTCCTAGTAGCTGGGATTACAGGTGTGCGCCATCATGTCAGGGTAATTTTTGTATT
TTTAGTAGAGACTGGGTTTCACCATGTTGGCCAGGCTGGTCTCGAACTCCTGACCTCGAGTGATCTGCCC
ACCTCAGCCTCTCAAAGTGCTGTGTTTACTGGTGTGAGCCACCGCACCTGGCCTGATTCCTAGATCTTAA
GCAACCGGGTGATCGTGTTGCCATTTGCTAATATGCAAAAGACGTGGGAAGAACAGGTTTTCAAGGTGG
CGGAAAAGAACAGGTAGGAAGGAAAAGTCCTGTTTTGACCTGTGAAACGAGATACCTGTGAGACAGGCA
AATAAAGATGTCAAGTAGGCATTTCAGTATGTGCATCTGGGCTCAAGAGGAGAGGTCAGGGCTAGAAAAA
TAAACGTTTGAGTCATAAGCATACAGCTGGTATTTAGAGTCATAGGACTAGGTGAGCTCACCAAAGGAAA
CAGCATGGACAGAGAAGAGAGGGGGCTGAGGTCTGAACCAGGTATTTCAACATTTAAAGACCAGGCCCAG
GGGGAAGAGTTTAAGGAATAAGAAGGAATAGCTGATGAGGTCAGAGGAAACCTGGGGTATGCTTTCCCA
GAAACCAAGTAAAGAAAGTGCTCCAGGCTAGGCGCAGTGGCTCATGCCTGTAATCCCAGCACTTTGGGAG

FIGURE 130 cont'd

```
GCCAAGGTGGTCGGATCATGCGGTCAAGAGATCGAGACCATCCTGGCCAATACGGTGAAACCCTATCTCT
ACTAAAAATACAAAAATTAGCTGAGCATGGTGGCACATGCCTGTAGTCCCAGCTACTCGGGAGGCCGAGG
CAGGAGAATCACTTGAATCCAGGAGGCAGAGGTTGCAGTGAGCCGAGATCACGCCACTGCACTCCAGCCT
GGCAACAGAGCGAGACTCCGTCTCAAAAAAAAAAGAAAGTGCTCCAAGGAGGTGGGGACCATAGGCTGT
ATCAAATGCTGCCAAGAGGTCAACTAAGACGAGCAATGCTAAGAGACCAGTGGATTTAGCCACATGGAGT
CACTGGTGAAGCAGTTTTCAATGGAGTTTTCATGGGTAGAAGGCAGCAGCGATAGACAGAAACAAATTAT
AGACGACTTCAAGAATTCATATCAGAAAGGGGAGCAGAACAACAGAACAACGGCTGAGAGTACATGTGTT
TTGAAGGTGGGAAGTACTCAGGTGTGAGGAGAAGGATGAAGTATAGAAGGAAGACTCAGTGATGCAGAAG
GGCTCATTTTAAGTGAAATCCTTGTGAAGAGGAAAGAGAAGGGAAACCAGTAACCAAAGGAAGAGCCTGG
CCATGAATGATGACACTTGGCTCCCAACAGCAAGATGGAAGGCAGAGAATCTGCACGGGGAATCTGTAGG
TGTAAAGAGGTGAGAGAGCTCATCTGATTCCTCAGCAACGTACAAAACAAAGTTAGCTGTAGAGGCAACT
CAGGAGAGAATAGGGGGACAGGAGGCAGAGGCTACTGGCCTTTTAGTTGTTTTTCCAGTGATGGTAACAG
TCACAGAGTTGCCACTTGATACTAAGCCCGACAACACAAGTACAAGATCTAGTTGGGACCAAGCATGCAC
CTACAGCCATGAGATTCTTCTCAACAAGCTGCCTCATGCTCTTCCTGTGGTTACTGGTTTCCCTTCTCTT
TCCTCTTCACAAGGATTTCACTTAAAATGAGCCCTTCTGCATCGTTGCAAGGATCAAACTCACAACCTCA
TTAAAAACAGAACTGACTTATCTGTCCCAGGACTATCATACAGAAAATATATCTATTTTCTCACCGAAAA
CCTCACTGAGGGATTTCCAAGTAAGCATGGCAAATCCCTTGTGAAATCCTACTAAAATGACAGTAAAGAA
ATGAAAAGATCTATATATCCACAAGGACAAAGAGATTAGAAGGGGAGACAGGAGATAAGAATTGCAACC
AGATGCCGGAAGCTGGAAAGCTGATGAAAGTGAGAGCATGGGGCGTGGGCGCCCTGCTGAACACAGGGCG
TGTGCTAAATAAGACACTTCTCTCTTGCTCCTCTTTCCCCACTCAGCTCTCCAATGACCTGACTTGCACC
CGCTGTGTAATCCCCATCCCTCCTGACCACAAGGGAGAATGAAGAACTTTCTAAGGAAAATCCTGTAGCC
CAAAAGAAAAGACATACAGCTCTGGGGTGTGGCCAACAAAATGGTCCTCTCCCTAATCACTAAACTGTGA
AGCTCCCAAGTTGATAAGCCCACCTCACACAAAGAACATGCGATCAGCTTTTCCTTGCCTCATTTTAAAT
AAGAATCACCAGATGCTTACCCAAGGCTACAAAACTAAAGATAGAGATCAAAGCTAAAGGAAAAAGAA
ACTCACAAAAAATACAGTAATTCAAGAACAGAGGAAACTTAAAACAAACCTACACTTTTAATACTGTCAG
TGGGATAAGACCAACAAAACCAAAAAGATTTTAACAAGAAGCATTTGAAGAAAAAGAAACAGCTCTTAAA
AATTAAAAATGTGGGCCAGGTGTGGTGGCTCACACCTGTAATCCCAGCACTTTGGGAGGCCGAGGCCGGC
AGATCACAAGGTCAGGAGTTCATGACCAGCCTGGCCAACATGGTGAAACCCTGTCTCTACTAAAACTACA
AAAATTAGCTGGGCATGGTGGCACGTGCCTGTAATCCCAGCTACTCGGGAGGCTGCAGCAAAAGAATTGC
TTGAACCAAGACCCAGGAGGCAGAAGCTGCAGTGAGCCAAGATCATGCCACTGCACTCCAGCCCGGGCGA
CAGAGCCAGACTCCATCTAAAAAAAAAAAAGAATAAAGAACATTTTTGGACATGCAAAGTAGTAAACTA
ATCTACCCTTTATGTTTCTCAGGAAGCTATAGGAAGATATGACATTTAGGAAATCAGTGATGCAGCATAG
AAAAAAGGGGCAAGAATGCTCAAGAGGTAAGCGAAGGAAATCCTTCAGGCACAGAGGGATCCTTGAGGA
GAATCACCAAGAACTAAATGGAGGGTCATCCAAAAATTAGAAATAGAACTACCCTATGATCCAGCAATCC
CACTTCTGGGTACTTATCCAAAAGAAGTGAAATCAGCATCTCAAAGAGATATCTGCACACCCACATTCAT
TGCAGTGCTATTTACAATAGACAAGACATGGAAGCAAACTAAATGTCTATCAACAGATGAATGGATTAAG
AAATGGGATATATACATACAATATACAGCATGCTAAGTGAAATAAGCCAGTCACAAAAGATAAATGCTG
CATGATTCACTTATATGAGGCATCTAAAGTAATCAAACTGGGCCAGACACAGTGGCTCTTGCCTGTAATC
CCAGTACTTTGAGAGACCGAGGCAGGAGGATCACTTGAGCCGAGTTCAAGACCAGCCTGGGCAACACAGT
GAAATCCTGTCTCTATTTTTTTTAATAAGATAAAATAAAAATAAAGTAATCAAACTATAGAAGTAGAAA
GAAGAATGGCAGTTGCCAGGGGATGAGGGGAGAGGGAAATGATTACTGTTCAGTGAGTATAAAATTTCAG
TTATGCAAGATGAAAAGCTCTAGAGATCTGTTGTACAACATTGTGCTTAACGATACTGTATTATACACA
TAAAAATTTGTTAACAGAATAGAGCTCATTATGTTTTTTCACCACACACACACACACACACACACACACA
CATGGAACTCAGAGAGGCAATTATTAACTCTAAAAAAATTATTCAACAAATAAATGTAGTCAAAATATA
TGAAATGGGGCCAGGCACAGTGGCTCACACCTGTAATCCCAGCGCTTTGGGAGGCCAACATGGGCAGATC
GCTTGAGCTCAGGAGTTAGAGACCAGCCTGGGCAACATGGCGAAACCCCATCTCTACAAAAAAATACAAA
AATTAGCCAGGCATGGTGGCACATGCCTATAGTCCCAGCTACTAAGGAAGCTGAGGTGGAGGATCACTT
GAGCCCAGGAGGTCGAGGCTGCAGTGAGCTGTAATTTCAACACTGCCCTACAGCCTGGGTTACAATATGA
GAAATGGCTTACTGTGGATGTTCACTGTTATAATAAGGATATTAATTCTGAATACTCATTTAACTAAAGA
TTGTGGTTTAACTATTTCAGGAAGACGTGGCAAGATGTGTGTGTGTCCTGGGTAGAGTATCTAAGAAA
ATATATTCCTAATATCCTACAATTGGAAGTCAACATAATTAAAATATCAAGAAATAGCAAATAAGTATGT
TGTTTCAAAAATATGGTGATAAGAGACTAGAAGAAGAAATAGTCAAAAATAATTGAATGTCATTATCTCT
AGGAGAGGTATTCAGGGGTGAAGAAGAATAAGAAAAAGACATATATGTTAATTTTCATAAACATAATAA
TTTTTCTAAACATAAAATTGACAAAATTTCAGTTCACTTTTCAAATTACAACAACATACCGCTCAATTGC
ACGAAGCTTAACCTTATTCATATCCTTTAGAACGTCCAACATGTTTGGAATATCTTTATTTCTCTGGCTT
TTTGAATGATGACTATAATTGGTCTTATTAGCAGCCGGGTTCTGTTTGCTCATTTCAGTTGCTGGATTAT
CTGAGTCACAAATATTATTAGATCCTGGTTGTACGGGAGGAAAACACGGTGGCTGGAGAGATGAAAACTG
AGGAGGAAGTGGTGGAGGAGGAGGAGGAGAAAGCACTGAACCTGGAAGCTGATCTGGGTCCAACACTCAGA
TGGGCAGCCCGCGATGATGACAGCTGACCCAAACTAATGCGCTCGTCACTCAAGCCAAAGGAACCTACAA
ACAAAGTGGTTTATTACAAAATCATGCACAATTATCTCTAACGTAATATATATTAATAACACTAATTAGA
ACCAAAACAGGAGCAATTTCTGTAATGCTAGTAGCGATATGGTAGCAAGGAAAGAGTGTCAATCCCATCT
```

FIGURE 130 cont'd

GCTTAGTAATTTAAGAGTCAAGTCAAATTGTGAATTCATTTTTAATCCAGTTAGGAATTTTCAGTGTAGG
TCCAAGAGCAGAGCGGGGAGGAGAATGCATCTTAAACAAACAAAAAAAAGAGTTTTTTCAGTAATTCACA
TACACTCTGAACTTCATCCTCTATTTTAAAAAAGCTAAAACAGAAATCAACAACTTGTAGTTAGAAACAC
AAATTGATGTATTCACTGTATAATGACATTGGAGAAATAAGCATATTATTTTCTAAGCAAAGCTTAAGAT
GGGTACTGAGTATTTAACTTTTCCACTTTAAGATTTGCTCATAAAGGACTGTGGGTAAACACGATTGCTT
AAGAAAACTGTGTATAGTTATATATCATTTTATTTATTATGTATAAATATAAGTTATTGTATATTATATA
ATGTGTTTATATGTAAATGTTATAAATATACACTGTATAAATATCTTAAATTATATGTGTATTTATGCAT
TTGTATATATACATATGTATTAAAAAATTTTTAGCAATTATATTTACACACAGCCCTTTACAGCCAAATC
TGTTGTGAAAAGCATTCAGTACCTAGATTGCTTTACATTTTATACACGCATACATACATGTTGTGTGTAT
GTGTGTGCATAAGTTTAAAGCAAGTTGTATCTCTATAAATTTATAAAACAATCATCTGGAAAACATGACT
CACCTCAACTTGGTGGAAGTGTAGCAGCAATAACTAAAAACTATAAACATATGTGCCTCAAACCTATAT
CCTCTTTCAAACCAATGCATTCTTCCTCTTTAATATCCAATGCTTTCATGAAGAGTTAGAAAAGCTTACT
GAGGGCCGGGCGCGGTGGCTCACGCCTGTAATCCCAGCACTTTGGGAGGCCAAGGCGGGCAGATCACGAG
GTCAGGAGATCGAGACCATCCTGGCTAACACGGTGAAACCCCGTCTCTACTAAAAATACAAAAAATTAGC
CGAGCGTGGTGGCGGGCGCCTGTAGTCCCAGCTACTCGAGAGGCTGAGGCAGGAGAATGGCGTGAACCCG
GGAGGTGGAGCTTGCAGTGAGCCAAGATCGTGCCACTGCACTCCAGCCTGGGCGACAGAGCAAGACTGCG
TCTCAAAAAAAAAAAAAAAAGCTTACTTAGAAGACAACAGACTTTTTAATACAAAATACAATCTTCTA
GTATAGTAAAGCTAGTTCTTCTTTAAATCAAAGCCATCCCCTCACTACAAATGTGTCTTAATTTATCCTG
AATAAACATCAGATATAATAATTTTGTATATTCAACATCCTTTTATGTACATTTAATGTTTTCATGGTAC
TTATTCAGAATTGTACTCACTTAAATACTAGATGTTCCTGTATGCTACTATACGTACTATATTCAGTACA
GTATCATGCTGTACAGGTTGGTATAGGCTATACCATGAGTATCATCTAACTGAAACAAAAATCCTACTGT
TACTTACTAGAATTTGTACTATTTTTCAGTTCCTGCATTTCCACAATTGCTGCAATCTGAGAGCGAAGAA
AAGTCAGCTCATTTTCAAGGGCAGCTATTTTTCTAATTGCAGCTTCATTTACAGGCAGGTCATTTTTCAC
AGTTTCTTTCTGTCTTACAGCAGGTGACAGTGGATCCCGAACTAGTCGCAAAGGATGAAAAATTTCCACT
TTCTCTTCTTCATTTTTCCATATACTATTTCTGTGGTGAAAAAAAATAGGAAATGGAGGGAAGATATAT
TTCCAATCAAAAGAGGTATAAACTCTTACACTCCTACGTGAAAATCAAAAGACAATAAAACAAAATAAAA
GCTACTCTCAGGCCGGGCACAGTGGCTCACACCTGTAATCCCAACACTTTGGGGGCTGAGGCAGTGAATC
ACCTGAGGCCAGGAGTTCGAGACCAGCCTGGTCAAAATGGCGAAACCCTGTCTCTACTAAAAATATTTTT
AAAAATTCGCCGGTGTGATGACGTGCCCCTGTAGTCCCAGCTACTCAGGAGGCTGAGGCAGGAGAATCAC
TTGAGCCTGGGAGGCAGAGGTTGTGGTGAGCCAAGATCGTGCCATTGCACTCCAGCCTGGTCGACAGAGT
AAGACTCTGTCTCAAAAAAAAAAAAAAAAAAAAAAAAAAACCTACTCTCTATCCCCCATGATTGTTTC
TAGAGTCACCACTGAGGACAAGGAAAATATCTTATTTAGCTTTGTATTCCCAATATAAACAGAACATAGC
CTCCAATGGAGGACCAGTCAGTGACCAGGGAATGAACAAAACAAACTTTGCTTTTAGATTATAAAACCAA
AATAATTACCTGCAATTGTTCTACTTATTAACTTTAAACGCAGGTAAGTTAATTTATTTAGAAGTTCTAT
ATAAGTTAATAAAGAGCCTTACATTCAGGATTATGTTAGGGTGAAATGTATGTTATTTTAACTATTTGAA
AATTGGTGCCAGTTTGATACATAATAAAATCAGCCGGAATACTTAAATAATTGACACTTAATGTGCTTAG
AGCCTGTATCTGAATATACTAACATATAAAGTAATACTCCCTAGGAGTAACACATCCAAATTTTGAAATA
CATTTAACATCATTGCCTGGTGCACAGTAAACAGTATATAAGTTTTGGCTAAAAACATGATTCTAATATC
CCTTTAATAACCACTCCCTCCTAGGCCTGGTGTTAGGTTTAAATGTGCACTAAAAAAAAAACAACTGGCT
AAAAAAATGAAAAGCAGCCAGTCTTCTTTATTAAGAAGATAGGGCACAGCACAGTTTGAAGATAA
ACAAAACAAAAAAGCTCAATCAATCTTAACAAGCTTCGACACATGCAAGAATTCAGTTTATAGCCCACTT
CCCAAGATAAGCATATAAAATTACCGAAATCTGAGATAACTGGCTTCTTCATCATTTGCCACATACAAAA

FIGURE 131
SEQ ID NO: 123
Genbank ID      : AF030514.1
Unigene ID(#167) : Hs.103982
Unigene name    :       chemokine (C-X-C motif) ligand 11    CXCL11
>gi|3219692|gb|AF030514.1|AF030514 Homo sapiens interferon stimulated T-cell al
pha chemoattractant precursor, mRNA, complete cds
CTCCTTCCAAGAAGAGCAGCAAAGCTGAAGTAGCAGCAACAGCACCAGCAGCAACAGCAAAAAACAAACA
TGAGTGTGAAGGGCATGGCTATAGCCTTGGCTGTGATATTGTGTGCTACAGTTGTTCAAGGCTTCCCCAT
GTTCAAAAGAGGACGCTGTCTTTGCATAGGCCCTGGGGTAAAAGCAGTGAAAGTGGCAGATATTGAGAAA
GCCTCCATAATGTACCCAAGTAACAACTGTGACAAAATAGAAGTGATTATTACCCTGAAAGAAAATAAAG
GACAACGATGCCTAAATCCCAAATCGAAGCAAGCAAGGCTTATAATCAAAAAAGTTGAAAGAAAGAATTT
TTAAAAATATCAAAACATATGAAGTCCTGGAAAAGGGCATCTGAAAAACCTAGAACAAGTTTAACTGTGA
CTACTGAAATGACAAGAATTCTACAGTAGGAAACTGAGACTTTTCTATGGTTTTGTGACTTTCAACTTTT
GTACAGTTATGTGAAGGATGAAAGGTGGGTGAAAGGACCAAAAACAGAAATACAGTCTTCCTGAATGAAT
GACAATCAGAATTCCACTGCCCAAAGGAGTCCAGCAATTAAATGGATTTCTAGGAAAAGCTACCTTAAGA FIGURE 131 cont'd AAGGCTGGTTACCATCGGAGTTTACAAAGTGCTTTCACGTTCTTACTTGTTGTATTATACATTCATGCAT
TTCTAGGCTAGAGAACCTTCTAGATTTGATGCTTACAACTATTCTGTTGTGACTATGAGAACATTTCTGT
CTCTAGAAGTTATCTGTCTGTATTGATCTTTATGCTATATTACTATCTGTGGTTACAGTGGAGACATTGA
CATTATTACTGGAGTCAAGCCCTTATAAGTCAAAAGCATCTATGTGTCGTAAAGCATTCCTCAAACATTT
TTTCATGCAAATACACAYTTCTTTCCCCAAATATCATGTAGCACATCAATATGTAGGGAAACATTCTTAT
GCATCATTTGGTTTGTTTTATAACCAATTCATTAAATGTAATTCATAAAATGTACTATGAAAAAATTAT
ACGCTATGGGATACTGGCAACAGTGCACATATTTCATAACCAAATTAGCAGCACCGGTCTTAATTTGATG
TTTTTCAACTTTTATTCATTGAGATGTTTTGAAGCAATTAGGATATGTGTGTTTACTGTACTTTTTGTTT
TGATCCGTTTGTATAAATGATAGCAATATCTTGGACACATTTGAAATACAAATGTTTTTGTCTACCAAA
GAAAAATGTTGAAAAATAAGCAAATGTATACCTAGCAATCACTTTTACTTTTTGTAATTCTGTCTCTTAG
AAAAATACATAATCTAATCAAAAAAAAAAAAAAAAAAAAA

FIGURE 132
SEQ ID NO: 124
Genbank ID      : NM_002639.1
Unigene ID(#167) : Hs.55279
Unigene name    :     serine (or cysteine) proteinase inhibitor, clade B
(ovalbumin), member 5     SERPINB5
>gi|4505788|ref|NM_002639.1| Homo sapiens serine (or cysteine) proteinase inhib
itor, clade B (ovalbumin), member 5 (SERPINB5), mRNA
GGCACGAGTTGTGCTCCTCGCTTGCCTGTTCCTTTTCCACGCATTTTCCAGGATAACTGTGACTCCAGGC
CCGCAATGGATGCCCTGCAACTAGCAAATTCGGCTTTTGCCGTTGATCTGTTCAAACAACTATGTGAAAA
GGAGCCACTGGGCAATGTCCTCTTCTCTCCAATCTGTCTCTCCACCTCTCTGTCACTTGCTCAAGTGGGT
GCTAAAGGTGACACTGCAAATGAAATTGGACAGGTTCTTCATTTTGAAAATGTCAAAGATATACCCTTTG
GATTTCAAACAGTAACATCGGATGTAAACAAACTTAGTTCCTTTTACTCACTGAAACTAATCAAGCGGCT
CTACGTAGACAAATCTCTGAATCTTTCTACAGAGTTCATCAGCTCTACGAAGAGACCCTATGCAAAGGAA
TTGGAAACTGTTGACTTCAAAGATAAATTGGAAGAAACGAAAGGTCAGATCAACAACTCAATTAAGGATC
TCACAGATGGCCACTTTGAGAACATTTTAGCTGACAACAGTGTGAACGACCAGACCAAAATCCTTGTGGT
TAATGCTGCCTACTTTGTTGGCAAGTGGATGAAGAAATTTCCTGAATCAGAAACAAAAGAATGTCCTTTC
AGACTCAACAAGACAGACACCAAACCAGTGCAGATGATGAACATGGAGGCCACGTTCTGTATGGGAAACA
TTGACAGTATCAATTGTAAGATCATAGAGCTTCCTTTTCAAAATAAGCATCTCAGCATGTTCATCCTACT
ACCCAAGGATGTGGAGGATGAGTCCACAGGCTTGGAGAAGATTGAAAAACAACTCAACTCAGAGTCACTG
TCACAGTGGACTAATCCCAGCACCATGGCCAATGCCAAGGTCAAACTCTCCATTCCAAAATTTAAGGTGG
AAAAGATGATTGATCCCAAGGCTTGTCTGGAAAATCTAGGGCTGAAACATATCTTCAGTGAAGACACATC
TGATTTCTCTGGAATGTCAGAGACCAAGGGAGTGGCCCTATCAAATGTTATCCACAAAGTGTGCTTAGAA
ATAACTGAAGATGGTGGGGATTCCATAGAGGTGCCAGGAGCACGGATCCTGCAGCACAAGGATGAATTGA
ATGCTGACCATCCCTTTATTTACATCATCAGGCACAACAAAACTCGAAACATCATTTTCTTTGGCAAATT
CTGTTCTCCTTAAGTGGCATAGCCCATGTTAAGTCCTCCCTGACTTTCTGTGGATGCCGATTTCTGTAA
ACTCTGCATCCAGAGATTCATTTTCTAGATACAATAAATTGCTAATGTTGCTGGATCAGGAAGCCGCCAG
TACTTGTCATATGTAGCCTTCACACAGATAGACCTTTTTTTTTTTCCAATTCTATCTTTTGTTTCCTTTT
TTCCCATAAGACAATGACATACGCTTTTAATGAAAAGGAATCACGTTAGAGGAAAATATTTATTCATTA
TTTGTCAAATTGTCCGGGGTAGTTGGCAGAATACAGTCTTCCACAAAGAAAATTCCTATAAGGAAGATT
TGGAAGCTCTTCTTCCCAGCACTATGCTTTCCTTCTTTGGGATAGAGAATGTTCCAGACATTCTCGCTTC
CCTGAAAGACTGAAGAAAGTGTAGTGCATGGGACCCACGAAACTGCCCTGGCTCCAGTGAAACTTGGGCA
CATGCTCAGGCTACTATAGGTCCAGAAGTCCTTATGTTAAGCCCTGGCAGGCAGGTGTTTATTAAAATTC
TGAATTTTGGGGATTTTCAAAAGATAATATTTTACATACACTGTATGTTATAGAACTTCATGGATCAGAT
CTGGGGCAGCAACCTATAAATCAACACCTTAATATGCTGCAACAAAATGTAGAATATTCAGACAAAATGG
ATACATAAAGACTAAGTAGCCCATAAGGGGTCAAAATTTGCTGCCAAATGCGTATGCCACCAACTTACAA
AAACACTTCGTTCGCAGAGCTTTTCAGATTGTGGAATGTTGGATAAGGAATTATAGACCTCTAGTAGCTG
AAATGCAAGACCCCAAGAGGAAGTTCAGATCTTAATATAAATTCACTTTCATTTTTGATAGCTGTCCCAT
CTGGTCATGTGGTTGGCACTAGACTGGTGGCAGGGGCTTCTAGCTGACTCGCACAGGGATTCTCACAATA
GCCGATATCAGAATTTGTGTTGAAGGAACTTGTCTCTTCATCTAATATGATAGCGGGAAAAGGAGAGGAA
ACTACTGCCTTTAGAAAATATAAGTAAAGTGATTAAAGTGCTCACGTTACCTTGACACATAGTTTTTCAG
TCTATGGGTTTAGTTACTTTAGATGGCAAGCATGTAACTTATATTAATAGTAATTTGTAAAGTTGGGTGG
ATAAGCTATCCCTGTTGCCGGTTCATGGATTACTTCTCTATAAAAAATATATATTTACCAAAAAATTTTG
TGACATTCCTTCTCCCATCTCTTCCTTGACATGCATTGTAAATAGGTTCTTCTTGTTCTGAGATTCAATA
TTGAATTTCTCCTATGCTATTGACAATAAAATATTATTGAACTACC

FIGURE 133
SEQ ID NO: 125
Genbank ID         : AV734646
Unigene ID(#167)   : Hs.381220
Unigene name       :         chromosome 6 open reading frame 187 C6orf187
>gi|10852191|gb|AV734646.1|AV734646 AV734646 cdA Homo sapiens cDNA clone cdAAGE
02 5', mRNA sequence
ACTTTGCTGATTTAGCTTATGGAAGAGGAACCAGAAATTTGTCCTTGAATAATGTTTCCCGTGTTGGGCT
GGATCTTGATAGCAGTTGTTATCATCATTCTTCTGATTTTTACATCTGTCACCCGATGCCTATCTCCAGT
TAGTTTTCTGCAGCTGAAATTCTGGAAAATCTATTTGGAACAGGAGCAGCAGATCCTTAAAAGTAAAGCC
ACAGAGCATGCAACTGAATTGGCAAAAGAGAATATTAAATGTTTCTTTGAGGGCTCGCATCCAAAAGAAT
ATAACACTCCAAGCATGAAAGAGTGGCAGCAAATTTCATCACTGTATACTTTCAATCCGAAGGGCCAGTA
CTACAGCATGTTGCACAAATATGTCAACAGAAAAGAGAAGACTCACAGTATCAGGTCTACTGAAGGAGAT
ACGGTGATTCCTGTTCTTGGCTTTGTAGATTCATCTGGTATAAACAGCACTCCTGAGTTATGACCTTTTG
AATGAGTAGAAAAAAAAATTGTTTTGAATTATTGCTTTATTAAAAAATAAACATTGGCAAAAAAAAAAA
AANAANAAAAAGCGGCCCGCTTCGAGCTCACTTGGCCTCGCCCTTATAGTGGN

FIGURE 134
SEQ ID NO: 126
Genbank ID         : AL524035
Unigene ID(#167)   : Hs.334562
Unigene name       :         cell division cycle 2, G1 to S and G2 to M
     CDC2
>gi|45699297|gb|AL524035.3|AL524035 AL524035 Homo sapiens NEUROBLASTOMA COT 25-
NORMALIZED Homo sapiens cDNA clone CS0DC003YN06 3-PRIME, mRNA sequence
CAAAGSBAGTCATTTTVGTTAAATATACATTAGAGCCTTTTTAGAAGGCTGCAAATAAACACTATGTCAA
AATGTGTAGTTTTAAACTCAGACTCGAAAGCHAAGAWAAGCACCTCCTTCAGTWATTACTCTGACCAAGG
CATAAGAATTCACTTAGACAAAAAGMTTTCAAAACCTACCTAAAAATAAGATAGTTCATAAATKTTCAAM
ACKGTCCTTCCCTGTGGCGGACAGCCCTTGAKCTTKGTCAGASTTAGCAAATCCCSSCATGCCCTCATGT
CAGCCTTTYMAGTCACTGACAACTCCTATAAATTTAGCATCATTTCTCAAATCTGTATAGTTTTCTCATT
CCGAATGCTTAAACATTTAGGTCAAAAATTAAAATACCAGTAGAAAAATATTCATCTTTAGCCAGGTTGT
ATAGTTAACAACATGGCAAGAAACTGATGAGAACATTTAAACATTCAGAGCATAAAAATACTTCAAAGCA
TTACGAAACTTGAACTTAGCATTTTCCTAAATTTTAGTAGTTCCAACTACAGGAAAATAAAACTGCCATA
AGGACTGAGATGATTTAAGCCAACTCAAATTTTTTCCTGATTCCTGACATCAATATTATAGTTTTATTAT
AGTAACAAATAGTTGTSACAGTGAGACCTACACACATTTACAGAATTATATTTAAATTCATATAGAATAT
TTACATTTTTAAGTKATATTTTTGAAATTAGAAGACGARKACAGCTGAAGTTTGATAACAAAGAAATATA
TATAAGACAAAAATAGACAAGAGTTAACAATAAAAACACAACTATCTGTTGACATAACATATGGAAACTT
TTTGTCAGAAAGCTACATCTTCTTAATCTGATTGTCCAAATCATTAAAATATGGATGATTCAGTGCCATT
TTGCCAGARATTCGTTTGGGCTGGATCATAGATTAAMATTTTCGAGAGCAATCCAAGCCATTCTCATCCA
AGTTTTTGACATGGGATGCTAGGCTTCCTGGTTCCAATTTGGGAAATGTATTCTTATAGTCTGTAAGATT
TCACTTCTGGCACAMTTCAATATTKGGAGTCCCMAGCCTGAAATCCTGAAGAGTGAYAATTCTGAATCCA
TGGAAAGTGGTCTWAGTG

FIGURE 135
SEQ ID NO: 127
Genbank ID         : NM_018455.1
Unigene ID(#167)   : Hs.283532
Unigene name       :         uncharacterized bone marrow protein BM039 BM039
>gi|8922096|ref|NM_018455.1| Homo sapiens uncharacterized bone marrow
protein B
M039 (BM039), mRNA
AATTTCGGCACGGGGGGAGGCACAGTGAGTCCACTGGGGCACGGCAGCGTCTAAGCCACAAGCCGACTG
ACATAAGCCAGGTCCTAACGGAGCCTATGTGTAAGTCCACTACTGGTGCAAGGTTGCACACTTCTAAGAA
GAGCGGCGTGCGGGCCTCGGCGACCTTCGCTTCAGTCGCTCCCCCGTGCAGTCCCCTGTGCCCAAGACAC
AGCCTGATGCTTGTGCTCCGGTGGGCGGACTTGGAGGCGGCGGGAACTGCAATTGGTGGCTTTGAAGGGC
GGCGAGCGGGAACAGCTCTTGAGGAGTGAGACTGCAGGAGATGTGGGCCGTGCCAAAGAGATGGATGAGA FIGURE 135 cont'd CTGTTGCTGAGTTCATCAAGAGGACCATCTTGAAAATCCCCATGAATGAACTGACAACAATCCTGAAGGC
CTGGGATTTTTTGTCTGAAAATCAACTGCAGACTGTAAATTTCCGACAGAGAAAGGAATCTGTAGTTCAG
CACTTGATCCATCTGTGTGAGGAAAAGCGTGCAAGTATCAGTGATGCTGCCCTGTTAGACATCATTTATA
TGCAATTTCATCAGCACCAGAAAGTTTGGGATGTTTTTCAGATGAGTAAAGGACCAGGTGAAGATGTTGA
CCTTTTTGATATGAAACAATTTAAAAATTCGTTCAAGAAAATTCTTCAGAGAGCATTAAAAAATGTGACA
GTCAGCTTCAGAGAAACTGAGGAGAATGCAGTCTGGATTCGAATTGCCTGGGAACACAGTACACAAAGC
CAAACCAGTACAAACCTACCTACGTGGTGTACTACTCCCAGACTCCGTACGCCTTCACGTCCTCCTCCAT
GCTGAGGCGCAATACACCGCTTCTGGGTCAGGAGTTAGAAGCTACTGGGAAAATCTACCTCCGACAAGAG
GAGATCATTTTAGATATTACCGAAATGAAGAAAGCTTGCAATTAGTGAACATGAAAGGAAATAAAAATT
CCTCACAGTCAAAAAAAAAAAAAA

FIGURE 136
SEQ ID NO: 128
Genbank ID      : AB037734.1
Unigene ID(#167) : Hs.4993
Unigene name    :         protocadherin 19   PCDH19
>gi|7242980|dbj|AB037734.1| Homo sapiens mRNA for KIAA1313 protein, partial cds
AAGCGAGACAACAAAGAGATCCGGACCTACAACTGCAGAATTGCTGAGTACTCCTATGGGCATCAAAAGA
AATCAAGCAAGAAGAAAAAAATCAGTAAGAATGACATCCGCCTGGTACCCCGGGATGTGGAGGAGACAGA
CAAGATGAACGTTGTCAGTTGCTCTTCCCTGACCTCCTCCCTCAACTATTTTGACTACCACCAGCAGACG
CTGCCCCTGGGCTGCCGCCGCTCTGAGAGCACTTTCCTGAATGTGGAGAACCAGAATACCCGCAACACCA
GTGCTAACCACATCTACCATCACTCTTTCAACAGCCAGGGGCCCCAGCAGCCTGACCTGATTATCAACGG
TGTGCCTCTGCCTGAGACTGAAAACTATTCTTTTGACTCCAACTACGTGAATAGCCGAGCCCATTTAATC
AAGAGCAGCTCCACCTTCAAGGACTTAGAGGGCAACAGCCTGAAGGATAGTGGACATGAGGAGAGTGACC
AAACTGACAGTGAGCATGATGTCCAGCGGAGCCTGTATTGTGATACTGCTGTCAACGATGTGCTGAACAC
CAGTGTGACCTCCATGGGATCTCAGATGCCTGATCATGATCAGAATGAAGGATTTCATTGCCGGGAAGAA
TGCCGGATTCTTGGCCACTCTGACAGGTGCTGGATGCCCCGGAACCCCATGCCCATCCGTTCCAAGTCCC
CTGAGCATGTGAGGAACATCATCGCGCTGTCTATTGAAGCTACTGCTGCTGATGTCGAGGCTTATGACGA
CTGCGGCCCCACCAAACGGACTTTCGCAACCTTTGGGAAAGATGTCAGCGACCACCCGGCTGAGGAGAGG
CCTACCCTGAAAGGCAAGAGGACTGTCGATGTGACCATCTGCAGCCCCAAGGTCAACAGCGTTATCCGGG
AGGCAGGCAATGGCTGTGAGGCGATTAGCCCTGTCACCTCCCCCTCCACCTCAAGAGCTCTCTGCCCAC
CAAGCCTTCCGTGTCTTACACCATTGCCCTGGCTCCCCCAGCCCGTGATCTGGAGCAGTATGTCAACAAT
GTCAACAATGGCCCTACTCGTCCCTCTGAAGCTGAGCCCCGTGGAGCTGATAGCGAGAAAGTCATGCATG
AGGTCAGCCCCATTCTGAAGGAAGGTCGCAACAAAGAGTCCCCTGGTGTGAAGCGTCTGAAGGATATCGT
TCTCTAAACCAGTCTCCAGGAAGAAGAGAAAGAAACCACACTGGCTAGTGAAGAAGCAGGAGCTTCTTGT
TTTAATTGCTCACCAATGGTTGGTTCTTGAGTGGCTATATTTCAGAGCTTTTCCTAAATGTATTGTTTAT
AGGTGATTATCATTCTGTGACAGTCCCTTGTTTCAACTTGTTCAGTTGGAGCAAATTAGCTTTGGCTTGA
GTTGTTCATGGGGCCTTGATGTTGGGGAAACAGAGACAAATTCAGTTGTGAAAAGTATTATGTATTAAGT
GTTTGAATTTATATATTTTTCTATGTCAAAATTATAATATAAATTACCATTGTTTGTGGAGGATTACATT
TAAAAAAGCAAAAAGTGAAAAAAAAAAAGCTCTGGACACCTTTAATAAGCTCGCCACTGTTTTTTGTAGT
GTAGACAAGTTAATGGTCATTTATTGTGTACTATTCATTGATTCAGTGATGTGAAATTGAGCCCCCAAAA
GGTTGTTTCTGAAGCTCGAGTACTTCCCAATGCCCCTACTTTGCTGTGGACACCCCTGCTTTAAAAACCC
TTTTGCTAGCTGTCGTATTGTTGTATTTGATATTGCAAATTGCTATGTGTGGGTGATGGCAAAAGGCTT
TTAAAAGTTGGTGTTTTCTTTTTCTTAAAAAAATAATAAAACTACAGACAAAAACAAAGTGCAAACAACT
GAGACAGCAAATGAATGAGCAACACCATGCATATAGATTGAGTACTTGGAGAATACTCACGTTTTTTAAC
TCATGTAGTGATTGCTCACCACTTTGCAAAGTATTTTTCCTGCCTTTCAGTGGTCTGCCCAGGTCCATGA
TAGATCATTGCAGAAAGTCATTTTTGGATAGGCTGCTATCTAATTTGCAGTTGTCAGAAATACTGTGCTG
AAAGTTTTATGACATCCATCTTTTAAATTTTCAGGCCCTGAACAGGAAAGTTGCTCCTGAAGTTATGTTT
CCAGGCTTAGAAATTCCCTCTCTCCAATCATCTAAAATTGAAGATGACTGAATCTATTTTAAGATCTAAA
TTAGCATCTCTTCAGACACACACTTCCTGATTCAGTGTTTCCCAATCATGATTAGAATTAGACTGCAAAG
CACGTCATGGGCTGGGATTGAGAACTCCATGTTGCTCTGTATCTTAGGCTTATATACGTAGGGATAGAGT
AAGCAGTACAAAGTGTATATTTTGGAAAAGACAGGTAACAGGTAACAGCATCGCTAATCCAATTACTGTG
CCTTCTAAACGGAGACACTCAGACACTTGAACTCATCTTTTTATGACTAATAGTTTTTTGATTAAAAATG
TGAACAAGAAAATACTAAAATAAAAATCCTTTCGATTTAGCCAACTCTTTTTGCTGTAGGCTAGGAATAC
ACCCTTTTTAAATTAACACACTGTAGATCCTTTTTTTCTGTTTTAACATTCCTCTAACTCCCCCATTTAT
CTTTTGTCTATTAATATTCACTAGCCAACATAGTATTTTTGCAGCCTAAGAGTTCATTATTTAAAAATAA
ACTAAAGAAATATGTCACCTTTGTTCTGCCTTGGTCTTAAGAGAGTTGTTTCTAGAGAAACAAGTTTAT
GGTTCTGTTTTCATTTGTTTCATTTTTTGAAATTCAGGAATACACAGAGAGAAGGCCTAGAGGTTAGAGC
ACTAGAATGCAAAAGAGGATTTATTTTCTTAAGTTTAGGTAGATAAGTCAGCTCTTTTGAATGTTTTACT FIGURE 136 cont'd

```
TATTTTTGCCTGAGTTCCTAGCTTTACGCATTACTAGGAATATTTTCTTTTACAGGAGGGAGAAGGGTTT
TGAGGGAGGGGGTGGGTAAGGCAGTAGGGATGGGGTTAGGTAGGGGAGAACATTTCTGAAAAAGAACTTA
TAATGAAGCTACAAATCCATCCTTATTTCTTATTCAGTGCTGAATACTACCTCATGCAAATATTGGTGT
GGCTGCAAATTTCCCTCTGAAGCTGACACAATTAAGGATGAATTACCATAACATCTTCATTTTTCCTCAT
TTCATTGCCTCTCATACAGTTTTCTCCCTCTGATTTATTTCATTTTGGTAGTGGATTTTGAATTAAGTAT
TTATTTCTCTTTGCAAGTGACTATTTGATTAACACATTAAAAATTTTTTAAAAATTTCCCCTTTAAGTTA
TGATGGCTGCCTATAGAATTTAGACTGTTTCTCACCCTGATCCATCCTGATATTATGTTATTAGCTACGA
TTTCAAGGTCACTTTGAAGTCAGACTTCACAGTTTTCTACAGGTGTATTTCTTGCTATGCTCAGTGGGAA
CCAGGGAGCAGAAAAGATTGTGGAAAGTGGGAACATTAATTGTCACGTGGCTGTTGAGCCAGAGAGGCCA
CTGGCTGCCATGCCTCTTACCAGCCAAGTTTTAAATGGTTAGAGTGGCATTGGCATTGATTTTGCTTTTC
TCTTGGGTTTTCTTCATTTCTTTTCATAATTCATCTTCAAGCTATAGATCCATCCTTCTTCCCTATCCAA
ATACTTTGTTCTCAGTGGGCAGTCAGATTTTTTGGCTTCCAAACCTCACTGAGCATGTTCAGAGAATTC
CTCTCATTAAGGAAATATTTTTCCCCACAATTGTCTGATGTATGAGTCCTCTCAGAAGCACAAGTGCATA
CTAGGAAGGCTTTGTAAACTGGTTTTGTAGGCAGGCTGTACCTGCAAATAGGCATTCTGAGCAAGGATCC
TAAATTTCCCTTTGGCTCATGTCCCCCCGCCCCACCCCACCTTCTCCTTTTTGGCATGTCTGGTGAAAA
GCTACAAGGTTCACAGGGCCAAATATTCTCCCTTTTGTTCTCTAAACATGTTGCACACATAAACTCAAGG
GAGTGATTTCGGTTCCTAAGTCCTAGGGAGTTCTATTCCATTTATTCTGATGTCCCTTTTAAGGAGGAGT
TGGTGTTGAAGTGTGACATGCTTTAATGATAACTGCTTTGGCAATTCCCCAGACAGGTATACTTCTTCAT
CCAAAATTGCACCTAAGGTGTTCATTTAGACAAAATTGTTCGCTTAGTGATCCACTGATCTCTAATCAGA
AATATTTTTAAAAAATACAATTTAGATCTCTGAAAATTGGAACCACTCAAGAGTATCATCTTGATAGTGT
TACTTCAGCATATGACTGACTGATTTTATGAAGGGAGTTTAGCTGACTTTTCCCTGTAGCCCTATCATAT
TAAAAACAAAAAGTGGTCCACTTGAAGCAGCAAGGACAAAGGGCAGTTTAGGGAGAGGCAGGGTGAAGGG
GATAGCTCGATTGGGCATCCAGAGTGGAAAAGGATTATTATTGTACATAATAGCAGTTCTGGCTGGAATT
CCAATCCACTTTCTGGGGATCATTTTGATGTTGAATGTTCCCCAAAGCATTCTGACAAGTTTGGTCCAC
TTGGCTCTTTACCCCGGGTAATAAGACCCTTATTGACTTTGAAAAACTGGCATAAATGAGCTTAAGAAAT
CCATTGTATACAGTCCTAGTGTTTGCCTTCTTGGTAAAATTACATTTAAGGATGTCATTTCATGAGTCAA
ATTGTATCTGCTGACACTGAAGTGTATTGAGATGTTGTTCTTTAGTTTAAGTATGTAACAAAGTAATATT
CAAAGGGGATGTTTGGGGGTGGGGCTGGGACCGGGTGGCTTTATATTGATAATGAAATATTCCAGAGCAA
AACACATTGTCCTAATGAAGTTGTTGCAGCTCTCTTCGTTTTCTTGTGCCGCTGGAATTGGCTTGTGGGT
CACTTGTTGTGCAAAAGTGAATTAATTTCAAATAGGAATCATATTGCTTTTGTGAAACAAAGAAAATTTA
CCACCTTGTCTGATACATAGATTGGAAGGCGCTCTTGTAAAGAATAACCCACAAACACCTGATCTTGAT
TGGAAAGCATTGTAGGTCATTAGGGAAAACTGATGATGCTGACTGTTGCTCCAGCTGTGTTGGCAATTCA
AGATGACCTTGTTACTAACTGAAAGTTGCTGTCAACCTTAGCAAACAAACCAGCTAACACCATTACAGCA
CTGGTTAAGTAGATTTTTACTGGCACTGGCTGGCGTTCAGCTGAGGAAGGCTAGGATACAGACTTTAATG
ACCAAGAGCCAGACTAGCTCGAGCTAGAAATCAGCAACAAATACCTCCTTGTGCTATTTGAATGCTAAGG
TATTAGTTGCAATAGGCTTACGCCTTCGCTCCTCAGTGAGGGAATGAGCCTGATGACACTATTACTGT
TTACCTGTCAAACCAGGGTGGAAATTTAGAGGGATGCAAGTACAGTATGTCTCATTAAGCAGTCTCTGTT
GCTGATTATATGAAGATAAAATTGTTGTATATGCTGATCTGTATGTTATGTACATTTTCACAGTGATTGA
ATCATTGTAAAAAGAAAAAAGACAAAAAAGAATCACCACTGTCTATTTTATGAAGATGATAAAGCAGCTT
TATTAAATTATTACAGTTATGTTTCAAATGGTGTTATCTGCCACATTGTTTCCTTTTATCTGGTGGTTCT
CTGTTTCCCCCTTTAAATGTGTTTTCTCTGCTTCAAAAATTTAATGCATTTAGTATTAAAGGCTATTAT
GGAAAAAG
```

FIGURE 137
SEQ ID NO: 129
Genbank ID      : NM_018063.1
Unigene ID(#167) : Hs.203963
Unigene name    :      helicase, lymphoid-specific   HELLS
>gi|8922361|ref|NM_018063.1| Homo sapiens hypothetical protein FLJ10339
(FLJ103
39), mRNA

```
TAATGATGCTACTTCGTAAATGTTGTAATCATCCATATTTGATTGAATATCCTATAGACCCTGTTACACA
AGAATTTAAGATCGATGAAGAATTGGTAACAAATTCTGGGAAGTTCTTGATTTTGGATCGAATGCTGCCA
GAACTAAAAAAAAGAGGTCACAAGGTGCTGCTTTTTTCACAAATGACAAGCATGTTGGACATTTTGATGG
ATTACTGCCATCTCAGAGATTTCAACTTCAGCAGGCTTGATGGGTCCATGTCTTACTCAGAGAGAGAAAA
AAACATGCACAGCTTCAACACGGATCCAGAGGTGTTTATCTTCTTAGTGAGTACACGAGCTGGTGGCCTG
GGCATTAATCTGACTGCAGCAGATACAGTTATCATTTATGATAGTGATTGGAACCCCCAGTCGGATCTTC
AGGCCCAGGATAGATGTCATAGAATTGGTCAGACAAAGCCAGTTGTTGTTTATCGCCTTGTTACAGCAAA
TACTATCGATCAGAAAATTGTGGAAAGAGCAGCTGCTAAAAGGAAACTGGAAAAGTTGATCATCCATAAA
```

FIGURE 137 cont'd

```
AATCATTTCAAAGGTGGTCAGTCTGGATTAAATCTGTCTAAGAATTTCTTAGATCCTAAGGAATTAATGG
AATTATTAAAATCTAGAGATTATGAAAGGGAAATAAAAGGATCAAGAGAGAAGGTCATTAGTGATAAAGA
TCTAGAGTTGTTGTTAGATCGAAGTGATCTTATTGATCAAATGAATGCTTCAGGACCAATTAAAGAGAAG
ATGGGGATATTCAAGATATTAGAAAATTCTGAAGATTCCAGTCCTGAATTGGAGACGGGGTTTCACCATC
TTGGCCTGACTGGTCCCGAACTGATCTCAGGTGATCTGCCCACCTCGGCCTCCCAAAGTGCTGGGATTAC
AAGCGTGAGCCACTGCGTGGCCTGAGCACTAGGGCGCAAGAGAAGCCGTACTGGAATATTACACTACTCA
GCACAAGACAGGTTTAATCTTTTTCTTGGGGGACAAGATTGGAAAATTGAGGTCTGAGCAGACCTGAAGA
GAGGCATCCAGCAACTCTGAGATTAAATTCATCATTGATCAATTCGTTATTGTTTGGAATTGACGTTTAG
CTGTGTTCCTCACTCAGATACGTGCATGATAGCTGCTTGCTAATTTGGTCTTAGCTCACATTTCACCTAG
AATGTATGGTCTCCCTCTCCCCTGCAAAATATCCCACTGTTGCTAATCTGTCTGCCTCATAATTTCCATG
AGATTGAGCATCTTGTTTGTTTTGTCACCACTATATAACAGCATGTTGGAAACAAAGCAGTAATAAAGCT
AGAAAAACCAAGCGAATACACTGGATTAAAAAAAATACTGTTTCCTAGAATTAAAGAAATAAATGAGGCC
GGGCGCAGTGGTGCCTGTAATCCCAGCAGTTTGGGAGGCTGAGGCTAGTGGATCATGTGGCCGAGATCGC
GTCACTGCACTCCAGTCTAGCAACAGAGCGATACCTTGTTTCTTACTT
```

FIGURE 138
SEQ ID NO: 130
Genbank ID        : NM_001793.1
Unigene ID(#167)  : Hs.191842
Unigene name      :        cadherin   3,   type   1,   P-cadherin   (placental)
   CDH3
>gi|4502722|ref|NM_001793.1|  Homo sapiens cadherin 3, type 1, P-cadherin (place
ntal) (CDH3), mRNA
```
GCGGAACACCGGCCCGCCGTCGCGGCAGCTGCTTCACCCCTCTCTCTGCAGCCATGGGGCTCCCTCGTGG
ACCTCTCGCGTCTCTCCTCCTTCTCCAGGTTTGCTGGCTGCAGTGCGCGGCCTCCGAGCCGTGCCGGGCG
GTCTTCAGGGAGGCTGAAGTGACCTTGGAGGCGGGAGGCCAGGAGGCCCGGCCAGGCGCTGGGGA
AAGTATTCATGGGCTGCCCTGGGCAAGAGCCAGCTCTGTTTAGCACTGATAATGATGACTTCACTGTGCG
GAATGGCGAGACAGTCCAGGAAAGAAGGTCACTGAAGGAAAGGAATCCATTGAAGATCTTCCCATCCAAA
CGTATCTTACGAAGACACAAGAGAGATTGGGTGGTTGCTCCAATATCTGTCCCTGAAAATGGCAAGGGTC
CCTTCCCCCAGAGACTGAATCAGCTCAAGTCTAATAAAGATAGAGACACCAAGATTTTCTACAGCATCAC
GGGGCCGGGGGCAGACAGCCCCCCTGAGGGTGTCTTCGCTGTAGAGAAGGAGACAGGCTGGTTGTTGTTG
AATAAGCCACTGGACCGGGAGGAGATTGCCAAGTATGAGCTCTTTGGCCACGCTGTGTCAGAGAATGGTG
CCTCAGTGGAGGACCCCATGAACATCTCCATCATCGTGACCGACCAGAATGACCACAAGCCCAAGTTTAC
CCAGGACACCTTCCGAGGGAGTGTCTTAGAGGGAGTCCTACCAGGTACTTCTGTGATGCAGGTGACAGCC
ACAGATGAGGATGATGCCATCTACACCTACAATGGGGTGGTTGCTTACTCCATCCATAGCCAAGAACCAA
AGGACCCACACGACCTCATGTTCACAATTCACCGGAGCACAGGCACCATCAGCGTCATCTCCAGTGGCCT
GGACCGGGAAAAGTCCCTGAGTACACACTGACCATCCAGGCCACAGACATGGATGGGGACGGCTCCACC
ACCACGGCAGTGGCAGTAGTGGAGATCCTTGATGCCAATGACAATGCTCCCATGTTTGACCCCCAGAAGT
ACGAGGCCCATGTGCCTGAGAATGCAGTGGGCCATGAGGTGCAGAGGCTGACGGTCACTGATCTGGACGC
CCCCAACTCACCAGCGTGGCGTGCCACCTACCTTATCATGGGCGGTGACGACGGGGACCATTTTACCATC
ACCACCCACCCTGAGAGCAACCAGGGCATCCTGACAACCAGGAAGGGTTTGGATTTTGAGGCCAAAAACC
AGCACACCCTGTACGTTGAAGTGACCAACGAGGCCCCTTTTGTGCTGAAGCTCCCAACCTCCACAGCCAC
CATAGTGGTCCACGTGGAGGATGTGAATGAGGCACCTGTGTTTGTCCCACCCTCCAAAGTCGTTGAGGTC
CAGGAGGGCATCCCCACTGGGGAGCCTGTGTGTCTACACTGCAGAAGACCCTGACAAGGAGAATCAAA
AGATCAGCTACCGCATCCTGAGAGACCCAGCAGGGTGGCTAGCCATGGACCCAGACAGTGGGCAGGTCAC
AGCTGTGGGCACCCTCGACCGTGAGGATGAGCAGTTTGTGAGGAACAACATCTATGAAGTCATGGTCTTG
GCCATGGACAATGGAAGCCCTCCCACCACTGGCACGGGAACCCTTCTGCTAACACTGATTGATGTCAACG
ACCATGGCCCAGTCCCTGAGCCCCGTCAGATCACCATCTGCAACCAAAGCCCTGTGCGCCACGTGCTGAA
CATCACGGACAAGGACCTGTCTCCCCACACCTCCCCTTTCCAGGCCGCTCACAGATGACTCAGACATC
TACTGGACGGCAGAGGTCAACGAGGAAGGTGACACAGTGGTCTTGTCCCTGAAGAAGTTCCTGAAGCAGG
ATACATATGACGTGCACCTTTCTCTGTCTGACCATGGCAACAAAGAGCAGCTGACGGTGATCAGGGCCAC
TGTGTGCGACTGCCATGGCCATGTCGAAACCTGCCCTGGACCCTGGAAAGGAGGTTTCATCCTCCCTGTG
CTGGGGGCTGTCCTGGCTCTGCTGTTCCTCCTGCTGGTGCTGCTTTTGTTGGTGAGAAAGAAGCGGAAGA
TCAAGGAGCCCCTCCTACTCCCAGAAGATGACACCCGTGACAACGTCTTCTACTATGGCGAAGAGGGGGG
TGGCGAAGAGGACCAGGACTATGACATCACCCAGCTCCACCGAGGTCTGGAGGCCAGGCCGGAGGTGGTT
CTCCGCAATGACGTGGCACCAACCATCATCCCGACACCCATGTACCGTCCTAGGCCAGCCAACCCAGATG
AAATCGGCAACTTTATAATTGAGAACCTGAAGGCGGCTAACACAGACCCCACAGCCCCGCCCTACGACAC
CCTCTTGGTGTTCGACTATGAGGGCAGCGGCTCCGACGCCGCGTCCCTGAGCTCCCTCACCTCCTCCGCC
TCCGACCAAGACCAAGATTACGATTATCTGAACGAGTGGGGCAGCCGCTTCAAGAAGCTGGCAGACATGT
```

FIGURE 138 cont'd

```
ACGGTGGCGGGGAGGACGACTAGGCGGCCTGCCTGCAGGGCTGGGGACCAAACGTCAGGCCACAGAGCAT
CTCCAAGGGGTCTCAGTTCCCCCTTCAGCTGAGGACTTCGGAGCTTGTCAGGAAGTGGCCGTAGCAACTT
GGCGGAGACAGGCTATGAGTCTGACGTTAGAGTGGTTGCTTCCTTAGCCTTTCAGGATGGAGGAATGTGG
GCAGTTTGACTTCAGCACTGAAAACCTCTCCACCTGGGCCAGGGTTGCCTCAGAGGCCAAGTTTCCAGAA
GCCTCTTACCTGCCGTAAAATGCTCAACCCTGTGTCCTGGGCCTGGGCCTGCTGTGACTGACCTACAGTG
GACTTTCTCTCTGGAATGGAACCTTCTTAGGCCTCCTGGTGCAACTTAATTTTTTTTTTAATGCTATCT
TCAAAACGTTAGAGAAAGTTCTTCAAAAGTGCAGCCCAGAGCTGCTGGGCCCACTGGCCGTCCTGCATTT
CTGGTTTCCAGACCCCAATGCCTCCCATTCGGATGGATCTCTGCGTTTTTATACTGAGTGTGCCTAGGTT
GCCCCTTATTTTTTATTTTCCCTGTTGCGTTGCTATAGATGAAGGGTGAGGACAATCGTGTATATGTACT
AGAACTTTTTTATTAAAGAAA
```

FIGURE 139
SEQ ID NO: 131
Genbank ID       : BG170335
Unigene ID(#167) : Hs.293257
Unigene name     :     epithelial  cell  transforming  sequence  2  oncogene
      ECT2
>gi|12677038|gb|BG170335.1|BG170335  602323225F1  NIH_MGC_89  Homo  sapiens cDNA cl
one IMAGE:4426255 5', mRNA sequence

```
GAAAACCTACCCTCCCTTTGTAAACTTCTTTGAAATGAGCAAGGAAACAATTATTAAATGTGAAAAACAG
AAACCAAGATTTCATGCTTTTCTCAAGATAAACCAAGCAAAACCAGAATGTGGACGGCAGAGCCTTGTGA
ACTTCTTATCCGACCAGTACAGAGGTTACCCAGTGTTGCATTACTTTTAAATGATCTTAAGAAGCATACA
GCTGATGAAAATCCAGACAAAAGCACTTTAGAAAAAGCTATGGATCACTGAAGGAAGTAATGACGCATAT
TAATGAGGATAAGAGAAAAACAGAAGCTCAAAAGCAAATTTTGATGTGTTTATGAAGTAGATGGATGCCC
AGCTAATCTTTTATCTTCTCACCGAAGCTTAGTACAGCGGGTTGAAACAATTTCTCTAGGTGAGCACCCC
TGTGACAGAGGAGAACAAGTAACTCTCTTCCTCTTCAATGATTGCCTAGAGATAGCAAGAAAACGGCACA
AGGTTATTGGCACTTTTAGGAGTCCTCATGGCAAACCCGACCCCAGCTTCTCTTAAGCATATTCACCTAA
TGCCTCTTTCTCAGATTACAGAAGGTATCGGCACCATACAGAGAGACAGAAAGATGCCATAATGGCTTTG
CCTTGCTTTGTGAGGCCACCAAACAGAGCAGGCAATGTGCTACTCAGTTTCCCAGATGACCCAAGATGAA
CTTCCAAAAGAAAACTGGTAAAAAATGCTGTGTCGACCTTGTGCTAAACACATTTGTAAAGCAGAGCTGA
GATCTTATTATAACTGGTGATCCAAATCTTGACATCA
```

FIGURE 140
SEQ ID NO: 132
Genbank ID       : NM_014791.1
Unigene ID(#167) : Hs.184339
Unigene name     :    maternal  embryonic  leucine  zipper  kinase   MELK
>gi|7661973|ref|NM_014791.1| Homo sapiens maternal embryonic leucine zipper kin
ase (MELK), mRNA

```
TTGGCGGGCGGAAGCGGCCACAACCCGGCGATCGAAAAGATTCTTAGGAACGCCGTACCAGCCGCGTCTC
TCAGGACAGCAGGCCCCTGTCCTTCTGTCGGGCGCCGCTCAGCCGTGCCCTCCGCCCCTCAGGTTCTTTT
TCTAATTCCAAATAAACTTGCAAGAGGACTATGAAAGATTATGATGAACTTCTCAAATATTATGAATTAC
ATGAAACTATTGGGACAGGTGGCTTTGCAAAGGTCAAACTTGCCTGCCATATCCTTACTGGAGAGATGGT
AGCTATAAAAATCATGGATAAAAACACACTAGGGAGTGATTTGCCCCGGATCAAAACGGAGATTGAGGCC
TTGAAGAACCTGAGACATCAGCATATATGTCAACTCTACCATGTGCTAGAGACAGCCAACAAAATATTCA
TGGTTCTTGAGTACTGCCCTGGAGGAGAGCTGTTTGACTATATAATTTCCCAGGATCGCCTGTCAGAAGA
GGAGACCCGGGTTGTCTTCCGTCAGATAGTATCTGCTGTTGCTTATGTGCACAGCCAGGGCTATGCTCAC
AGGGACCTCAAGCCAGAAAATTTGCTGTTTGATGAATATCATAAATTAAAGCTGATTGACTTTGGTCTCT
GTGCAAAACCCAAGGGTAACAAGGATTACCATCTACAGACATGCTGTGGGAGTCTGGCTTATGCAGCACC
TGAGTTAATACAAGGCAAATCATATATCTTGGATCAGAGGCAGATGTTTGGAGCATGGCATACTGTTATAT
GTTCTTATGTGTGGATTTCTACCATTTGATGATGATAATGTAATGGCTTTATACAAGAAGATTATGAGAG
GAAAATATGATGTTCCCAAGTGGCTCTCTCCCAGTAGCATTCTGCTTCTTCAACAAATGCTGCAGGTGGA
CCCAAAGAAACGGATTTCTATGAAAAATCTATTGAACCATCCCTGGATCATGCAAGATTACAACTATCCT
GTTGAGTGGCAAAGCAAGAATCCTTTTATTCACCTCGATGATGATTGCGTAACAGAACTTTCTGTACATC
ACAGAAACAACAGGCAAACAATGGAGGATTTAATTTCACTGTGGCAGTATGATCACCTCACGGCTACCTA
TCTTCTGCTTCTAGCCAAGAAGGCTCGGGGAAAACCAGTTCGTTTAAGGCTTTCTTCTTTCTCCTGTGGA
```

FIGURE 140 cont'd

```
CAAGCCAGTGCTACCCCATTCACAGACATCAAGTCAAATAATTGGAGTCTGGAAGATGTGACCGCAAGTG
ATAAAAATTATGTGGCGGGATTAATAGACTATGATTGGTGTGAAGATGATTTATCAACAGGTGCTGCTAC
TCCCCGAACATCACAGTTTACCAAGTACTGGACAGAATCAAATGGGGTGGAATCTAAATCATTAACTCCA
GCCTTATGCAGAACACCTGCAAATAAATTAAAGAACAAAGAAAATGTATATACTCCTAAGTCTGCTGTAA
AGAATGAAGAGTACTTTATGTTTCCTGAGCCAAAGACTCCAGTTAATAAGAACCAGCATAAGAGAGAAAT
ACTCACTACGCCAAATCGTTACACTACACCCTCAAAAGCTAGAAACCAGTGCCTGAAAGAAACTCCAATT
AAAATACCAGTAAATTCAACAGGAACAGACAAGTTAATGACAGGTGTCATTAGCCCTGAGAGGCGGTGCC
GCTCAGTGGAATTGGATCTCAACCAAGCACATATGGAGGAGACTCCAAAAAGAAAGGGAGCCAAAGTGTT
TGGGAGCCTTGAAAGGGGGTTGGATAAGGTTATCACTGTGCTCACCAGGAGCAAAAGGAAGGGTTCTGCC
AGAGACGGGCCCAGAAGACTAAAGCTTCACTATAATGTGACTACAACTAGATTAGTGAATCCAGATCAAC
TGTTGAATGAAATAATGTCTATTCTTCCAAAGAAGCATGTTGACTTTGTACAAAAGGGTTATACACTGAA
GTGTCAAACACAGTCAGATTTTGGGAAAGTGACAATGCAATTTGAATTAGAAGTGTGCCAGCTTCAAAAA
CCCGATGTGGTGGGTATCAGGAGGCAGCGGCTTAAGGGCGATGCCTGGGTTTACAAAAGATTAGTGGAAG
ACATCCTATCTAGCTGCAAGGTATAATTGATGGATTCTTCCATCCTGCCGGATGAGTGTGGGTGTGATAC
AGCCTACATAAAGACTGTTATGATCGCTTTGATTTTAAAGTTCATTGGAACTACCAACTTGTTTCTAAAG
AGCTATCTTAAGACCAATATCTCTTTGTTTTTAAACAAAAGATATTATTTTGTGTATGAATCTAAATCAA
GCCCATCTGTCATTATGTTACTGTCTTTTTTAATCATGTGGTTTTGTATATTAATAATTGTTGACTTTCT
TAGATTCACTTCCATATGTGAATGTAAGCTCTTAACTATGTCTCTTTGTAATGTGTAATTTCTTTCTGAA
ATAAAACCATTTGTGAATAT
```

FIGURE 141
SEQ ID NO: 133
Genbank ID         : NM_003504.1
Unigene ID(#167)   : Hs.114311
Unigene name       :     CDC45 cell division cycle 45-like (S. cerevisiae)
      CDC45L
>gi|4502712|ref|NM_003504.1| Homo sapiens CDC45 (cell division cycle 45,
S.cere
visiae, homolog)-like (CDC45L), mRNA

```
GCCAGGCGTCCGGCCGCCGTGGCTATGTTCGTGTCCGATTTCCGCAAAGAGTTCTACGAGGTGGTCCAGA
GCCAGAGGGTCCTTCTCTTCGTGGCCTCGGACGTGGATGCTCTGTGTGCGTGCAAGATCCTTCAGGCCTT
GTTCCAGTGTGACCACGTGCAATATACGCTGGTTCCAGTTTCTGGGTGGCAAGAACTTGAAACTGCATTT
CTTGAGCATAAAGAACAGTTTCATTATTTTATTCTCATAAACTGTGGAGCTAATGTAGACCTATTGGATA
TTCTTCAACCTGATGAAGACACTATATTCTTTGTGTGTGACACCCATAGGCCAGTCAATGTCGTCAATGT
ATACAACGATACCCAGATCAAATTACTCATTAAACAAGATGATGACCTTGAAGTTCCCGCCTATGAAGAC
ATCTTCAGGGATGAAGAGGAGGATGAAGAGCATTCAGGAAATGACAGTGATGGGTCAGAGCCTTCTGAGA
AGCGCACACGGTTAGAAGAGGAGATAGTGGAGCAAACCATGCGGAGGAGGCAGCGGCGAGAGTGGGAGGC
CCGGAGAAGAGACATCCTCTTTGACTACGAGCAGTATGAATATCATGGGACATCGTCAGCCATGGTGATG
TTTGAGCTGGCTTGGATGCTGTCCAAGGACCTGAATGACATGCTGTGGTGGGCCATCGTTGGACTAACAG
ACCAGTGGGTGCAAGACAAGATCACTCAAATGAAATACGTGACTGATGTTGGTGTCCTGCAGCGCCACGT
TTCCCGCCACAACCACCGGAACGAGGATGAGGAGAACACACTCTCCGTGGACTGCACACGGATCTCCTTT
GAGTATGACCTCCGCCTGGTGCTCTACCAGCACTGGTCCCTCCATGACAGCCTGTGCAACACCAGCTATA
CCGCAGCCAGGTTCAAGCTGTGGTCTGTGCATGGACAGAAGCGGCTCCAGGAGTTCCTTGCAGACATGGG
TCTTCCCCTGAAGCAGGTGAAGCAGAAGTTCCAGGCCATGGACATCTCCTTGAAGGAGAATTTGCGGGAA
ATGATTGAAGAGTCTGCAAATAAATTTGGGATGAAGGACATGCGCGTGCAGACTTTCAGCATTCATTTTG
GGTTCAAGCACAAGTTTCTGGCCAGCGACGTGGTCTTTGCCACCATGTCTTTGATGGAGAGCCCCGAGAA
GGATGGCTCAGGGACAGATCACTTCATCCAGGCTCTGGACAGCCTCTCCAGGAGTAACCTGGACAAGCTG
TACCATGGCCTGGAACTCGCCAAGAAGCAGCTGCGAGCCACCCAGCAGACCATTGCCAGCTGCCTTTGCA
CCAACCTCGTCATCTCCCAGGGGCCTTTCCTGTACTGCTCTCTCATGGAGGGCACTCCAGATGTCATGCT
GTTCTCTAGGCCGGCATCCCTAAGCCTGCTCAGCAAACACCTGCTCAAGTCCTTTGTGTGTTCGACAAAG
AACCGGCGCTGCAAACTGCTGCCCCTGGTGATGGCTGCCCCCTGAGCATGGAGCATGGCACAGTGACCG
TGGTGGGCATCCCCCCAGAGACCGACAGCTCGGACAGGAAGAACTTTTTTGGGAGGGCGTTTGAGAAGGC
AGCGGAAAGCACCAGCTCCCGGATGCTGCACAACCATTTTGACCTCTCAGTAATTGAGCTGAAAGCTGAG
GATCGGAGCAAGTTTCTGGACGCACTTATTTCCCTCCTGTCCTAGGAATTTGATTCTTCCAGAATGACCT
TCTTATTTATGTAACTGGCTTTCATTTAGATTGTAAGTTATGGACATGATTTGAGATGTAGAAGCCATTT
TTTATTAAATAAAATGCTTATTTTAGAAAAAAAAAAAAAAAAAAAA
```

FIGURE 142
SEQ ID NO: 134
```
Genbank ID       : NM_022346.1
Unigene ID(#167) : Hs.528669
Unigene name     :         chromosome condensation protein G    HCAP-G
>gi|11641252|ref|NM_022346.1| Homo sapiens chromosome condensation protein
G (H
CAP-G), mRNA
ATAGAAGACTCCTCGGAGAGCGCTGCCTCTGGGTTGGCGGGCTGGCAGGCTGTAGCCGAGCGCGGGCAGG
ACTCGTCCCGGCAGGGTTCCAGAGCCATGGGAGCGGAAAGGAGGCTGCTGTCGATTAAGGAGGCCTTTCG
GCTGGCGCAGCAGCCGCACCAGAACCAGGCGAAGCTGGTGGTGGCGCTGAGCCGCACCTACCGCACGATG
GATGATAAGACAGTTTTTCATGAGGAGTTCATTCATTACCTTAAATATGTTATGGTGGTCTATAAACGTG
AACCAGCTGTGGAGAGGGTAATAGAATTTGCAGCAAAGTTTGTTACCTCATTTCACCAATCAGATATGGA
AGATGATGAGGAAGAGGAAGATGGTGGCCTTTTAAATTATTTGTTTACTTTTCTCTTAAAGTCTCATGAA
GCAAACAGCAATGCAGTGGGATTTAGAGTGTGCCTGCTCATAAACAAGCTTTTGGGAAGTATGCCAGAAA
ATGCTCAGATTGATGATGATGTGTTTGATAAAATTAATAAAGCCATGCTTATTAGATTGAAAGATAAGAT
TCCAAATGTGAGAATACAGGCAGTTCTGGCGCTTTCACGACTTCAGGATCCCAAGGATGATGAATGCCCA
GTGGTTAATGCATATGCTACTTTGATTGAAAATGATTCAAATCCAGAAGTTAGACGGGCAGTGTTATCAT
GTATTGCACCATCAGCAAAGACTTTGCCAAAAATTGTAGGGCGCACCAAGGATGTGAAAGAGGCTGTCAG
AAAGCTGGCTTATCAGGTTTTAGCTGAAAAGGTTCATATGAGAGCTATGTCCATTGCTCAGAGAGTAATG
CTCCTTCAACAAGGTCTTAATGACAGATCAGACGCTGTGAAACAAGCTATGCAGAAGCATCTTCTTCAAG
GCTGGTTACGGTTCTCTGAAGGAAATATCTTAGAGTTGCTCCATCGGTTGGATGTAGAAAATTCTTCTGA
AGTGGCAGTCTCTGTTCTCAATGCCTTGTTTTCAATAACTCCTCCTCAGTGAACTGGTGGGACTCTGTAAA
AACAATGATGGCAGGAAATTGATTCCAGTGGAAACATTAACTCCTGAAATTGCTTTGTATTGGTGTGCCC
TTTGTGAATATTTGAAATCAAAAGGAGATGAAGGTGAAGAATTTTTAGAGCAGATTTTGCCAGAGCCTGT
AGTATATGCAGACTATTTATTGAGTTACATCCAGAGCATTCCAGTTGTTAATGAAGAACACAGAGGTGAT
TTTTCCTATATTGGAAATTTGATGACAAAAGAATTCATAGGTCAACAATTGATTCTAATTATTAAGTCTT
TGGATACCAGTGAAGAAGGAGGAAGAAAAAAACTGCTGGCTGTTTTACAGGAGATTCTTATTTTACCCAC
AATCCCAATATCCCTGGTTTCTTTTCTTGTTGAAAGACTACTCCACATCATTATAGATGATAATAAGAGA
ACACAAATTGTTACAGAAATTATCTCAGAGATTCGAGCGCCCATTGTTACTGTTGGTGTTAATAACGATC
CAGCTGATGTAAGAAAGAAAGAACTCAAGATGGCTGAAATAAAAGTTAAGCTTATCGAAGCCAAAGAAGC
TTTGGAAAATTGCATTACCTTACAGGATTTTAATCGGGCATCAGAATTAAAAGAAGAAATAAAAGCATTA
GAAGATGCCAGAATAAACCTTTTGAAAGAGACAGGCAACTTGAAATTAAAGAAGTCCACATAGAGAAGA
ATGATGCTGAAACATTGCAGAAATGTCTTATTTTATGCTATGAACTGTTGAAGCAGATGTCCATTTCAAC
AGGCTTAAGTGCAACCATGAATGGAATCATCGAATCTTTGATTCTTCCTGGAATAATAAGTATTCATCCT
GTTGTAAGAAACCTGGCTGTTTTATGCTTGGGATGCTGTGGACTACAGAATCAGGATTTTGCAAGGAAAC
ACTTCGTATTACTATTGCAGGTTTTGCAAATTGATGATGTCACAATAAAAATAAGTGCTTTAAAGGCAAT
CTTTGACCAACTGATGACGTTCGGGATTGAACCATTTAAAACTAAAAAAATCAAAACACTTCATTGTGAA
GGTACAGAAATAAACAGTGATGTTGAGCAAGAATCAAGAGAAGTTGAAGAGACTGCTACAGCTAAGAATG
TTCTGAAACTCCTTTCTGATTTCTTAGATAGTGAGGCATCTGAACTTAGGACTGGAGCTGCAGAAGGACT
AGCCAAGCTGATGTTCTCTGGGCTTTTGGTCAGCAGCAGGATTCTTTCTCGTCTTATTTTGTTATGGTAC
AATCCTGTGACTGAAGAGGATGTTCAACTTCGACATTGCCTAGGCGTGTTCTTCCCCGTGTTTGCTTATG
CAAGCAGGACTAATCAGGAATGCTTTGAAGAAGCTTTTCTTCCAACCCTGCAAACACTGGCCAATGCCCC
TGCATCTTCTCCTTTAGCTGAAATTGATATCACAAATGTTGCTGAGTTACTTGTAGATTTGACAAGACCA
AGTGGATTAAATCCTCAGGCCAAGACTTCCCAAGATTATCAGGCCTTAACAGTACATGACAATTTGGCTA
TGAAAATTTGCAATGAGATCTTAACAAGTCCGTGCTCGCCAGAAATTCGAGTCTATACAAAAGCCTTGAG
TTCTTTAGAACTCAGTAGCCATCTTGCAAAAGATCTTCTGGTTCTATTGAATGAGATTCTGGAGCAAGTA
AAAGATAGGACATGTCTGAGAGCTTTGGAGAAAATCAAGATTCAGTTAGAAAAAGGAAATAAAGAATTTG
GTGACCAAGCTGAAGCAGCACAGGATGCCACCTTGACTACAACTACTTTCCAAAATGAAGATGAAAAGAA
TAAAGAAGTATATATGACTCCACTCAGGGGTGTAAAAGCAACCCAAGCATCAAAGTCTACTCAGCTAAAG
ACTAACAGAGGACAGAGAAAAGTGACAGTTTCAGCTAGGACGAACAGGAGGTGTCAGACTGCTGAAGCCG
ACTCTGAAAGTGATCATGAAGTTCCAGAACCAGAATCAGAAATGAAGATGAGACTACCAAGACGAGCCAA
AACCGCAGCACTAGAAAAAAGTAAACTTAACCTTGCCCAATTTCTCAATGAAGATCTAAGTTAGGAAAGA
CGATGGAGGTGGAATCCTTTAAGATTATGTCCAGTTATTTGCTTTAATAAAGAAGAAGTTACCCTTGTCA
AAATCAG
```

FIGURE 143
SEQ ID NO: 135
```
Genbank ID       : AA972452
```

FIGURE 143 cont'd

```
Unigene ID(#167)  : Hs.292072
Unigene name      :       Transcribed sequences
>gi|3145216|gb|AA972452.1|AA972452    op41b09.s1    Soares_NFL_T_GBC_S1    Homo sapiens
cDNA clone IMAGE:1579385 3', mRNA sequence
ATCCCATGTTTTGTTTCCTGCTTTCTTTTGAATTGTTTGAATGTTTTTTTGAATTCTGTCTATTGGCCTT
TTATTATTTTAATCATACCTCTTTTAATGATTGTTTAGAGGTTGCTTTAGGAAATATCATGTACAGCTTT
AACTTTTCATAGTCTACTTGAGGTTAGTATTGTATTATCTCATGTAAAATATAGAAACTTGCAACCATG
TAGGTCCATTTGTCCACCCACCCTTGCAGCCAGCATGTCTTATGTTATAGCCGTCATGTGAATTTCATAC
ATCTAAATACATTAGAAACTCCATAAGACTGTTACAATTTTTGTATTAATCCATTGTGGGTATTGTAAAG
AAAGAGGAAAAAGTAGTCATTTAGTTTTACCCAAATATGTACCATTTCTGATACTCTTCATTTGTTACT
GAAGATTGGTTTTCCCTCC
```

FIGURE 144
SEQ ID NO: 136
```
Genbank ID        : NM_001813.1
Unigene ID(#167)  : Hs.75573
Unigene name      :       centromere protein E, 312kDa   CENPE
>gi|4502780|ref|NM_001813.1|  Homo  sapiens  centromere  protein  E,  312kDa
(CENPE),
mRNA
TAAATTTAAAGGCGGGGCGGCCTGTGAGCCCTGAAGTGCCGGCCGCGGAGGGTCCTGGCCATTTGGTGG
GACCAGTTCAGCCTGATAGGATGGCGGAGGAAGGAGCCGTGGCCGTCTGCGTGCGAGTGCGGCCGCTGAA
CAGCAGAGAAGAATCACTTGGAGAAACTGCCCAAGTTTACTGGAAAACTGACAATAATGTCATTTATCAA
GTTGATGGAAGTAAATCCTTCAATTTTGATCGTGTCTTTCATGGTAATGAAACTACCAAAAATGTGTATG
AAGAAATAGCAGCACCAATCATCGATTCTGCCATACAAGGCTACAATGGTACTATATTTGCCTATGGACA
GACTGCTTCAGGAAAAACATATACCATGATGGGTTCAGAAGATCATTTGGGAGTTATACCCAGGGCAATT
CATGACATTTTCCAAAAAATTAAGAAGTTTCCTGATAGGGAATTTCTCTTACGTGTATCTTACATGGAAA
TATACAATGAAACCATTACAGATTTACTCTGTGGCACTCAAAAAATGAAACCTTTAATTATTCGAGAAGA
TGTCAATAGGAATGTGTATGTTGCTGATCTCACAGAAGAAGTTGTATATACATCAGAAATGGCTTTGAAA
TGGATTACAAAGGGAGAAAAGAGCAGGCATTATGGAGAAACAAAAATGAATCAAAGAAGCAGTCGTTCTC
ATACCATCTTTAGGATGATTTTGGAAAGCAGAGAGAAGGGTGAACCTTCTAATTGTGAAGGATCTGTTAA
GGTATCCCATTTGAATTTGGTTGATCTTGCAGGCAGTGAAAGAGCTGCTCAAACAGGCGCTGCAGGTGTG
CGGCTCAAGGAAGGCTGTAATATAAATCGAAGCTTATTTATTTTGGGACAAGTGATCAAGAAACTTAGTG
ATGGACAAGTTGGTGGTTTCATAAATTATCGAGATAGCAAGTTAACACGAATTCTTCAGAATTCCTTGGG
AGGAAATCCAAAGACACGTATTATCTGCACAATTACTCCAGTATCTTTTGATGAAACTCTTACTGCTCTC
CAGTTTGCCAGTACTGCTAAATATATGAAGAATACTCCTTATGTTAATGAGGTATCAACTGATGAAGCTC
TCCTGAAAAGGTATAGAAAAGAAATAATGGATCTTAAAAAACAATTAGAGGAGGTTTCTTTAGAGACGCG
GGCTCAGGCAATGGAAAAAGACCAATTGGCCCAACTTTTGGAAGAAAAAGATTTGCTTCAGAAAGTACAG
AATGAGAAAATTGAAAACTTAACACGGATGCTGGTGACCTCTTCTTCCCTCACGTTGCAACAGGAATTAA
AGGCTAAAAGAAAACGAAGAGTTACTTGGTGCCTTGGCAAAATTAACAAAATGAAGAACTCAAACTATGC
AGATCAATTTAATATACCAACAAATATAACAACAAAAACACATAAGCTTTCTATAAATTTATTACGAGAA
ATTGATGAATCTGTCTGTTCAGAGTCTGATGTTTTCAGTAACACTCTTGATACATTAAGTGAGATAGAAT
GGAATCCAGCAACAAAGCTACTAAATCAGGAGAATATAGAAAGTGAGTTGAACTCACTTCGTGCTGACTA
TGATAATCTGGTATTAGACTATGAACAACTACGAACAGAAAAAGAAGAAAATGGAATTGAAATTAAAGAA
AAGAATGATTTGGATGAATTTGAGGCTCTAGAAAGAAAAACTAAAAAAGATCAAGAGATGCAACTAATTC
ATGAAATTTCGAACTTAAAGAATTTAGTTAAGCATCGAGAAGTATATAATCAAGATCTTGAGAATGAACT
CAGTTCAAAAGTAGAGCTGCTTAGAGAAAAGGAAGACCAGATTAAGAAGCTACAGGAATACATAGACTCT
CAAAAGCTAGAAAATATAAAAATGGACTTGTCATACTCATTGGAAAGCATTGAAGACCCAAAACAAATGA
AGCAGACTCTGTTTGATGCTGAAACTGTAGCCCTTGATGCCAAGAGAGAATCAGCCTTTCTTAGAAGTGA
AAAATCTGGAGTTGAAGGAGAAATGAAAGAACTTGCAACTACATACAAGCAAATGGAAAATGATATTCAG
TTATATCAAAGCCAATTGGAGGCAAAAAGAAAATGCAAGTTGATCTGGAGAAAGAATTACAATCTGCTT
TTAATGAGATAACAAAACTCACCTCCCTTATAGATGGCAAAGTTCCAAAAGATTTGCTCTGTAATTTGGA
ATTGGAAGGAAAGATTACTGATCTTCAGAAAGAACTAATAAAGAAGTTGAAGAAAATGAAGCTTTTGCGG
GAAGAAGTCATTTTGCTTTCAGAATTGAAATCTTTACCTTCTGAAGTAGAAAGGCTGAGGAAAGAGATAC
AAGACAAATCTGAAGAGCTCCATATAATAACATCAGAAAAGATAAATTGTTTTCTGAAGTAGTTCATAA
GGAGAGTAGAGTTCAAGGTTTACTTGAAGAAATTGGGAAAACAAAAGATGACCTAGCAACTACACAGTCG
AATTATAAAAGCACTGATCAAGAATTCCAAAATTTCAAAACCCTTCATATGGACTTTGAGCAAAAGTATA
AGATGGTCCTTGAGGAGAATGAGAGAATGAATCAGGAAATAGTTAATCTCTCTAAAGAAGCCCAAAAATT
TGATTCGAGTTTGGGTGCTTTGAAGACCGAGCTTTCTTACAAGACCCAAGAACTTCAGGAGAAAACACGT
```

FIGURE 144 cont'd

```
GAGGTTCAAGAAAGACTAAATGAGATGGAACAGCTGAAGGAACAATTAGAAAATAGAGATTCTCCGCTGC
AAACTGTAGAAAGGGAGAAAACACTGATTACTGAGAAACTGCAGCAAACTTTAGAAGAAGTAAAAACTTT
AACTCAAGAAAAAGATGATCTAAAACAACTCCAAGAAAGCTTGCAAATTGAGAGGGACCAACTCAAAAGT
GATATTCACGATACTGTTAACATGAATATAGATACTCAAGAACAATTACGAAATGCTCTTGAGTCTCTGA
AACAACATCAAGAAACAATTAATACACTAAAATCGAAAATTTCTGAGGAAGTTTCCAGGAATTTGCATAT
GGAGGAAAATACAGGAGAAACTAAAGATGAATTTCAGCAAAAGATGGTTGGCATAGATAAAAAACAGGAT
TTGGAAGCTAAAAATACCCAAACACTAACTGCAGATGTTAAGGATAATGAGATAATTGAGCAACAAAGGA
AGATATTTTCTTTAATACAGGAGAAAATGAACTCCAACAAATGTTAGAGAGTGTTATAGCAGAAAAGGA
ACAATTGAAGACTGACCTAAAGGAAAATATTGAAATGACCATTGAAAACCAGGAAGAATTAAGACTTCTT
GGGGATGAACTTAAAAAGCAACAAGAGATAGTTGCACAAGAAAAGAACCATGCCATAAAGAAAGAAGGAG
AGCTTTCTAGGACCTGTGACAGACTGGCAGAAGTTGAAGAAAAACTAAAGGAAAAGAGCCAGCAACTCCA
AGAAAAACAGCAACAACTTCTTAATGTACAAGAAGAGATGAGTGAGATGCAGAAAAAGATTAATGAAATA
GAGAATTTAAAGAATGAATTAAAGAACAAAGAATTGACATTGGAACATATGGAAACAGAGAGGCTTGAGT
TGGCTCAGAAACTTAATGAAAATTATGAGGAAGTGAAATCTATAACCAAAGAAAGAAAAGTTCTAAAGGA
ATTACAGAAGTCATTTGAAACAGAGAGAGACCACCTTAGAGGATATATAAGAGAAATTGAAGCTACAGGC
CTACAAACCAAAGAAGAACTAAAAATTGCTCATATTCACCTAAAAGAACACCAAGAAACTATTGATGAAC
TAAGAAGAAGCGTATCTGAAGACAGCTCAAATAATAAATACTCAGGACTTAGAAAAATCCCATACCAA
ATTACAAGAAGAGATCCCAGTGCTTCATGAGGAACAAGAGTTACTGCCTAATGTGAAAAAAGTCAGTGAG
ACTCAGGAAACAATGAATGAACTGGAGTTATTAACAGAACAGTCCACAACCAAGGACTCAACAACACTGG
CAAGAATAGAAATGGAAAGGCTCAGGTTGAATGAAAAATTTCAAGAAAGTCAGGAAGAGATAAAATCTCT
AACCAAGGAAAGAGACAACCTTAAAACGATAAAAGAAGCCCTTGAAGTTAAACATGACCAGCTGAAAGAA
CATATTAGAGAAACTTTGGCTAAAATCCAGGAGTCTCAAAGCAAACAAGAACAGTCCTTAAATATGAAAG
AAAAAGACAATGAAACTACCAAAATCGTGAGTGAGATGGAGCAATTCAAACCCAAAGATTCAGCACTACT
AAGGATAGAAATAGAAATGCTCGGATTGTCCAAAAGACTTCAAGAAAGTCATGATGAAATGAAATCTGTA
GCTAAGGAGAAAGATGACCTACAGAGGCTGCAAGAAGTTCTTCAATCTGAAAGTGACCAGCTCAAAGAAA
ACATAAAAGAAATTGTAGCTAAACACCTGGAAACTGAAGAGGAACTTAAAGTTGCTCATTGTTGCCTGAA
AGAACAAGAGGAAACTATTAATGAGTTAAGAGTGAATCTTTCAGAGAAGGGAAACTGAAATATCAACCATT
CAAAAGCAGTTAGAAGCAATCAATGATAAATTACAGAACAAGATCCAAGAGATTTATGAGAAAGAGGAAC
AACTTAATATAAAACAAATTAGTGAGGTTCAGGAAAACGTGAATGAACTGAAACAATTCAAGGAGCATCG
CAAAGCCAAGGATTCAGCACTACAAAGTATAGAAAGTAAGATGCTCGAGTTGACCAACAGACTTCAAGAA
AGTCAAGAAGAAATACAAATTATGATTAAGGAAAAAGAGGAAATGAAAAGAGTACAGGAGGCCCTTCAGA
TAGAGAGAGACCAACTGAAAGAAAACACTAAAGAAATTGTAGCTAAAATGAAAGAATCTCAAGAAAAAGA
ATATCAGTTTCTTAAGATGACAGCTGTCAATGAGACTCAGGAGAAAATGTGTGAAATAGAACACTTGAAG
GAGCAATTTGAGACCCAGAAGTTAAACCTGGAAAACATAGAAACGGAGAATATAAGGTTGACTCAGATAC
TACATGAAAACCTTGAAGAAATGAGATCTGTAACAAAAGAAAGAGATGACCTTAGGAGTGTGGAGGAGAC
TCTCAAAGTAGAGAGAGACCAGCTCAAGGAAAACCTTAGAGAAACTATAACTAGAGACCTAGAAAAACAA
GAGGAGCTAAAAATTGTTCACATGCATCTGAAGGAGCACCAAGAAACTATTGATAAACTAAGAGGGATTG
TTTCAGAGAAAACAAATGAAATATCAAATATGCAAAAGGACTTAGAACACTCAAATGATGCCTTAAAAGC
ACAGGATCTGAAAATACAAGAGGAACTAAGAATTGCTCACATGCATCTGAAAGAGCAGCAGGAAACTATT
GACAAACTCAGAGGAATTGTTTCTGAGAAGACAGATAAACTATCAAATATGCAAAAGATTTAGAAAATT
CAAATGCTAAATTACAAGAAAAGATTCAAGAACTTAAGGCAAATGAACATCAACTTATTACGTTAAAAAA
AGATGTCAATGAGACACAGAAAAAGTGTCTGAAATGGAGCAACTAAAGAAACAAATAAAAGACCAAAGC
TTAACTCTGAGTAAATTAGAAATAGAGAATTTAAATTTGGCTCAAGAACTTCATGAAAACCTTGAAGAAA
TGAAATCTGTAATGAAAGAAAGAGATAATCTAAGAAGAGTAGAGGAGACACTCAAACTGGAGAGAGACCA
ACTCAAGGAAAGCCTGCAAGAAACCAAAGCTAGAGATCTGGAAATACAACAGGAACTAAAAACTGCTCGT
ATGCTATCAAAAGAACACAAAGAAACTGTTGATAAACTTAGAGAAAAAATTTCAGAAAAGACAATTCAAA
TTTCAGACATTCAAAGGATTTAGATAAGATCCAAAAGATGAATTGACAGAAAAAGATCCAAGAACTTCAGAA
AAAAGAACTTCAACTGCTTAGAGTGAAAGAAGATGTCAATATGAGTCATAAAAAAATTAATGAAATGGAA
CAGTTGAAGAAGCAATTTGAGCCAAACTATCTATGCAAGTGTGAGATGGATAACTTCCAGTTGACTAAGA
AACTTCATGAAAGCCTTGAAGAAATAAGAATTGTAGCTAAAGAAAGAGATGAGCTAAGGAGGATAAAAGA
ATCTCTCAAAATGGAAAGGGACCAATTCATAGCAACCTTAAGGGAAATGATAGCTAGAGACCGACAGAAC
CACCAAGTAAAACCTGAAAAAAGGTTACTAAGTGATGGACAACAGCACCTTATGGAAAGCCTGAGAGAAA
AGTGCTCTAGAATAAAAGAGCTTTTGAAGAGATACTCAGAGATGGATGATCATTATGAGTGCTTGAATAG
ATTGTCTCTTGACTTGGAGAAGGAAATTGAATTCCACAGAATCATGAAGAAACTGAAGTATGTGTTAAGC
TATGTTACAAAAATAAAAGAAGAACAACATGAATGCATCAATAAATTTGAAATGGATTTTATTGATGAAG
TGGAAAAGCAAAAGGAATTGCTAATTAAAATACAGCACCTTCAACAAGATTGTGATGTACCATCCAGAGA
ATTAAGGGATCTCAAATTGAACCAGAATATGGATCTACATATTGAGGAAATTCTCAAAGATTTCTCAGAA
AGTGAGTTCCCTAGCATAAAGACTGAATTTCAACAAGTACTAAGTAATAGGAAAGAAATGACACAGTTTT
TGGAAGAGTGGTTAAATACTCGTTTTGATATAGAAAAGCTTAAAAATGGCATCCAGAAAGAAAATGATAG
GATTTGTCAAGTGAATAACTTCTTTAATAACAGAATAATTGCCATAATGAATGAATCAACAGAGTTTGAG
GAAAGAAGTGCTACCATATCCAAAGAGTGGGAACAGGACCTGAAATCACTGAAAGAGAAAAATGAAAAAC
```

FIGURE 144 cont'd

```
TATTTAAAAACTACCAAACATTGAAGACTTCCTTGGCATCTGGTGCCCAGGTTAATCCTACCACACAAGA
CAATAAGAATCCTCATGTTACATCAAGAGCTACACAGTTAACCACAGAGAAAATTCGAGAGCTGGAAAAT
TCACTGCATGAAGCTAAAGAAAGTGCTATGCATAAGGAAAGCAAGATTATAAAGATGCAGAAAGAACTTG
AGGTGACTAATGACATAATAGCAAAACTTCAAGCCAAAGTTCATGAATCAAATAAATGCCTTGAAAAAAC
AAAAGAGACAATTCAAGTACTTCAGGACAAAGTTGCTTTAGGAGCTAAGCCATATAAAGAAGAAATTGAA
GATCTCAAAATGAAGCTTGTGAAAATAGACCTAGAGAAAATGAAAAATGCCAAAGAATTTGAAAAGGAAA
TCAGTGCTACAAAAGCCACTGTAGAATATCAAAAGGAAGTTATAAGGCTATTGAGAGAAAATCTCAGAAG
AAGTCAACAGGCCCAAGATACCTCAGTGATATCAGAACATACTGATCCTCAGCCTTCAAATAAACCCTTA
ACTTGTGGAGGTGGCAGCGGCATTGTACAAAACACAAAAGCTCTTATTTTGAAAAGTGAACATATAAGGC
TAGAAAAAGAAATTTCTAAGTTAAAGCAGCAAAATGAACAGCTAATAAAACAAAAGAATGAATTGTTAAG
CAATAATCAGCATCTTTCCAATGAGGTCAAAACTTGGAAGGAAAGAACCCTTAAAAGAGAGGCTCACAAA
CAAGTAACTTGTGAGAATTCTCCAAAGTCTCCTAAAGTGACTGGAACAGCTTCTAAAAAGAAACAAATTA
CACCCTCTCAATGCAAGGAACGGAATTTACAAGATCCTGTGCCAAAGGAATCACCAAAATCTTGTTTTTT
TGATAGCCGATCAAAGTCTTTACCATCACCTCATCCAGTTCGCTATTTTGATAACTCAAGTTTAGGCCTT
TGTCCAGAGGTGCAAAATGCAGGAGCAGAGAGTGTGGATTCTCAGCCAGGTCCTTGGCACGCCTCCTCAG
GCAAGGATGTGCCTGAGTGCAAAACTCAGTAGACTCCTCTTTGTCACTTCTCTGGAGATCCAGCATTCCT
TATTTGGAAATGACTTTGTTTATGTGTCTATCCCTGGTAATGATGTTGTAGTGCAGCTTAATTTCAATTC
AGTCTTTACTTTGCCACTAGAGTTGAAAGATAAGGGAACAGGAAATGAATGCATTGTGGTAATTTAG
```

FIGURE 145
SEQ ID NO: 137
Genbank ID       : AA180985
Unigene ID(#167) : Hs.285574
Unigene name     :       zinc finger protein 229 ZNF229
>gi|1764264|gb|AA180985.1|AA180985 zp44c07.s1 Stratagene muscle 937209 Homo sap
iens cDNA clone IMAGE:612300 3', mRNA sequence
```
TTTTTTTTGAGGTTACAACATGAATCTTTAATCATAAGGGATTGTTCCATCAGGCTAATTTATAAAAAAA
TAGCTCTACTGTTATTATAAAACTGAAAGATACTTTGTTACAAAGTAAAATACATAAAAGTACAACATAT
GTATTATACATTCAGAATCCCACCACTAGAGATAAGTAGTTATATGTCCTCTCCCACATCTTTTTTTCTC
TGTTGCTCTAAACATACACACAGAAAAACATACTAACAAAATGGGGTCATGCTATAATTGTTGTTCTAAA
ACTCTCCTGGTTCACTAAATACTTCATGAGCAACCTGCACTGTCATTATCTGTGCCTGAAGATTTCTA
GTGGCTTTCCATTGCATACATATGCCTGAACTTATCTAAAAAATTTCCTACCAATGGGAAACTGGAATAT
TAACATTTGCNATTTTAAAAATGGTTTTAAATTTAAAAACTCCACCTTCTGCATGNGGTTTTGGCCCAGT
GGGGGANCTATCTCCCCAGGTATCCATTNACTACATAATTACCGGGCACCTCT
```

FIGURE 146
SEQ ID NO: 138
Genbank ID       : AK022197.1
Unigene ID(#167) : Hs.130581
Unigene name     :       CDNA FLJ12135 fis, clone MAMMA1000307.
>gi|10433541|dbj|AK022197.1| Homo sapiens cDNA FLJ12135 fis, clone MAMMA1000307
```
TTAGAAGGTGAGATTAGCATAAGCAGAGGTTTGAGGGAAGAGTGGGAGCAAGGAGTGGAGGACAGGAAAC
AGGAAGGAGACTGGGCTGCTGGTGGGGAGGAGGCAGGACAGGCCCTGTGAGGGCAGGGCAAAGTGGGAGT
CAGCGTTGGCCAAAGCGAGAGAGCCCCAGGCAGTGGAGCCTTTGATGTCAGGCCTGAAGGCAGTGGGGAC
TGTCTTAGAATTTTATGCTGAGATGAAAATGTATGACTGAAAAATTGGTCTGGTGGCAGGAGGTGATCAG
AGTGGGTGGCCGCAAGAGGCTTCCTGGGGAATGGGCTTCCTCAGTATCCGGGTGCAGCAGGTGGGCCAGA
GGCGACCCATGGCAGCCCCCAGTGTCAACGTGAGCAAGTGCAGGACTGTCGACAAGACTGTGATCGCATG
CCCGGGGCAGAGAAGATGATGGAAAGGAGAAGTTGCCCCAGATCCAGTGGCTCACAGAAGCACTCTTCC
TGAGGAAGAGCTTGTTCTTGAAGTTTGCACCCACAGCTTCTCCTAGGCGATGGGCTTGGAGAGCTGTGGT
CAGCATCAAGAGCTAGCCTGGCAGCAGGGCAAGGATGTGGCTGCGAGATGGCATCGTGGTACCCACTCTC
TCTCGGTGCCTCAGTGTCCTTGTGGAGGATCTGGCCTCTATGACTTGAGTGATGGTAAAGTGAGATGATC
CCATATGGCGTTTGACGTTGTGCTGCACACGGGGTGGGTGCCCAGTAAATGGGAGTGGTTATTATTTTGA
AGATCCTTTAGGGAAAAAATGTCCATTCTTTAAGAAGCTAAAGCAGAAATGAAGGGAATGAGCACTCAGA
CATCTTCCACTCTGCAAACATTTTTGTTAATAACAGGAAGGAAGAGAAGCAGCCACATTTTTTCTGTGGT
TCTCATATAACATTGTCGTGTACTTGGTGGAAATTACAGAGGGAGCTAGACTTTGAAAAGCCTTAAGACT
TGTCAACCCAGCTTATCAGATGAGGTCTCCAGTATTTTTCAGAAGGTAATCACTTGAGAGGCTTTGTTTC
```

FIGURE 146 cont'd

```
TTCTTATCAATTCACAATTAATGTGTTTTTATTAAACTGGCAGATTATAATTTTGCATTAGAGTTCTGGG
GCTCTTAAGTGCATAAAATTCATTTGCCTACACCTTTTTTCAACTACGTATTTCAATTCAGTGTTTATT
GGCATTTGCTAACTACATATTCATTACCTTACTGGTCAAATAAAACAATATATGTGTGTCTCACTCCTAA
AGGATCTTATCAGAAAGGACTGTCAAATGATGATAGAAGACGGTAAGTGAATGAGGACTAACAGGAGTGG
TCTAGACAGTGAGCTCTCCAGAACTGGAAGGAAGTTAGAACCGGGCACTAAAATCCTCAGCAGAGGCCTT
GCAAGGTGAGATAAGAAGCCGGGTTTTGAAAAGGTGGTCTGGTGTGGGCAGTGGGAGGTCAGTGTGAGGA
GAGATGACCAACATGAGCAGAGAGACCCGAGTGGGTCTGAGCAGGCCTCCACCAAAGGATGGGCAGACCT
GGCCAAAGAGACATTTTGAGTAAGTCTGAGGGGGCCTGATAGCCACAGTCCGTGTGACTCTATTTCACTC
CTACGATTCTATGAAAATAGGCTGGAATGATGTTTTAGGGGAGAGAATGGGAGCCAGGGGGGTGTTTTA
TTTTCAAATTAATTGCATGTGACTGAAAATGAAATTTCAAAGTATATATGCTTACCATCCAATTTGTCTT
ATACTTGCTGCTGAATAAAAAGTCCTGAAATTCAGTTTAAATATTGGTCTTTGTTATCCCAAAATAGCAA
TCATAATTATGGTAAATTAGTTGAATTCACCTTTCATTTATTTGTAGTAAATATCTATTTCACTTAACT
TTAGTAGATAAAGTAACCAACTATTGTTCAGCTTTTTAAAAAGCCTTCACAATACAATTAAAAAAATTAT
ATGTAGTAACTAATAAAAGTAAACCATTTCTTTAAAATTCACGGGGTGTACTTGCAAAACAGTTCATGCA
CACCTGGGAAGATGGAGAGAGAACTATGAAATAAGAATGCACAGGGCCGGGCGCGGTGGCTCATGCCTGT
AATCCCAGCACTTTGGGAGGCCGAGGCGGGCAGATCACGGTCAGGAGATCGAGACCATCCTGGCTAAC
ACAGTGAAACCCCGTCTCTACTAAAAATACAAAAATTAGCTGAGCATGGTGGTGCGTGCCTGTAGTCCC
AGCTAGTGGGGAGTCTGAGGGAGGAGAATCGCTTGAACCTGGGAGGTGGAGGTCACAGTGAGCCGAGATC
GTGCCACGGCACTCCAGCCTGGGTGACAGAGTGAGACTCCGTCTCC
```

FIGURE 147
SEQ ID NO: 139
```
Genbank ID       : NM_000767.2
Unigene ID(#167) : Hs.1360
Unigene name     :       cytochrome P450, family 2, subfamily B, polypeptide
6     CYP2B6
>gi|13699814|ref|NM_000767.2| Homo sapiens cytochrome P450, subfamily IIB
(phen
obarbital-inducible), polypeptide 6 (CYP2B6), mRNA
CAGACCATGGAACTCAGCGTCCTCCTCTTCCTTGCACTCCTCACAGGACTCTTGCTACTCCTGGTTCAGC
GCCACCCTAACACCCATGACCGCCTCCCACCAGGGCCCGCCCCTCTGCCCCTTTTGGGAAACCTTCTGCA
GATGGATAGAAGAGGCCTACTCAAATCCTTTCTGAGGTTCCGAGAGAAATATGGGGACGTCTTCACGGTA
CACCTGGGACCGAGGCCCGTGGTCATGCTGTGTGGAGTAGAGGCCATACGGGAGGCCCTTGTGGACAAGG
CTGAGGCCTTCTCTGGCCGGGGAAAAATCGCCATGGTCGACCCATTCTTCCGGGGATATGGTGTGATCTT
TGCCAATGGAAACCGCTGGAAGGTGCTTCGGCGATTCTCTGTGACCACTATGAGGGACTTCGGGATGGGA
AAGCGGAGTGTGGAGGAGCGGATTCAGGAGGAGGCTCAGTGTCTGATAGAGGAGCTTCGGAAATCCAAGG
GGGCCCTCATGGACCCCACCTTCCTCTTCCAGTCCATTACCGCCAACATCATCTGCTCCATCGTCTTTGG
AAAACGATTCCACTACCAAGATCAAGAGTTCCTGAAGATGCTGAACTTGTTCTACCAGACTTTTTCACTC
ATCAGCTCTGTATTCGGCCAGCTGTTTGAGCTCTTCTCTGGCTTCTTGAAATACTTTCCTGGGGCACACA
GGCAAGTTTACAAAAACCTGCAGGAAATCAATGCTTACATTGGCCACAGTGTGGAGAAGCACCGTGAAAC
CCTGGACCCCAGCGCCCCCAAGGACCTCATCGACACCTACCTGCTCCACATGGAAAAGAGAAATCCAAC
GCACACAGTGAATTCAGCCACCAGAACCTCAACCTCAACACGCTCTCGCTTCTTTGCTGGCACTGAGA
CCACCAGCACCACTCTCCGCTACGGCTTCCTGCTCATGCTCAAATACCCTCATGTTGCAGAGAGAGTCTA
CAGGGAGATTGAACAGGTGATTGGCCCACATCGCCCTCCAGAGCTTCATGACCGAGCCAAAATGCCATAC
ACAGAGGCAGTCATCTATGAGATTCAGAGATTTTCCGACCTTCTCCCCATGGGTGTGCCCCACATTGTCA
CCCAACACACCAGCTTCCGAGGGTACATCATCCCCAAGGACACAGAAGTATTTCTCATCCTGAGCACTGC
TCTCCATGACCCACACTACTTTGAAAAACCAGACGCCTTCAATCCTGACCACTTTCTGGATGCCAATGGG
GCACTGAAAAGACTGAAGCTTTTATCCCCTTCTCCTTAGGGAAGCGGATTTGTCTTGGTGAAGGCATCG
CCCGTGCGGAATTGTTCCTCTTCTTCACCACCATCCTCCAGAACTTCTCCATGGCCAGCCCCGTGGCCCC
AGAAGACATCGATCTGACACCCCAGGAGTGTGGTGTGGGCAAAATACCCCCAACATACCAGATCCGCTTC
CTGCCCCGCTGAAGGGGCTGAGGGAAGGGGGTCAAAGGATTCCAGGGTCATTCAGTGTCCCCGCCTCTGT
AGACAATGGCTCTGACTCCCCGCAACTTCCTGCCTCTGAGAGACCTGCTACAAGCCAGCTTCCTTCCCCT
CCATGGCACCAGTTGTCTGAGGTCACATTGCAAGTGAGTGCAGGAGTGAGATTATCGAAAATTATAATAT
ACAAAATCATATATATATATATGTTCTTGTTTTTTGAGACAGAGTCTCACACTGTTGCCCAGGCTGGAGT
GCAGTGGCGTGATCTTGGCTCACTGCAACCTCCACCCCGGGGATCAAGCAACTCTCCTGCCTCAGCCTC
CCTAGAGGCTGGGATTACAGGCATGCACTACCACGCTTGGCTAATTTTTGTATTTTTAGTAGAGATGGGG
TTTCACTGTGTAGGCCAGGCTGGTCTCGAACTCCTGAACTCAAGTGATTCACCCACCTTAGCCTCCCAAA
GTGCTGGGATTACAGGCGTGAGTCACCGTGCCCAGCCATGTATATATATAATTTTAAAAATTAAGCTGAA
ATTCACATAACATAAAATTAGCCGTTTTAAAGTGTAAAATTTAGTGGCGTGTGGTTCATTCACAAAGCTG
TACAACCACCACCATCTAGTTCCAAACATTTTCTTTTTTTCTGAGATGGAGTCTCACTCTGTCACCCAGG
```

FIGURE 147 cont'd

```
TTCGAGTTCAGTGGTGCCATCTCTGTCCACTGCAACCTCCACATCCTGGGTTCAAGTGATTCTCCTGCCT
CAGCCTCTGGAGGAGCTGGTATCACAGGCGTCCCCCACCACGCCTGGCTAAATTTTGTATTTTTAGGTGG
TCTTGAACTCCTGATGTCAGGTGATTCTCCTAGCTCCAAATGTTTTCATTATCTCTCCCCCAACAAAACC
CATACCTATCAAGCTGTCACTCCCCATACCCCATTCTCTTTTTCATCTCGGCCCCTGTCAATCTGGTTTT
TGTCACTATGGACTTACCAATTCTGAATATTTCCCATAAACAGAATCATACAATATTTGATTTTTTTTTT
TTTTTGAAACTAAGCCTTGCTCTGTCTCCCAGGCTGGAGTGCTATGGTGCAATTTTGTTCACTGCAACC
TCTGCCTTCCAAGATCAAGAGATTCTCCAGTCTCAGCTCCCAAGTAGCTGGGATTACAGGCATGTACTAC
CATGCCTGGCTAATTTTCTTGTAGTTTTAGTAGGGACATGTTGGCCAGGCTGGTGGTGAGCTCCTGGCCT
CAGGTGATCCACCCACCTCAGTGTTCCTAAGTGCTGATATTACAGGCATAATATGTGATCTTTTGTGTCT
GGTTGCTTTCATGTTGAATGCTATTTTTGAGGTTCGTGCCTGTTGTAGACCACAGTCACACACTGCTGTA
GTCTTCCCGAGTCCTCATTCCCAGCTGCCTCTTCCTACTGCTTCCGTCTATCAAAAAGCCCCCTTGGCCC
AGGTTCCCTGAGCTGTGGATTCTGCACTGGTGCTTTGGATTCCCTGATATGTTCCTTCAAATCTGCTGA
GAATTAAATAAACATCTCTAAAGCCTGACCTCCCCACGTC
```

FIGURE 148
SEQ ID NO: 140
Genbank ID         : NM_001565.1
Unigene ID(#167)   : Hs.413924
Unigene name       :         chemokine (C-X-C motif) ligand 10     CXCL10
>gi|4504700|ref|NM_001565.1| Homo sapiens chemokine (C-X-C motif) ligand 10
(CX
CL10), mRNA
```
GAGACATTCCTCAATTGCTTAGACATATTCTGAGCCTACAGCAGAGGAACCTCCAGTCTCAGCACCATGA
ATCAAACTGCGATTCTGATTTGCTGCCTTATCTTTCTGACTCTAAGTGGCATTCAAGGAGTACCTCTCTC
TAGAACCGTACGCTGTACCTGCATCAGCATTAGTAATCAACCTGTTAATCCAAGGTCTTTAGAAAAACTT
GAAATTATTCCTGCAAGCCAATTTTGTCCACGTGTTGAGATCATTGCTACAATGAAAAAGAAGGGTGAGA
AGAGATGTCTGAATCCAGAATCGAAGGCCATCAAGAATTTACTGAAAGCAGTTAGCAAGGAAATGTCTAA
AAGATCTCCTTAAAACCAGAGGGGAGCAAAATCGATGCAGTGCTTCCAAGGATGGACCACACAGAGGCTG
CCTCTCCCATCACTTCCCTACATGGAGTATATGTCAAGCCATAATTGTTCTTAGTTTGCAGTTACACTAA
AAGGTGACCAATGATGGTCACCAAATCAGCTGCTACTACTCCTGTAGGAAGGTTAATGTTCATCATCCTA
AGCTATTCAGTAATAACTCTACCCTGGCACTATAATGTAAGCTCTACTGAGGTGCTATGTTCTTAGTGGA
TGTTCTGACCCTGCTTCAAATATTTCCCTCACCTTTCCCATCTTCCAAGGGTACTAAGGAATCTTTCTGC
TTTGGGGTTTATCAGAATTCTCAGAATCTCAAATAACTAAAAGGTATGCAATCAAATCTGCTTTTTAAAG
AATGCTCTTTACTTCATGGACTTCCACTGCCATCCTCCCAAGGGGCCCAAATTCTTTCAGTGGCTACCTA
CATACAATTCCAAACACATACAGGAAGGTAGAAATATCTGAAAATGTATGTGTAAGTATTCTTATTTAAT
GAAAGACTGTACAAAGTATAAGTCTTAGATGTATATATTTCCTATATTGTTTTCAGTGTACATGGAATAA
CATGTAATTAAGTACTATGTATCAATGAGTAACAGGAAAATTTTAAAAATACAGATAGATATATGCTCTG
CATGTTACATAAGATAAATGTGCTGAATGGTTTTCAAATAAAAATGAGGTACTCTCCTGGAAATATTAAG
AAAGACTATCTAAATGTTGAAAGATCAAAAGGTTAATAAAGTAATTATAACT
```

FIGURE 149
SEQ ID NO: 141
Genbank ID         : AA143765
Unigene ID(#167)   : Hs.439180
Unigene name       :       hypothetical protein LOC126353       LOC126353
>gi|1713188|gb|AA143765.1|AA143765  zo31e02.s1  Stratagene   colon   (#937204)
Homo s
apiens cDNA clone IMAGE:588506 3', mRNA sequence
```
TTGGCAGCTCACTCCAGGTTTATTTCAGGGCAGTTTGGGGGTGGGGGACAAAGACCCCCTCCAGCTCCTA
AACTGGGTCACTTTTCTCCCAGGTGAAGGGGACCATCCTCATGGGATCCTATCGATGTGAGAGCTTTGT
TCCACCAGGTGTGGCTGGGTGCACCAAGGTGAAGGGTTTGAGGGCTGCACAGGGACCCCCAGCACTGGGA
GTTTGGCCTCCTCCCTCAGACTGGATGGTTTCCCAGGGTTGGAAAGGGGCAGGTCTCCCCTCTCAGCTTG
GGACTTCTCAGAGGGAGGAGCTGAGTGTCTCCTCCCTCAGACCCGCAGCCCCTCAAGGTGCTGCGATCTG
TGCCACCCTCTTTGACCGGTCCCTCTGCCCTCAGACTAAGCGGANGAAATTACACCTGAAAGTGGAAGNA
GCGGGTNTCTTTCTTTCTTAGACCCAGGGCAATTTGGCAAAGTCTTAGAAGCCGAAAGGAATCAGCGGGG
GTCCA
```
FIGURE 150
SEQ ID NO: 142

FIGURE 150 cont'd

```
Genbank ID         : AB032931.1
Unigene ID(#167)   : Hs.5199
Unigene name       :     HSPC150  protein  similar  to  ubiquitin-conjugating
enzyme     HSPC150
>gi|7416119|dbj|AB032931.1|  Homo  sapiens  mRNA  for  ubiquitin-conjugating
enzyme
isolog, complete cds
GTGGAGCAGTGAACTGTGTGTGGTTCCTTCTACTTGGGGATCATGCAGAGAGCTTCGCGTCTGAAGAGAG
AGCTGCACATGTTAGCCACAGAGCCACCCCCAGGCATCACATGTTGGCAAGATAAAGACCAAATGGATGA
CCTGCGAGCTCAAATATTAGGTGGAGCCAACACACCTTATGAGAAAGGTGTTTTTAAGCTAGAAGTTATC
ATTCCTGAGAGGTACCCATTTGAACCTCCTCAGATCCGATTTCTCACTCCAATTTATCATCCAAACATTG
ATTCTGCTGGAAGGATTTGTCTGGATGTTCTCAAATTGCCACCAAAAGGTGCTTGGAGACCATCCCTCAA
CATCGCAACTGTGTTGACCTCTATTCAGCTGCTCATGTCAGAACCCAACCCTGATGACCCGCTCATGGCT
GACATATCCTCAGAATTTAAATATAATAAGCCAGCCTTCCTCAAGAATGCCAGACAGTGGACAGAGAAGC
ATGCAAGACAGAAACAAAAGGCTGATGAGGAAGAGATGCTTGATAATCTACCAGAGGCTGGTGACTCCAG
AGTACACAACTCAACACAGAAAAGGAAGGCCAGTCAGCTAGTAGGCATAGAAAAGAAATTTCATCCTGAT
GTTTAGGGGACTTGTCCT
```

FIGURE 151
SEQ ID NO: 143
```
Genbank ID         : NM_004695.1
Unigene ID(#167)   : Hs.90911
Unigene name       :      solute  carrier  family  16  (monocarboxylic  acid
transporters), member 5 SLC16A5
>gi|4759115|ref|NM_004695.1|  Homo  sapiens  solute  carrier  family  16
(monocarboxy
lic acid transporters), member 5 (SLC16A5), mRNA
CCGAATTCGGGGGCAGCAGCCACATTGGCAGTGAGGCCGTGGCAGCGTCAGCAGCAGAGGATGCCCCAGG
CCCTGGAGCGTGCAGATGGCAGCTGGGCCTGGGTGGTGCTGCTGGCCACCATGGTGACCCAGGGCCTCAC
CCTGGGCTTCCCCACGTGTATCGGCATCTTCTTCACTGAACTGCAATGGGAGTTCCAGGCCAGCAACAGC
GAGACCTCTTGGTTCCCCTCCATCCTCACGGCTGTGCTCCACATGGCAGGGCCCCTGTGCAGCATCCTGG
TGGGACGCTTCGGCTGCCGAGTGACCGTGATGCTGGGGGGCGTGCTGGCCAGCCTGGGCATGGTGGCCAG
CTCCTTCTCTCACAACCTCAGCCAGCTCTACTTCACAGCAGGATTCATCACAGGCCTGGGCATGTGCTTC
AGCTTCCAGTCAAGCATCACGGTGCTGGGCTTCTACTTTGTCCGCCGGCGGGTGCTGGCCAACGCGCTGG
CCTCGATGGGCGTCTCCCTGGGCATCACCCTCTGGCCGCTGCTCTCCCGTTACCTTCTGGAGAACCTGGG
CTGGAGGGGTACCTTCCTTGTCTTCGGCGGGATCTTTCTCCACTGCTGCATCTGCGGGGCCATCATAAGG
CCTGTGGCCACCAGTGTGGCCCCTGAGACCAAAGAATGTCCCCCGCCACCTCCCGAGACACCTGCACTTG
GCTGCCTGGCTGCATGCGGCCGGACCATCCAGCGCCACCTGGCCTTCGACATCCTGCGGCACAACACAGG
CTACTGCGTGTACATACTGGGTGTGATGTGGTCCGTCCTGGGCTTCCCACTGCCACAAGTCTTCCTGGTG
CCATATGCCATGTGGCACAGCGTGGACGAGCAGGCAGGCAGCCCTCCTCATCTCCATCATCGGCTTCAGCA
ACATCTTCCTGAGGCCCCTAGCCGGGCTGATGGCAGGACGGCCGGCCTTTGCTAGCCACCGCAAGTACCT
GTTCAGCCTGGCACTCCTGCTCAATGGGCTCACTAACCTGGTGTGTGCGGCATCAGGTGACTTCTGGGTG
CTCGTGGGCTACTGCCTGGCGTACAGCGTGTCCATGAGTGGCATCGGCGCCCTCATCTTCCAGGTTCTCA
TGGACATCGTCCCCATGGATCAGTTCCCCAGAGCCCTGGGACTCTTCACTGTCCTGGACGGCCTTGCTTT
CCTCATCTCCCCACCACTGGCCGGGTTGCTCCTGGACGCCACCAACAACTTTAGCTATGTTTTCTACATG
TCCAGCTTCTTCCTCATCTCAGCTGCCCTCTTCATGGGTGGCAGCTTCTACGCCCTGCAGAAGAAGGAGC
AAGGCAAGCAGGCTGTCGCGGCGGATGCCCTGGAGCGGGATCTTTTCTTGGAAGCCAAAGACGGTCCTGG
GAAGCAACGGTCCCCTGAGATCATGTGCCAGTCTTCCCGCCAGCCACGTCCAGCTGGCGTCAATAAGCAT
CTTTGGGGATGTCCTGCCTCCTCCAGGACCAGCCATGAGTGGCTCTTATGGCCAAAAGGCGGTACTGCAGG
CCAAGCAAACGGCTCTGGGCTGGAATAGCCCTACCTGAGTGCCCTGTTTGACTCCGCCACTATCTGCCAT
GTGAGTTGGGCAAATTGTTGACCACCTCTGAGCCTTGAAAAAGTAGGAGGTTACTTTGTTAGAGCAAAAT
AATAAAATTTAATTTTAAAAAAGAAAAAAAAAAAAAAA
```

FIGURE 152
SEQ ID NO: 144
```
Genbank ID         : NM_030920.1
Unigene ID(#167)   : Hs.385913
```

FIGURE 152 cont'd

Unigene name : acidic (leucine-rich) nuclear phosphoprotein 32 family, member E ANP32E
>gi|13569878|ref|NM_030920.1| Homo sapiens lecuine-rich acidic protein-like pro
tein (LANP-L), mRNA
GTCCCAACTCTTGGACTCCATTTGCTATTCTCTTCTTTCTCCCCCACACCTATCTGGTGGTGGTAGTGGG
CGTTTATATTTGCGTTCCTTTTCATTCATTTCTAAATCTCTTAAAAATTTTGGGTTGGGGGTATTGGGGA
AGGCAGGAAAGGGAAAAGGAGAGTAGTAGCTGAAGAGCAAGAGGAGGACATGGAGATGAAGAAGAAGATT
AACCTGGAGTTAAGGAACAGATCCCCGGAGGAGGTGACAGAGTTAGTCCTTGATAATTGCCTGTGTGTCA
ATGGGGAAATTGAAGGCCTGAATGATACTTTCAAAGAACTAGAATTTCTGAGTATGGCTAATGTGGAACT
AAGTTCGCTGGCCCGGCTTCCCAGCTTAAATAAACTTCGAAAATTGGAGCTTAGTGATAATATAATTTCT
GGAGGCTTGGAAGTCCTGGCAGAGAAATGTCCAAATCTTACCTACCTCAATCTGAGTGGAAACAAAATAA
AAGATCTCAGTACAGTAGAAGCTCTGCAAAATCTTAAAAATTTGAAAAGTCTTGACCTGTTTAACTGTGA
GATCACAAACCTGGAAGATTATAGAGAAAGTATTTTTGAACTACTGCAGCAAATCACATACTTAGATGGA
TTTGATCAGGAGGATAATGAAGCGCCGGACTCTGAAGAGGAGGATGATGAGGATGGAGATGAAGATGATG
AAGAGGAAGAGGAAAATGAAGCTGGTCCACCGGAAGGATATGAGGAAGAGGAGGAGGAAGAGGAAGAGGA
GGATGAGGATGAGGATGAAGATGAAGATGAAGCAGGTTCAGAGTTGGGAGAGGGAGAAGAGGAAGTGGGC
CTCTCATACTTAATGAAAGAAGAAATTCAGGATGAAGAAGATGATGATGACTATGTTGAAGAAGGGGAAG
AAGAGGAAGAAGAGGAAGAAGGAGGTCTTCGAGGGGAGAAGAGGAAACGAGATGCTGAAGACGATGGAGA
GGAAGAAGATGACTAGATCATTCTAAGACCAGATTCTCTAATGTTTCTGGGTGTGCAATAGAGTGATCAC
ATCTTTGTTTCTTCATGTACGATAGCTATCCCTACAGAAGATAATGTGTAACTTTTTATAGGAAAAGTGT
GGTTTTACTATTTTTGCCTTATCATTCCAAATAAGAACTAGTCTGTTAATGATCATATTGTATGTAGAGA
AAAATTTTCATTGACTCCCATTGTGGAATTCCCTAGCAATTTATTTAGACTTAATTTTTTAAATTCAAGC
TTACTGTATTAGTCATTTTTAGCCCATAATTAAAACATGATCACTTTTAAAAAAAAAAAAAAAAAAAAA

FIGURE 153
SEQ ID NO: 145
Genbank ID        : AW189430
Unigene ID(#167)  : Hs.348921
Unigene name      :      PHD finger protein 3      PHF3
>gi|6463892|gb|AW189430.1|AW189430    xl06d10.x1    NCI_CGAP_Ut4    Homo sapiens cDNA cl
one IMAGE:2675443 3' similar to TR:Q92576 Q92576 MYELOBLAST KIAA0244 ;, mRNA se
quence
CTTCTGAGGATCTCCGAGGTAAAACTGGTTGTCCCATCTTACGAAGAGGAGCTAGCTGCCATTTTTTAAT
TTCATTATCTCTACAGTCTGATGAATTTCTGCCTTCACCAGACTCCCGTTTTAAAATTTTGACCTTGTGC
TTCACTGTATCATCTATATATTTGGTTCTATCATTTGTTGTGTGTTTTGATAATCCAAGCTTTTCACACT
CCATTGTTTTATCTCCACTATGGAATTCAACTGTAGCTTGGTTTTCCAAAGTATCTGGATCTAGTATTTC
AGTCTTTTTGTCTTCTTCAGCACAACATTTTACACAGACATATTCTTTGTCTTCCTCGCCCATCTGCTGT
GCTTGAGAAAGACTTAACCCAACACAATCACCATGAAACCAGTCATCACATCTCCCACAGCCAACCATAA
ACCTGTTGCCATGTGGTTGGTTGCAAAACCCACACTGCTTGCTGGGAGTCCACATATATTTGCTTTCAAA
TGAGGAGCTATGATCAGAGCCTTCTCTTTCTATGGTACCTATGTTATCTGGAATGAACAATGGTGGCTGA
TCTAAAGGAAAACTTGTGCTTGCTGTTCTGTTGCCGGGTTGTAGGTCTTCTCAGGTTGTTTCAATGTCA
ATTTATCCTGCTGCTTGAAATGCCTGACCCCCTGAGGTTCAACCTCTTGCGTCACCTTACT

FIGURE 154
SEQ ID NO: 146
Genbank ID        : NM_018401.1
Unigene ID(#167)  : Hs.58241
Unigene name      :     gene for serine/threonine protein kinase    HSA250839
>gi|8923753|ref|NM_018401.1|    Homo sapiens    serine/threonine kinase    32B (STK32B),
mRNA
GTCCCACATCCCGCATCCGGCATCCCAGCGGCCGGGCATGTAGCAGCGGCAGCAACGGCGGAATATGGGC
GGGAACCACTCCCACAAGCCCCCGTGTTTGACGAGAATGAGGAAGTCAACTTTGACCATTTTCAGATTC
TGCGGGCCATTGGTAAAGGGAGTTTTGGAAAGGTATGCATCGTGCAGAAGCGAGACACTAAGAAAATGTA
TGCAATGAAGTACATGAACAAGCAGAAGTGCATCGAGAGGGATGAGGTTCGGAATGTTTTCCGGGAGCTG

FIGURE 154 cont'd

```
CAGATCATGCAAGGGCTGGAGCACCCCTTCCTGGTCAATCTGTGGTACTCCTTCCAGGATGAGGAGGACA
TGTTCATGGTGGTGGACCTGCTCCTGGGAGGCGACCTGCGCTACCATCTGCAGCAGAATGTGCATTTCAC
AGAGGGGACTGTGAAACTCTACATCTGTGAGCTGGCACTGGCCCTGGAGTATCTTCAGAGGTACCACATC
ATCCACAGAGACATCAAGCCAGACAATATCCTGCTGGATGAACACGGACATGTTCACATTACAGACTTCA
ACATAGCGACGGTAGTGAAAGGAGCAGAAAGGGCTTCCTCCATGGCTGGCACCAAGCCCTACATGGCTCC
AGAAGTATTCCAGGTGTACATGGACAGAGGCCCCGGATACTCGTACCCTGTCGACTGGTGGTCCCTGGGC
ATCACAGCCTATGAGCTGCTGCGGGCTGGAGGCCGTACGAAATCCACTCGGTCACGCCCATCGATGAAA
TCCTCAACATGTTCAAGGTGGAGCGTGTCCACTACTCCTCCACGTGGTGCAAGGGGATGGTGGCCCTGCT
GAGGAAGCTCCTGACCAAGGATCCTGAGAGCCGCGTGTCCAGCCTTCATGACATACAGAGCGTGCCCTAC
TTGGCCGACATGAACTGGGACGCGGTGTTCAAGAAGGCACTGATGCCCGGCTTTGTGCCCAATAAAGGGA
GGTTGAACTGCGATCCCACATTTGAGCTTGAAGAGATGATTCTAGAATCCAAGCCACTTCACAAAAAGAA
GAAGCGATTGGCAAAGAACAGATCCAGGGATGGCACAAAGGACAGCTGCCCGCTGAATGGACACCTGCAG
CACTGTTTGGAGACTGTCCGGGAGGAATTCATCATATTCAACAGAGAGAAGCTCAGGAGGCAGCAGGGAC
AGGGCAGCCAGCTCTTGGACACCGACAGCCGAGGGGGAGGCCAGGCCCAAAGCAAGCTCCAGGACGGGTG
CAACAACAACCTCCTCACCCACACCTGCACCCGTGGCTGCAGCAGCTGAGCCCACACTTGTTGCTGCTCA
ACAGGACTGCACTCGTCTCTGCCCTGCCCACCCAGAGCCCCTCTTTGTGCCCTGATGGTCCCTGTCTCAC
CCCTGAAAACATCAGATGCAGAAAAAGCCCTGGACTTGGAGCTGGGAAGCCTGGGTTCTGGTCCCATCTC
CATGACTGATTCACGTGTGACCTCAGACAAGTCACGCCCTCTCTGTGCCTCCGTTTTCTGCATCTGCCAA
AGGGGTTAAACACTTCTGCCCCACTTCAAATTACAAGATTATGGGGAGAACCCAATTAGGTAGGAAACAT
GAAAAACCTTTGATATTTATAAAATCATTTTTACGTGCAAAATATAACCTTAATATTTGAAGTGACCCCC
ATTCCCCAAAGCAATCAAACCGTCATGACTTTGCAATTTGGCACATCCTAGCTTGTTAGAGGGCACTTCC
GAAAAACACAGCCCTGACAGCAAAATAAAGGTCTGATATGTTGGCCCCTTCTATGGAAACAACGCTGCCA
AATCCTGGAGCAAAACCTGAAGTGTCTTCATGTGCATTCTCTGGCAGGCCACAGTCCTGAGCTTGTAAGA
TGGTGCAGCATGCAGACCAGACTTGTCCCCAAGGTCTCAGCGCTGCGGTCTCACTCCTCCCCTCATTTAA
GAAGACTATCCTTACCTTTTAGTTTCAGCAGTCCTCACCACCACCATATCCCCAGTGCTGGGATGGCACA
CAGGTGTCCATTCAGATGAGAGTTGGGTCGCTGAGCATTGGTTACTCCTGCAGAGTGTAATCAGCACCCC
ATCCAACTGGCCCGAAAGCCCAGACCTGCAGCAGAACTCTCCAACTCTCTATCAGCTTTCAGGGTTTTCT
CTCCTGGGAAGGGTGTAAAATCAGCTTGTCAGATTCTTCTTACAGAGATGTATCCAATCGGTATTGGTGGA
GCGGCTCCCTATTTATACAATAGGAAGCATGGGTGCTTAGAAAGTTTATTTCAGGAGGAAAATGGGTTCA
CACAAAAAGCAAACTACATTCTGATCTGCTCAGGGAGAAGCTTGCCTTTGAACTGGAAGATGTTGGGATG
AGCAGGGAAAGCTTAGACTTTGGAGTCAGGTTTGTGTTCAGAATCCAGCCCTGCTGGCTACTAACTAACT
GGGAGACCTTAGGCAAAGCATGCAATCGCTCTGAATGGCAGTTTCCTCATTTTTAAACAGGGATAATAAA
ACTAATATTGCAGGGGAGTTACAGGGTTAAATAAGATCCTGTGTGTAACCCCAAGCATTGGATGACTCAT
AGAATGGCCTTTTTTGTCAGCATAATCGTCATCATTATTTAGATACTTTCTTCCTTCACTCACCCAGCAG
GTCAGTTTTCTGTGCAAACAAACCTGTTTAGGATTCTTCCAAATGTTCTTCCTGGGGTCTTTGATATTTG
TTTGTTACATCCTGCTGAAGTTCGACTGTGTTTTATTTTTTCATCCAACTTCCATTTTTCACTTTTTAC
ATGATTACTCAATCCTTGGGGCTGTCCATGTCATCTCTTAGATTTCTTAAAAGACATTTTAATGTATGGT
TAGGTTTTATATTTTTATTTTTTAAAAAAGAAATAGTCAGTGTTTTCCTCCTTTCAACCGAGACTATTTC
TGGATTGTGTCCTCGTCAGTTGACTTGTTTTGCACACTTTTCTTTACTTCATGTCCCATCAACAAC
CGTCCTGCTCCCCACCTCCCCCCAGGAAATAAGGGGCCTGCTCCTCCTCCCTACTGTGACCCTGGAGGCTCT
TAAGATGATGATGGTTTTTTTTATTGGGCTGAGTTCACGAATTAGGGGCAGGAGCTGGAAGTCGCCCTAG
GAACACCAGATTTCCTGGTTCTGTTCAAGTTGGCATTTCTTGTTTGGAATAAACTATTTCTTGGACATTC
CTTC
```

FIGURE 155
SEQ ID NO: 147
Genbank ID       : AL590118.1
Unigene ID(#167) : Hs.301947
Unigene name     :       kraken-like dJ222E13.1
>gi|13445181|emb|AL590118.1|HS22E131E Novel human mRNA from chromosome 22.
Spli
ce variant of dJ222E13.C22.1
```
ATGAGTGAGAACGCCGCACCAGACTTTTATTACGTTGCCATGGATTTCGGAGGTCATGGGCTCTCGTCCC
ATTACAGCCCAGGTGTCCCATATTACCTCCAGACTTTTGTGAGTGAGATCCGAAGAGTTGTGGCAGGTGG
CGTCGTGGGCGGAATGTTTTTCTGTACCTTCCCCGAGATGGTGGATAAACTTATCTTGCTGGACACGCCG
CTCTTTCTCCTGGAATCAGATGAAATGGAGAACTTGCTGACCTACAAGCGGAGAGCCATAGAGCACGTGC
TGCAGGTAGAGGCCTCCCAGGAGCCCTCGCACGTGTTCAGCCTGAAGCAGCTGCTGCAGAGGTTACTGAA
GAGCAATAGCCACTTGAGTGAGGAGTGCGGGGAGCTTCTCCTGCAAAGAGGAACCACGAAGGTGGCCACA
GGTCTGGTTCTGAACAGAGACCAGAGGCTCGCCTGGGCAGAGAACAGCATTGACTTCATCAGCAGGGAGC
TGTGTGCGCATTCCATCAGGAAGCTGCAGGCCCATGTCCTGTTGATCAAAGCAGTCCACGGATATTTTGA
```

FIGURE 155 cont'd

```
TTCAAGACAGAATTACTCTGAGAAGGAGTCCCTGTCGTTCATGATAGACACGATGAAATCCACCCTCAAA
GAGCAGTTCCAGTTTGTGGAAGTCCCAGGCAATCACTGTGTCCACATGAGCGAACCCCAGCACGTGGCCA
GTATCATCAGCTCCTTCTTACAGTGCACACACATGCTCCCAGCCCAGCTGTAG
```

FIGURE 156
SEQ ID NO: 148
Genbank ID        : AK026197.1
Unigene ID(#167)  : Hs.272027
Unigene name      :       F-box only protein 5     FBX05
>gi|10438969|dbj|AK026197.1|   Homo   sapiens   cDNA:   FLJ22544   fis,   clone
HSI00219, h
ighly similar to AF129535 Homo sapiens F-box protein Fbx5 (FBX5) mRNA

```
ATACAGGTCTGTGAAGCAGGCAGGTTGCTCAGCTGCCCCGGAGCGGTTCCTCCACCTGAGGCAGACTCC
ACGTCGGCTGGCATGAGCCGGCGCCCTGCAGCGCCCTCGACCCTCGGATAGTTGTAAAGAAGAAAGTTC
TACCCTTTCTGTCAAAATGAAGTGTGATTTTAATTGTAACCATGTTCATTCCGGACTTAAACTGGTAAAA
CCTGATGACATTGGAAGACTAGTTTCCTACACCCCTGCATATTTGGAAGGTTCCTGTAAAGACTGCATTA
AAGACTATGAAAGGCTGTCATGTATTGGGTCACCGATTGTGAGCCCTAGGATTGTAGAACTTAAAACTGA
AAGCAAGCGCTTGCATAACAAGGAAAATCAACATGTGCAACAGACACTTAATAGTACAAATGAAATAGAA
GCACTAGAGACCAGTAGACTTTATGAAGACAGTGGCTATTCTCATTTTCTCTACAAAGTGGCCTCAGTG
AACATGAAGAAGGTAGCCTCCTGGAGGAGAATTTCGGTGACAGTCTACAATCCTGCCTGCTACAAATACA
AAGCCCAGACCAATATCCCAACAAAAACTTGCTGCCAGTTCTTCATTTTGAAAAAGTGGTTTGTTCAACA
TTAAAAAAGAATGCAAAACGAAATCCTAAAGTAGATCGGGAGATGCTGAAGGAAATTATAGCCAGAGGAA
GTTTTAGACTGCAGAATATAATTGGCAGAAAATGGGCCTAGAATGTGTAGATATTCTCAGCGAACTCTT
TCGAAGGGGACTCAGACGTGTCTTAGCAACTATTTTAGCACAACTCAGTGACATGGACTTAATCAATGTG
TCTAAAGTGAGCACAACTTGGAAGAAGATCCTAGAAGATGATAAGGGGGCATTCCAGTTGTACAGTAAAG
CAATACAAAGAGTTACCGAAAACAACAATAAATTTTCACCTCATGCTTCAACCAGAGAATATGTTATGTT
CAGAACCCCACTGGCTTCTGTTCAGAAATCAGCAGCCCAGACTTCTCTCAAAAAAGATGCTCAAACCAAG
TTATCCAATCAAGGTGATCAGAAAGGTTCTACTTATAGTCGACACAATGAATTCTCTGAGGTTGCCAAGA
CATTGAAAAAGAACGAAAGCCTCAAAGCCTGTAATTCGCTGTAATTCACCTGCAAAATATGATTGCTATTT
ACAACGGGCAACCTGCAAACGAGAAGGCTGTGGATTTGATTATTGTACGAAGCGTCTCTGTAATTATCAT
ACTACTAAAGACTGTTCAGATGGCAAGCTCCTCAAAGCCAGTTGTAAAATAGGTCCCCTGCCTGGTACAA
AAAAAAAAAAAAAAA
```

FIGURE 157
SEQ ID NO: 149
Genbank ID        : BF508074
Unigene ID(#167)  : acc_BF508074
Unigene name      :
>gi|11591372|gb|BF508074.1|BF508074 UI-H-BI4-apx-e-05-0-UI.s1 NCI_CGAP_Sub8
Hom
o sapiens cDNA clone IMAGE:3088977 3', mRNA sequence

```
TTTTTTTTTTTTTTTTACAATAAGGCCAAATGTCTACCCAGTAGTTAGTATCCCAGAAAATGTCTACAT
GCACCCAATTATACATACCTAAAGTATTATTTCTATTATCTTCCACTTGTATTATAATTAAGGCCATGAC
AGTAAGCTACTGTCTCTTGGCTTCAAACCCACTCTTTGGAATTCTGCAAGCATTTCTGTCTCCCTGTTAG
GCTCTGCCAATAGAGGGACCAGCGTGACACTTCACAGGTAGAGAAGGAAGAAGGAATTTGCTGTTTCCTT
CGGATGGGTTTCTTAATCCTGTTAAGTCTCACTCTAGCAACAATTCTTCACTCCGAAAGCAATAGTGCCT
GCTAGTAGTAGCAGCTGATTGCAATTTGGGGGTTTCCCAACACTTATAGAACCAATCTCAATGTGCCTTC
TTGAGATGCCAGCTCCAATTACTGGGTGCTTCTTCCTCAGATACCTGGTTCCCAGGTCTATAGGCTCCCT
CCTCTGAACTCAGAGAAATCAGTTACAGGCAAGCAGTGACCTGTTCTCAAAAGTCTGAAT
```

FIGURE 158
SEQ ID NO: 150
Genbank ID        : NM_006342.1
Unigene ID(#167)  : Hs.104019
Unigene name      :        transforming, acidic coiled-coil containing protein
3        TACC3

FIGURE 158 cont'd

>gi|5454101|ref|NM_006342.1| Homo sapiens transforming, acidic coiled-coil cont
aining protein 3 (TACC3), mRNA
GGCGGCGGTAGCAGCCAGGCTTGGCCCCCGGCGTGGAGCAGACGCGGACCCCTCCTTCCTGGCGGCGGCG
GCGCGGGCTCAGAGCCCGGCAACGGGCGGGCGGGCAGAATGAGTCTGCAGGTCTTAAACGACAAAAATGT
CAGCAATGAAAAAAATACAGAAAATTGCGACTTCCTGTTTTCGCCACCAGAAGTTACCGGAAGATCGTCT
GTTCTTCGTGTGTCACAGAAAGAAATGTGCCACCCAAGAACCTGGCCAAAGCTATGAAGGTGACTTTTC
AGACACCTCTGCGGGATCCACAGACGCACAGGATTCTAAGTCCTAGCATGGCCAGCAAACTTGAGGCTCC
TTTCACTCAGGATGACACCCTTGGACTGGAAAACTCACACCCGGTCTGGACACAGAAAGAGAACCAACAG
CTCATCAAGGAAGTGGATGCCAAAACTACTCATGGAATTCTACAGAAACCAGTGGAGGCTGACACCGACC
TCCTGGGGATGCAAGCCCAGCCTTTGGGAGTGGCAGCTCCAGCGAGTCTGGCCCAGGTGCCCTGGCTGA
CCTGGACTGCTCAAGCTCTTCCCAGAGCCCAGGAAGTTCTGAGAACCAAATGGTGTCTCCAGGAAAAGTG
TCTGGCAGCCCTGAGCAAGCCGTGGAGGAAAACCTTAGTTCCTATTCCTTAGACAGAAGAGTGACACCCG
CCTCTGAGACCCTAGAAGACCCTTGCAGGACAGAGTCCCAGCACAAAGCGGAGACTCCGCACGGAGCCGA
GGAAGAATGCAAAGCGGAGACTCCGCACGGAGCCGAGGAGGAATGCCGGCACGGTGGGGTCTGTGCTCCC
GCAGCAGTGGCCACTTCGCCTCCTGGTGCAATCCCTAAGGAAGCCTGCGGAGGAGCACCCCTGCAGGGTC
TGCCTGGCGAAGCCCTGGGCTGCCCTGCGGGTGTGGGCACCCCCGTGCCAGCAGATGGCACTCAGACCCT
TACCTGTGCACACACCTCTGCTCCTGAGAGCACAGCCCCAACCAACCACCTGGTGGCTGGCAGGGCCATG
ACCCTGAGTCCTCAGGAAGAAGTGGCTGCAGGCCAAATGGCCAGCTCCTCGAGGAGCGGACCTGTAAAAC
TAGAATTTGATGTATCTGATGGCGCCACCAGCAAAAGGGCACCCCCACCAAGGAGACTGGGAGAGAGGTC
CGGCCTCAAGCCTCCCTTGAGGAAAGCAGCAGTGAGGCAGCAAAAGGCCCGCAGGAGGTGGAGGAGGAC
GACGGTAGGAGCGGAGCAGGAGAGGACCCCCCCATGCCAGCTTCTCGGGGCTCTTACCACCTCGACTGGG
ACAAAATGGATGACCCAAACTTCATCCCGTTCGGAGGTGACACCAAGTCTGGTTGCAGTGAGGCCCAGCC
CCCAGAAAGCCCTGAGACCAGGCTGGGCCAGCCAGCGGCTGAACAGTTGCATGCTGGGCCTGCCACGGAG
GAGCCAGGTCCCTGTCTGAGCCAGCAGCTGCATTCAGCCTCAGCGGAGGACACGCCTGTGGTGCAGTTGG
CAGCCGAGACCCCAACAGCAGAGAGCAAGGAGAGAGCCTTGAACTCTGCCAGCACCTCGCTTCCCACAAG
CTGTCCAGGCAGTGAGCCAGTGCCCACCCATCAGCAGGGCAGCCTGCCTTGGAGCTGAAAGAGGAGAGC
TTCAGAGACCCCGCTGAGGTTCTAGGCACGGGCGCGGAGGTGGATTACCTGGAGCAGTTTGGAACTTCCT
CGTTTAAGGAGTCGGCCTTGAGGAAGCAGTCCTTATACCTCAAGTTCGACCCCCTCCTGAGGGACAGTCC
TGGTAGACCAGTGCCCGTGGCCACCGAGACCAGCAGCATGCACGGTGCAAATGAGACTCCCTCAGGACGT
CCGCGGGAAGCCAAGCTTGTGGAGTTCGATTTCTTGGGAGCACTGGACATTCCTGTGCCAGGCCCACCCC
CAGGTGTTCCCGCGCCTGGGGGCCCACCCCTGTCCACCGGACCCTATAGTGGACCTGCTCCAGTACAGCCA
GAAGGACCTGGATGCAGTGGTAAAGGCGACACAGGAGGAGAACCGGGAGCTGAGGAGCAGGTGTGAGGAG
CTCCACGGGAAGAACCTGGAACTGGGGAAGATCATGGACAGGTTCGAAGAGGTTGTGTACCAGGCCATGG
AGGAAGTTCAGAAGCAGAAGGAACTTTCCAAAGCTGAAATCCAGAAAGTTCTAAAAGAAAAAGACCAACT
TACCACAGATCTGAACTCCATGGAGAAGTCCTTCTCCGACCTCTTCAAGCGTTTTGAGAAACAGAAAGAG
GTGATCGAGGGCTACCGCAAGAACGAAGAGTCACTGAAGAAGTGCGTGGAGGATTACCTGGCAAGGATCA
CCCAGGAGGGCCAGAGGTACCAAGCCCTGAAGGCCCACGCGGAGGAGAAGCTGCAGCTGGCAAACGAGGA
GATCGCCCAGGTCCGGAGCAAGGCCCAGGCGGAAGCGTTGGCCCTCCAGGCCAGCCTGAGGAAGGAGCAG
ATGCGCATCCAGTCGCTGGAGAAGACAGTGGAGCAGAAGACTAAAGAGAACGAGGAGCTGACCAGGATCT
GCGACGACCTCATCTCCAAGATGGAGAAGATCTGACCTCCACGGAGCCGCTGTCCCCGCCCCCTGCTCC
CGTCTGTCTGTCCTGTCTGATTCTCTTAGGTGTCATGTTCTTTTTCTGTCTTGTCTTCAACTTTTTTA
AAACTAGATTGCTTTGAAAACATGACTCAATAAAGTTTCCTTTCAATTTAAAAAAAA

FIGURE 159
SEQ ID NO: 151
Genbank ID       : NM_002852.1
Unigene ID(#167) : Hs.2050
Unigene name     :       pentaxin-related gene, rapidly induced by IL-1 beta
      PTX3
>gi|4506332|ref|NM_002852.1| Homo sapiens pentaxin-related gene, rapidly
induce
d by IL-1 beta (PTX3), mRNA
CTCAAACTCAGCTCACTTGAGAGTCTCCTCCCGCCAGCTGTGGAAAGAACTTTGCGTCTCTCCAGCAATG
CATCTCCTTGCGATTCTGTTTTGTGCTCTCTGGTCTGCAGTGTTGGCCGAGAACTCGGATGATTATGATC
TCATGTATGTGAATTTGGACAACGAAATAGACAATGGACTCCATCCCACTGAGGACCCCACGCCGTGCGA
CTGCGGTCAGGAGCACTCGGAATGGGACAAGCTCTTCATCATGCTGGAGAACTCGCAGATGAGAGAGCGC
ATGCTGCTGCAAGCCACGGACGACGTCCTGCGGGGCGAGCTGCAGAGGCTGCGGGAGGAGCTGGGCCGGC
TCGCGGAAAGCCTGGCGAGGCCGTGCGCGCCGGGGGCTCCCGCAGAGGCCAGGCTGACCAGTGCTCTGGA
CGAGCTGCTGCAGGCGACCCGCGACGCGGGCCGCAGGCTGGCGCGTATGGAGGGCGCGGAGGCGCAGCGC

FIGURE 159 cont'd

```
CCAGAGGAGGCGGGGCGCGCCCTGGCCGCGGTGCTAGAGGAGCTGCGGCAGACGCGAGCCGACCTGCACG
CGGTGCAGGGCTGGGCTGCCCGGAGCTGGCTGCCGGCAGGTTGTGAAACAGCTATTTTATTCCCAATGCG
TTCCAAGAAGATTTTTGGAAGCGTGCATCCAGTGAGACCAATGAGGCTTGAGTCTTTTAGTGCCTGCATT
TGGGTCAAAGCCACAGATGTATTAAACAAAACCATCCTGTTTTCCTATGGCACAAAGAGGAATCCATATG
AAATCCAGCTGTATCTCAGCTACCAATCCATAGTGTTTGTGGTGGGTGGAGAGGAGAACAAACTGGTTGC
TGAAGCCATGGTTTCCCTGGGAAGGTGGACCCACCTGTGCGGCACCTGGAATTCAGAGGAAGGGCTCACA
TCCTTGTGGGTAAATGGTGAACTGGCGGCTACCACTGTTGAGATGGCCACAGGTCACATTGTTCCTGAGG
GAGGAATCCTGCAGATTGGCCAAGAAAAGAATGGCTGCTGTGTGGGTGGTGGCTTTGATGAAACATTAGC
CTTCTCTGGGAGACTCACAGGCTTCAATATCTGGGATAGTGTTCTTAGCAATGAAGAGATAAGAGAGACC
GGAGGAGCAGAGTCTTGTCACATCCGGGGGAATATTGTTGGGTGGGGAGTCACAGAGATCCAGCCACATG
GAGGAGCTCAGTATGTTTCATAAATGTTGTGAAACTCCACTTGAAGCCAAAGAAAGAAACTCACACTTAA
AACACATGCCAGTTGGGAAGGTCTGAAAACTCAGTGCATAATAGGAACACTTGAGACTAATGAAAGAGAG
AGTTGAGACCAATCTTTATTTGTACTGGCCAAATACTGAATAAACAGTTGAAGGAAAGACATTGGAAAAA
GCTTTTGAGGATAATGTTACTAGACTTTATGCCATGGTGCTTTCAGTTTAATGCTGTGTCTCTGTCAGAT
AAACTCTCAAATAATTAAAAAGGACTGTATTGTTGAACAGAGGGACAATTGTTTTACTTTTCTTTGGTTA
ATTTTGTTTTGGCCAGAGATGAATTTTACATTGGAAGAATAACAAAATAAGATTTGTTGTCCATTGTTCA
TTGTTATTGGTATGTACCTTATTACAAAAAAAATGATGAAAACATATTTATACTACAAGGTGACTTAACA
ACTATAAATGTAGTTTATGTGTTATAATCGAATGTCACGTTTTTGAGAAGATAGTCATATAAGTTATATT
GCAAAAGGGATTTGTATTAATTTAAGACTATTTTTGTAAAGCTCTACTGTAAATAAAATATTTTATAAAA
CTAAAAAAAAAAAAAAA
```

FIGURE 160
SEQ ID NO: 152
Genbank ID       : AF233336.1
Unigene ID(#167) : Hs.212088
Unigene name     :        epoxide hydrolase 2, cytoplasmic        EPHX2
>gi|10197683|gb|AF233336.1|AF233336    Homo    sapiens    clone    129-13    soluble epoxide h
ydrolase (EPHX2) mRNA, complete cds

```
GCGTGTCCGGGTGCTAGGCTGCAGACCCGCCGCCATGACGCTGCGCGCGGCCGTCTTCGACCTTGACGGG
GTGCTGGCGCTGCCAGCGGTGTTCGGCGTCCTCGGCCGCACGGAGGAGGCCCTGGCGCTGCCCAGAGGAC
TTCTGAATGATGCTTTCCAGAAAGGGGGACCAGAGGGTGCCACTACCCGGCTTATGAAAGGAGAGATCAC
ACTTTCCCAGTGGATACCACTCATGGAAGAAAACTGCAGGAAGTGCTCCGAGACCGCTAAAGTCTGCCTC
CCCAAGAATTTCTCCATAAAAGAAATCTTTGACAAGGCGATTTCAGCCAGAAGATCAACCGCCCCATGC
TCCAGGCAGCTCTCATGCTCAGGAAGAAAGGATTCACTACTGCCATCCTCACCAACACCTGGCTGGACGA
CCGTGCTGAGAGAGATGGCCTGGCCCAGCTGATGTGTGAGCTGAAGATGCACTTTGACTTCCTGATAGAG
TCGTGTCAGGTGGGAATGGTCAAACCTGAACCTCAGATCTACAAGTTTCTGCTGGACACCCTGAAGGCCA
GCCCCAGTGAGGTCGTTTTTTTGGATGACATCGGGGCTAATCTGAAGCCAGCCCGTGACTTGGGAATGGT
CACCATCCTGGTCCAGGACACTGACACGGCCCCTGAAAGAACTGGAGAAAGTGACCGGAATCCAGCTTCTC
AATACCCCGGCCCCTCTGCCGACCTCTTGCAATCCAAGTGACATGAGCCATGGGTACGTGACAGTAAAGC
CCAGGGTCCGTCTGCATTTTGTGGAGCTGGGCTCCGGCCCTGCTGTGTGCCTCTGCCATGGATTTCCCGA
GAGTTGGTATTCTTGGAGGTACCAGATCCCTGCTCTGGCCCAGGCAGGTTACCGGGTCCTAGCTATGGAC
ATGAAAGGCTATGGAGAGTCATCTGCTCCTCCCGAAATAGAAGAATATTGCATGGAAGTGTTATGTAAGG
AGATGGTAACCTTCCTGGATAAACTGGGCCTCTCTCAAGCAGTGTTCATTGGCCATGACTGGGGTGGCAT
GCTGGTGTGGTACATGGCTCTCTTCTACCCCGAGAGAGTGAGGGCGGTGGCCAGTTTGAATACTCCCTTC
ATACCAGCAAATCCCAACATGTCCCCTTTGGAGAGTATCAAAGCCAACCCAGTATTTGATTACCAGCTCT
ACTTCCAAGAACCAGGAGTGGCTGAGGCTGAACTGGAACAGAACCTGAGTCGTCGGACTTTCAAAAGCCT
CTTCAGAGCAAGCGATGAGAGTGTTTTATCCATGCATAAAGTCTGTGAAGCGGGAGGACTTTTTGTAAAT
AGCCCAGAAGAGCCCCAGCCTCAGCAGGATGGTCACTGAGGAGGAAATCCAGTTCTATGTGCAGCAGTTCA
AGAAGTCTGGTTTCAGAGGTCCTCTAAACTGGTACCGAAACATGGAAAGGAACTGGAAGTGGGCTTGCAA
AAGCTTGGGACGGAAGATCCTGATTCCGGCCCTGATGGTCACGGCGGAGAAGGACTTCGTGCTCGTTCCT
CAGATGTCCCAGCACATGGAGGACTGGATTCCCCACCTGAAAAGGGGACACATTGAGGACTGTGGGCACT
GGACACAGATGGACAAGCCAACCGAGGTGAATCAGATCCTCATTAAGTGGCTGGATTCTGATGCCCGGAA
CCCACCGGTGGTCTCAAAGATGTAGAACGCAGCGTGTGCCCACGCTCAGCAGGTGTGCCATCCTTCCACC
TGCTGGGGCACCATTCTTAGTATACAGAGGTGGCCT
```

FIGURE 161
SEQ ID NO: 153

FIGURE 161 cont'd

```
Genbank ID        : AI073396
Unigene ID(#167)  : Hs.9398
Unigene name      :      hypothetical protein FLJ10055 FLJ10055
>gi|3400040|gb|AI073396.1|AI073396    ov46a07.x1    Soares_testis_NHT    Homo
sapiens cD
NA clone IMAGE:1640340 3', mRNA sequence
TTTTAAGAAGTTTAAAGGAGTTTATTCAAAAGTTGAACATTTTTAAAATTTCACAAAACTAACCAGCAAA
GACAGTAAGCCAATCCTCCATTTACCCCCTTTCTGTCTTGGTTAAGGGCAGAGACACATGTCAGAGGGAG
ACTGCGTCCCATGTAGGGAGCTAATGTGTTCACTAGCTATTGCTTCTCGCAGGGTCGCAGCATCTACACT
CACTTGCCTCATCCACACTGTCACGTTCAAAGACAAGAAATAATCCTGAAAGTAGATCCCAAGGCCAGAA
TGCAAAGGAATAGCCAGAAGCCCAGACCAGATCAGTGGGCTAAGGGTTTGTCAAAGGCAGAATCTGGTGA
CAGCTANGGTGAGGGGGGCTTTGTCATTGGAAGCGAATCCATCGCCCATCTTCGTTGTCATCACGGTTTA
TGTTTTCCTTGGCCCTTGCGATCCAGAAGTTGCCACGGCTGCTAGTTGCGTCATCCAGTGGACACCTTTA
TATGTACAATTTGGATCCTCAGGATGGAGGAGAGTGTGTCTTAATCAAAACCCACAGGTGAAGAGACTGC
TTTTCAAAAGACAGCCTTTCGAGAGGCTGGCGTGTAGAGTTGTCCCTTCGCCAAGAACGACAAGCCTCAA
GGGCCCTTGCCATTGATTTGTTCTTTCACTGGCAGNCTCAGTGGCAAAAACCTTTAGTGGGCAAGTGCTC
TGCACCCGGGCTCTGTGGCAGGTGCCCCTCAAACATGTGGTAATTCATCCTGGTGGTCCTTGAAAAGAAC
CAGAGGGACTAA
```

FIGURE 162
SEQ ID NO: 154

```
Genbank ID        : NM_001034.1
Unigene ID(#167)  : Hs.226390
Unigene name      :      ribonucleotide reductase M2 polypeptide    RRM2
>gi|4557844|ref|NM_001034.1|   Homo   sapiens   ribonucleotide   reductase   M2
polypepti
de (RRM2), mRNA
CCCAGGCGCAGCCAATGGGAAGGGTCGGAGGCATGGCACAGCCAATGGGAAGGGCCGGGGCACCAAAGCC
AATGGGAAGGGCCGGGAGCGCGCGGCGCGGGAGATTTAAAGGCTGCTGGAGTGAGGGGTCGCCCGTGCAC
CCTGTCCCAGCCGTCCTGTCCTGGCTGCTCGCTCTGCTTCGCTGCGCCTCCACTATGCTCTCCCTCCGTG
TCCCGCTCGCGCCCATCACGGACCCGCAGCAGCTGCAGCTCTCGCCGCTGAAGGGGCTCAGCTTGGTCGA
CAAGGAGAACACGCCGCCGGCCCTGAGCGGGACCCGCGTCCTGGCCAGCAAGACCGCGAGGAGGATCTTC
CAGGAGCCCACGGAGCCGAAAACTAAAGCAGCTGCCCCCGGCGTGGAGGATGAGCCGCTGCTGAGAGAAA
ACCCCCGCCGCTTTGTCATCTTCCCCATCGAGTACCATGATATCTGGCAGATGTATAAGAAGGCAGAGGC
TTCCTTTTGGACCGCCGAGGAGGTTGACCTCTCCAAGGACATTCAGCACTGGGAATCCCTGAAACCCGAG
GAGAGATATTTTATATCCCATGTTCTGGCTTTCTTTGCAGCAAGCGATGGCATAGTAAATGAAAACTTGG
TGGAGCGATTTAGCCAAGAAGTTCAGATTACAGAAGCCCGCTGTTTCTATGGCTTCCAAATTGCCATGGA
AAACATACATTCTGAAATGTATAGTCTTCTTATTGACACTTACATAAAAGATCCCAAAGAAAGGGAATTT
CTCTTCAATGCCATTGAAACGATGCCTTGTGTCAAGAAGAAGGCAGACTGGGCCTTGCGCTGGATTGGGG
ACAAAGAGGCTACCTATGGTGAACGTGTTGTAGCCTTTGCTGCAGTGGAAGGCATTTTCTTTTCCGGTTC
TTTTGCGTCGATATTCTGGCTCAAGAAACGAGGACTGATGCCTGGCCTCACATTTTCTAATGAACTTATT
AGCAGAGATGAGGGTTTACACTGTGATTTTGCTTGCCTGATGTTCAAACACCTGGTACACAAACCATCGG
AGGAGAGAGTAAGAGAAATAATTATCAATGCTGTTCGGATAGAACAGGAGTTCCTCACTGAGGCCTTGCC
TGTGAAGCTCATTGGGATGAATTGCACTCTAATGAAGCAATACATTGAGTTTGTGGCAGACAGACTTATG
CTGGAACTGGGTTTTAGCAAGGTTTTCAGAGTAGAGAACCCATTTGACTTTATGGAGAATATTTCACTGG
AAGGAAAGACTAACTTCTTTGAGAAGAGAGTAGGCGAGTACCAGAGGATGGGAGTGATGTCAAGTCCAAC
AGAGAATTCTTTTACCTTGGATGCTGACTTCTAAATGAACTGAAGATGTGCCCTTACTTGGCTGATTTTT
TTTTTCCATCTCATAAGAAAATCAGCTGAAGTGTTACCAACTAGCCACACCATGAATTGTCCGTAATGT
TCATTAACAGCATCTTTAAAACTGTGTAGCTACCTCACAACCAGTCCTGTCTGTTTATAGTGCTGGTAGT
ATCACCTTTTGCCAGAAGGCCTGGCTGGCTGTGACTTACCATAGCAGTGACAATGGCAGTCTTGGCTTTA
AAGTGAGGGGTGACCCTTTAGTGAGCTTAGCACAGCGGGATTAAACAGTCCTTTAACCAGCACAGCCAGT
TAAAAGATGCAGCCTCACTGCTTCAACGCAGATTTTAATGTTTACTTAAATATAAACCTGGCACTTTACA
AACAAATAAACATTGTTTTGTACTCACGGCGGCGATAATAGCTTGATTTATTTGGTTTCTACACCAAATA
CATTCTCCTGACCACTAATGGGAGCCAATTCACAATTCACTAAGTGACTAAAGTAAGTTAAACTTGTGTA
GACTAAGCATGTAATTTTTAAGTTTTATTTTAATGAATTAAAATATTTGTTAACCAACTTTAAAGTCAGT
CCTGTGTATACCTAGATATTAGTCAGTTGGTGCCAGATAGAAGACAGGTTGTGTTTTATCCTGTGGCTT
GTGTAGTGTCCTGGGATTCTCTGCCCCTCTGAGTAGAGTGTTGTGGGATAAAGGAATCTCTCAGGGCAA
GGAGCTTCTTAAGTTAAATCACTAGAAATTTAGGGGTGATCTGGGCCTTCATATGTGTGAGAAGCCGTTT
CATTTTATTTCTCACTGTATTTTCCTCAACGTCTGGTTGATGAGAAAAAATTCTTGAAGAGTTTTCATAT
GTGGGAGCTAAGGTAGTATTGTAAAATTTCAAGTCATCCTTAAACAAAATGATCCACCTAAGATCTTGCC
```

FIGURE 162 cont'd

CCTGTTAAGTGGTGAAATCAACTAGAGGTGGTTCCTACAAGTTGTTCATTCTAGTTTTGTTTGGTGTAAG
TAGGTTGTGTGAGTTAATTCATTTATATTTACTATGTCTGTTAAATCAGAAATTTTTTATTATCTATGTT
CTTCTAGATTTTACCTGTAGTTCATAAAAAAAAAAAAAAAAAAAAAAAAAA

FIGURE 163
SEQ ID NO: 155
Genbank ID         : NM_003500.1
Unigene ID(#167)   : Hs.9795
Unigene name       :       acyl-Coenzyme A oxidase 2, branched chain ACOX2
>gi|4501868|ref|NM_003500.1| Homo sapiens acyl-Coenzyme A oxidase 2,
branched c
hain (ACOX2), mRNA
GGTTCTTTGCACTGACCAATGCTGAGAGCAGACCCTCGGAGCAGCCGGGTTGGAAGTGTCTCTCCACAGT
CACCAGACAGATCCAGGATAGGATGGGCAGCCCAGTGCACCGAGTGTCATTGGGGGATACCTGGAGCAGG
CAAATGCACCCCGACATAGAGAGCGAGAGGTATATGCAGTCCTTTGACGTGGAACGGCTCACCAACATCC
TTGATGGAGGTGCCCAGAACACTGCACTCCGCAGGAAAGTTGAGAGCATCATCCACAGTTACCCGGAGTT
TAGCTGTAAGGACAATTATTTCATGACCCAGAATGAGCGTTATAAGGCTGCCATGCGGAGGGCATTCCAC
ATCCGGTTGATAGCTCGGCGCCTGGGTTGGTTAGAAGATGGTCGTGAATTAGGCTACGCTTACAGAGCCC
TTTCTGGAGACGTGGCCTTAAATATACACAGAGTCTTCGTGAGAGCCCTCAGGAGCCTGGGCTCAGAGGA
GCAGATTGCCAAATGGGACCCACTCTGCAAAAACATCCAGATCATCGCAACGTATGCACAGACAGAGTTG
GGACATGGGACATATCTTCAGGGCCTGGAGACTGAAGCCACCTATGACGCAGCCACCCAGGAGTTTGTGA
TACACAGCCCCACGCTGACTGCCACCAAATGGTGGCCTGGAGACTTGGGACGGTCAGCCACCCATGCCCT
GGTCCAGGCCCAGCTGATCTGCTCAGGAGCCAGGCGGGGCATGCACGCTTTTATTGTGCCAATCCGGAGT
CTTCAGGACCACACCCCACTGCCAGGAATCATCATTGGGGACATCGGACCCAAGATGGACTTTGATCAAA
CAGACAATGGCTTCCTGCAGCTGAACCATGTGCGGGTCCCCAGGGAGAACATGCTGAGTCGCTTTGCACA
GGTCTTGCCAGATGGCACCTACGTCAAACTCGGTACAGCACAGAGCAACTACCTTCCCATGGTGGTGGTG
CGGGTGGAGCTGCTGTCAGGGGAGATCCTCCCTATACTGCAGAAGGCCTGTGTCATCGCCATGCGCTACT
CGGTCATCCGCCGCCAATCCCGGCTCCGGCCCAGTGACCCAGAGGCAAAGGTCCTGGACTACCAGACACA
ACAGCAGAAACTCTTTCCTCAGCTGGCCATCAGTTATGCCTTCCATTTCCTGGCAGTCAGCCTCTTGGAG
TTCTTCCAGCACTCCTACACTGCCATTCTGAACCAAGACTTCAGCTTCCTGCCTGAGCTCCACGCGCTGA
GCACGGGCATGAAGGCCATGATGTCAGAATTCTGCACCCAGGGAGCTGAGATGTGCCGCAGGGCCTGTGG
CGGACATGGCTACTCAAAGCTGAGTGGCCTGCCATCACTGGTCACCAAATTGTCGGCCTCCTGCACCTAC
GAGGGTGAGAACACAGTGCTCTACCTGCAGGTGGCCAGGTTCCTGGTGAAGAGCTACCTGCAGACTCAGA
TGTCCCCTGGCTCCACGCCACAGAGATCTCTCTCCATCTGTCGCATATCTCACCGCACCTGACCTGGC
CAGGTGTCCAGCCCAGAGGGCAGCCGACTTCCTCTGCCCGGAGCTCTACACCACGGCCTGGGCACATGTG
GCAGTAAGGCTCATAAAGGACTCAGTGCAGCATTTACAGACCCTGACGCAATCCGGAGCTGACCAGCACG
AGGCTTGGAACCAGACCACTGTCATACACCTCCAGGCTGCTAAGGTGCACTGCTACTATGTCACTGTGAA
GGGTTTTACAGAAGCTCTGGAGAAACTAGAAAATGAACCAGCGATTCAGCAGGTGCTCAAGCGCCTCTGT
GACCTCCATGCCATACATGGAATCTTGACTAACTCGGGTGACTTTCTCCATGACGCCTTCCTGTCTGGTG
CCCAAGTGGACATGGCAAGAACAGCCTACCTGGACCTGCTCCGCCTGATCCGGAAGGATGCCATCCTGTT
AACTGATGCTTTTGACTTCACCGATCAGTGTTTAAATTCAGCCCTTGGCTGTTATGATGGAAACGTCTAC
GAACGCCTGTTCCAGTGGGCTCAGAAGTCACCAACCAATACTCAGGAGAACCCTGCCTATGAGGAATATA
TAAGACCACTTTTACAAAGTTGGAGATCCAAGCTATGAAATAACCAACAGTATTCAAGAAGCAACCAGCA
CCATCATGTGATAATGGTACTATGGCATATATGCAACATTAAAATTTTAAATTAG

FIGURE 164
SEQ ID NO: 156
Genbank ID         : AL138410
Unigene ID(#167)   : Hs.282832
Unigene name       :     hypothetical protein LOC255743         LOC255743
>gi|6855091|gb|AL138410.1|AL138410 DKFZp434A1029_s1 434 (synonym: htes3)
Homo s
apiens cDNA clone DKFZp434A1029 3', mRNA sequence
TTTTTTTTTTTTTTTTTTTTTTTTTTTTTTTTTTTTTTTTTTACTAACAGTGTTTTTATTTAC
AAATAATTGTTTTTATTAGGCCATTTGGAAAACCACTAACATTTTTATTTTAGAAAACATTAAATAATA
AACAAGATGTTATACAGTACTTTGGATAACTTCTTCCATCAGTTTAGTGCAATGTATCATTGGCATCGAA
AAGTAAAATTTTCATTTATTTTCCCCTTTCATCTTCAGCTGTGCAGTTATATGACCATAAAGGAAATGAA
CCATTAAAAATGGATCTACAGCCATATATTCTGCCGTTACTCAAAGGCTTAATGATTTATTTTCCCCCTC FIGURE 164 cont'd CAGCCCTGCCTTTACCAGGTTAAATGACAGAAGACCTTCTATTGTACCTATTGTTCAAAAAATATTACTG
TTCTGTGGAACCTGGGAGAGTCCAATTGATAAGAGAAACTGAATCATACTGATGAGGTGAAGGAAAGGTC
TGCCGGTGTGGGGCAGGGCACTCTTTCTCAGCAGCCAAGATAACTTGTCACACACGAAGCAGAGAGAATG
CCCCGATGAAAATCTCTCTGAACTGTGTTCCTTGAAGGATCTCTTAAAAAAAAAA

FIGURE 165
SEQ ID NO: 157
Genbank ID          : AI033582
Unigene ID(#167)    : Hs.372254
Unigene name        :       Transcribed sequences
>gi|3254535|gb|AI033582.1|AI033582                                          ox13b09.x1
Soares_fetal_liver_spleen_1NFLS_S
1 Homo sapiens cDNA clone IMAGE:1656185 3', mRNA sequence
AAACACAGAGAATTTTGTTTTAGCCTGACAAATTTCAAAGAGGCTTTGCAAGTGCAAACAGACTTCAGCT
TTTTCACATTCCTATGCCCAGAAACTGGGACGTGAAAATGCCAGGAACCCTTTCAATAACTAGACTATGT
GATAGATGCAGGAGAAACTCTCCAACCACCAAGATTACTCCTATGGAGCTGCCAAAGAACCAGATGCTTC
CTTCAAAAGCATATCAATTTGGCGGTGAAAAACCCTGTGGCCTCAGCTCCAGTCGGGAAGGGCAGGTGGG
ATGGCATGGTGCAGGATGCCTGTTCCACTTGCCTCAGCAACCATCTTCTTCTGACAGCAAAACTGTGTT
ACTCCCAGGCTTGAAGGCATGAGCAAAATACATGGCTTTGCTATATATAAGGACGGGACTTGGAAATATT
TGGTCTGAGGCCATGCAAAATGAATTC

FIGURE 166
SEQ ID NO: 158
Genbank ID          : NM_014057.1
Unigene ID(#167)    : Hs.109439
Unigene name        :       osteoglycin (osteoinductive factor, mimecan)     OGN
>gi|7661703|ref|NM_014057.1|  Homo   sapiens   osteoglycin   (osteoinductive
factor, m
imecan) (OGN), mRNA
GAGAGTTTTGTCCCACAGTCAGCAGGCCACTAGTTTATTAACTTCCAGTCACCTTGATTTTTGCTAAAAT
GAAGACTCTGCAGTCTACACTTCTCCTGTTACTGCTTGTGCCTCTGATAAAGCCAGCACCACCAACCCAG
CAGGACTCACGCATTATCTATGATTATGGAACAGATAATTTTGAAGAATCCATATTTAGCCAAGATTATG
AGGATAAATACCTGGATGGAAAAAATATTAAGGAAAAGAAACTGTGATAATACCCAATGAGAAAGTCT
TCAATTACAAAAGATGAGGCAATAACACCATTACCTCCCAAGAAAGAAAATGATGAAATGCCCACGTGT
CTGCTGTGTGTTTGTTTAAGTGGCTCTGTATACTGTGAAGAAGTTGACATTGATGCTGTACCACCCTTAC
CAAAGGAATCAGCCTATCTTTACGCACGATTCAACAAAATTAAAAAGCTGACTGCCAAAGATTTTGCAGA
CATACCTAACTTAAGAAGACTCGATTTTACAGGAAATTTGATAGAAGATATAGAAGATGGTACTTTTTCA
AAACTTTCTCTGTTAGAAGAACTTTCACTTGCTGAAAATCAACTACTAAAACTTCCAGTTCTTCCTCCCA
AGCTCACTTTATTTAATGCAAAATACAACAAAATCAAGAGTAGGGGAATCAAAGCAAATGCATTCAAAAA
ACTGAATAACCTCACCTTCCTCTACTTGGACCATAATGCCCTGGAATCCGTGCCTCTTAATTTACCAGAA
AGTCTACGTGTAATTCATCTTCAGTTCAACAACATAGCTTCAATTACAGATGACACATTCTGCAAGGCTA
ATGACACCAGTTACATCCGGGACCGCATTGAAGAGATACGCCTGGAGGGCAATCCAATCGTCCTGGGAAA
GCATCCAAACAGTTTTATTTGCTTAAAAAGATTACCGATAGGGTCATACTTTTAACCTCTATTGGTACAA
CATATAAATGAAAGTACACCTACACTAATAGTCTGTCTCAACAATGAGTAAAGGAACTTAAGTATTGGTT
TAATATTAACCTTGTATCTCATTTTGAAGGAATTTAATATTTTAAGCAAGGATGTTCAAAATCTTACATA
TAATAAGTAAAAAGTAAGACTGAATGTCTACGTTCGAAACAAAGTAATATGAAAATATTTAAACAGCATT
ACAAAATCCTAGTTTTATACTAGACTACCATTTAAAAATCATGTTTTTATATAAATGCCCAAATTTGAGAT
GCATTATTCCTATTACTAATGATGTAAGTACGAGGATAAATCCAAGAAACTTTCAACTCTTTGCCTTTCC
TGGCCTTTACTGGATCCCAAAAGCATTTAAGGTACATGTTCCAAAAACTTTGAAAAGCTAAATGTTTCCC
ATGATCGCTCATTCTTCTTTTATGATTCATACGTTATTCCTTATAAAGTAAGAACTTTGTTTTCCTCCTA
TCAAGGCAGCTATTTTATTAAATTTTTCACTTAGTCTGAGAAATAGCAGATAGTCTCATATTTAGGAAAA
CTTTCCAAATAAAATAAATGTTATTCTCTGATAAAGAGCTAATACAGAAATGTTCAAGTTATTTTACTTT
CTGGTAATGTCTTCAGTAAAATATTTTCTTTATCTAAATATTAACATTCTAAGTCTACCAAAAAAAGTTT
TAAACTCAAGCAGGCCAAAACCAATATGCTTATAAGAAATAATGAAAAGTTCATCCATTTCTGATAAAGT
TCTCTATGGCAAAGTCTTTCAAATACGAGATAACTGCAAAATATTTTCCTTTTATACTACAGAAATGAGA
ATCTCATCAATAAATTAGTTCAAGCATAAGATGAAAACAGAATATTCTGTGGTGCCAGTGCACACTACCT
TCCCACCCATACACATCCATGTTCACTGTAACAAACTGAATATTCACAATAAAGCTTCTGAGTAACACTT
TCTGATTACTCATGATAAAAAAAAAAAAAAAAAGG

FIGURE 167
SEQ ID NO: 159
Genbank ID       : NM_018014.1
Unigene ID(#167) : Hs.314623
Unigene name     :     B-cell    CLL/lymphoma    11A    (zinc    finger    protein)
     BCL11A
>gi|8922264|ref|NM_018014.1|  Homo  sapiens  B-cell  CLL/lymphoma  11A  (zinc finger
protein) (BCL11A), mRNA
GCATCAAGCTCGAGAAGGAGTTCGACCTGCCCCCGGCCGCGATGCCCAACACGGAGAACGTGTACTCGCA
GTGGCTCGCCGGCTACGCGGCCTCCAGGCAGCTCAAAGATCCCTTCCTTAGCTTCGGAGACTCCAGACAA
TCGCCTTTTGCCTCCTCGTCGGAGCACTCCTCGGAGAACGGGAGCTTGCGCTTCTCCACACCGCCCGGGG
AGCTGGACGGAGGGATCTCGGGGCGCAGCGGCACGGGAAGTGGAGGGAGCACGCCCCATATTAGTGGTCC
GGGCCCGGGCAGGCCCAGCTCAAAAGAGGGCAGACGCAGCGACACTTGTGAGTACTGTGGGAAAGTCTTC
AAGAACTGTAGCAATCTCACTGTCCACAGGAGAAGCCACACGGGCGAAAGGCCTTATAAATGCGAGCTGT
GCAACTATGCCTGTGCCCAGAGTAGCAAGCTCACCAGGCACATGAAAACGCATGGCCAGGTGGGGAAGGA
CGTTTACAAATGTGAAATTTGTAAGATGCCTTTTAGCGTGTACAGTACCCTGGAGAAACACATGAAAAAA
TGGCACAGTGATCGAGTGTTGAATAATGATATAAAAACTGAATAGAGGTATATTAATACCCCTCCCTCAC
TCCCACCTGACACCCCCTTTTTCACCACTCCCCTTCCCCATCGCCCTCCAGCCCCACTCCCTGTAGGATT
TTTTCTAGTCCCATGTGATTTAAACAAACAAACAAACAAACAGAAGTAACGAAGCTAAGAATATGAGAG
TGCTTGTCACCAGCACACCTGTTTTTTTTCTTTTTCTTTTTCTTTTTTCTTTTTCCTTTTTTTTTTTCT
TTTCCTTTATGTTCTCACCGTTTGAATGCATGATCTGTACGGGGCAATACTATTGCATTTTACGCAAACT
TTGAGCCTTTCTCTTGTGCAATAATTTACATGTTGTGTATGTTTTTTTTTAAACTTAGACAGCATGTATG
GTATGTTATGGCTATTTTAAATTGTCCCTAATTCGTTGCTGAGCAAACATGTTGCTGTTTCCAGTTCCGT
TCTGAGAGAAAAGAGAGAGAGAGAGAAAAAGACCATGCTGCATACATTCTGTAATACATATCATGTACA
GTTTTATTTTATAACGTGAGGAGGAAAAACAGTCTTTGGATTAACCCTCTATAGACAGAATAGATAGCAC
TGAAAAAAAATCTCTATGAGCTAAATGTCTGTCTCTAAAGGGTTAAATGTATCAATTGGAAAGGAAGAAA
AAAGGCCTTGAATTGACAAATTAACAGAAAAACAGAACAAGTTTATTCTATCATTTGGTTTTAAAATATG
AGTGCCTTGGATCTATTAAAACCACATCGATGGTTCTTTCTACTTGTTATAAACTTGTAGCTTAATTCAG
CATTGGGTGAGGTAATAAACCTTAGGAACTAGCATATAATTCTATATTGTATTTCTCACAACAATGGCTA
CCTAAAAAGATGACCCATTATGTCCTAGTTAATCATCATTTTTCCTTTAGTTTAATTTTATAAACAAAAC
TGATTATACCAGTATAAAAGCTACTTTGCTCCTGGTGAGAGCTTAAAAGAAATGGGCTGTTTTGCCCAAA
GTTTTATTTTTTTTAAACAATGATTAAATTGAATGTGTAATGTGCAAAAGCCCTGGAACGCAATTAAAT
ACACTAGTAAGGAGTTCATTTTATGAAGATATTTGCTTTAATAATGCCTTTTTAAAAATACTGGCACCAA
AAGAAATAGATCCAGATCTACTTGGTTGTCAAGTGGACAATCAAATGATAAACTTTAAGACCTTGTATAC
CATATTGAAAGGAAGAGGCTGACAATAAGGTTTGACAGAGGGGAACAGAAGAAAATAATATGATTTATTA
GCACAACGTGGTACTATTTGCCATTTAAAACTAGAACAGGTATATAAGCTAATATTGATACAATGATGAT
TAACTATGAATTCTTAAGACTTGCATTTAAATGTGACATTCTTAAAAAAAGAAGAGAAAGAATTTTAAGA
GTAGCAGTATATATGTCTGTGCTCCCTAAAAGTTGTACTTCATTTCTTTTCCATACACTGTGTGCTATTT
GTGTTAACATGGAAGAGGATTCATTGTTTTTATTTTTATTTTTTAATTTTTTCTTTTTTATTAAGCTAG
CATCTGCCCCAGTTGGTGTTCAAATAGCACTTGACTCTGCCTGTGATATCTGTATCTTTTCTCTAATCAG
AGATACAGAGGTTGAGTATAAAATAAACCTGCTCAGATAGGACAATTAAGTGCACTGTACAATTTTCCCA
GTTTACAGGTCTATACTTAAGGGAAAAGTTGCAAGAATGCTGAAAAAAAAATTGAACACAATCTCATTGAG
GAGCATTTTTTAAAAACT

FIGURE 168
SEQ ID NO: 160
Genbank ID       : AL043927
Unigene ID(#167) : Hs.169910
Unigene name     :     KIAA0173 gene product    KIAA0173
>gi|5935917|gb|AL043927.2|AL043927  DKFZp434F1028_s1  434  (synonym: htes3) Homo s
apiens cDNA clone DKFZp434F1028 3', mRNA sequence
GNTGANTTCGAANGCCCCAAACCTGCTTTATAAGGCTGCGTGGCCCCACTGGCTTCTCTGCTGAGATATG
AGGTGCCAGCCAGGCAGACAGGTGACAGAGGGTGACCCTTCCTCACCTTCTCCCCATCACTACCATCCCT
CCGGCCCTACAAATACCCATCTCTATAATGCAACCACTTCAAAAAATACTCTGAGGAGGGACAGGGTGAA
AGGGGTAGGGGGTCAGACTGGTCTGAACAGCAGGCTGGTTCCCGTGAGGTAGCTGATGCCCATGCTCCTG

FIGURE 168 cont'd

```
GGCAGAGGCTTTTGGAGAGAGGCCAGTTATGGGCTCACAGCCAGGAGGGAGTCACTGATTGACTGGAAAG
TGGAGGAAGCAGAAAGTCTTGAAGTCTGCCCAGAGCACTTGATCACAGGTAACGTCTGGGTAGAAAGGCT
GGGCTCTTTGCTGGTGTCCTCACTGTCCTTTGAGGAACTGGGTTTCTGGGGATAAGGGGAAAGGCCAGCT
TGAGTCTTCTTGGATTTGGGCGTGGTCCCGTCTTCAGAGAGTAGTAGGCTAACCTCACAGGAGCTTTGTT
TTCCCAGCTTGCTAGTCTCTGATTTGCTGAAGGCATTGAGTATCACGTCATCCTTTGAGATAGTCANAAA
GTGATGTCCGGGAGAGACCCACACTGGAGCAGAATCAGAAGACAACTCCCATGTGGGAAACCCTTTTGTA
GCACCAACTTCCGGGAGCAGATCTACTCCTTTAAGCTTGTTGGCCATGGGNATTTTCTGNTTCCCATTTG
GGTNGGG
```

FIGURE 169
SEQ ID NO: 161
Genbank ID       : NM_003787.1
Unigene ID(#167) : Hs.23567
Unigene name     :        nucleolar protein 4     NOL4
>gi|4505420|ref|NM_003787.1| Homo sapiens nucleolar protein 4 (NOL4), mRNA
```
CCCACGCGTCCGGATGGTCCTGGTCACAAAATATTAAAGAGACCGACCGCTAAGGGAACAGGAAAAACGT
CCGAGACAGCCGTTGCAATTACGAATGGACCAGACTTGGTAGCACGGGGCATTGATTGCTGGTGCCCAAC
CGGACCCTCCTCCCCTCTTCCCATCCCTTCCCCCACCCAAAGCAGGCTCCCGCTGCGGCCGGGACCTCGC
ATCCCTGCAACGTGGCCGGGGCTGCATTTTTCATGAGCCTAGGGTGAACAGGTGCGAAGTGCGCTGGGAG
CATCCGGCCAGCGGCCGAGCGCGGGGAACATGGAGAGCGAGCGCGACATGTACCGCCAGTTCCAGGACTG
GTGCCTCAGGACTTACGGGGACTCAGGCAAGACCAAGACGGTGACCCGTAAAAAATACGAACGGATCGTC
TAGCTCCTCAATGGCTCCGAGTCGAGCTCCACGGACAACGCCAAATTTAAATTCTGGGTCAAATCGAAGG
GCTTCCAGCTGGGCCAGCCGGACGAGGTCCGCGGGGAGGCGGCGGCGCCAAGCAAGTGCTCTAGTGCCT
GTCAAGACCACGGATGGCGTAGGGGTAGATGAGAAGCTATCTTTACGACGGGTAGCTGTGGTTGAAGATT
TCTTTGACATTATTTATTCGATGCATGTGGAAACGGGGCCAAATGGAGAACAAATTCGGAAACACGCTGG
ACAAAAGAGAACTTACAAAGCAATTTCAGAGAGCTATGCCTTCCTACCAAGAGAAGCGGTGACACGATTT
CTAATGAGCTGCTCAGAGTGCCAGAAAAGAATGCATTTAAACCCAGATGGAACAGATCATAAAGATAATG
GAAAACCTCCCACTTTGGTGACCAGCATGATTGACTACAACATGCCAATTACCATGGCCTACATGAAACA
CATGAAGCTGCAGCTGCTAAACTCACAGCAAGATGAGGATGAAAGTTCAATAGAAAGTGATGAATTTGAC
ATGAGTGATTCAACACGGATGTCAGCTGTGAACTCTGATCTTAGCTCCAATCTTGAAGAAAGAATGCAAA
GTCCCCAGAATCTTCATGGCTCAGCAAGATGATGATTCTGCTCAGAGAGCTTTAATGGCAATGAGACTCT
GGGGCACAGTTCAATTGCTTCAGGGGGAACACACAGCAGGGAGATGGGAGACTCCAACAGTGATGGCAAA
ACTGGGCTGGAGCAAGATGAACAGCCACTGAACCTGAGTGACAGTCCCCTCTCTGCGCAGCTAACTTCGG
AATACAGAATAGATGATCACAACAGTAATGGGAAAAACAAGTATAAGAATCTTCTAATTTCTGACCTCAA
GATGGAACGAGAGGCGAGAGAAAATGGAAGCAAGTCTCCTGCACATAGTTACTCCAGCTATGACTCTGGC
AAAAATGAGAGTGTAGACCGAGGAGCTGAGGACCTCTCACTAAACAGGGGAGATGAGGACGAAGATGACC
ACGAGGACCATGACGATTCGGAGAAAGTTAATGAGACAGACGGCGTTGAAGCCGAGCGGCTGAAAGCTTT
TAATATGTTTGTCAGGCTGTTTGTAGATGAAAACTTGGACCGAATGGTCCCAATCTCTAAGCAGCCCAAA
GAAAAGATCCAGGCTATCATTGACTCATGCAGGCGACAATTCCCTGAGTATCAAGAGCGTGCCAGAAAAC
GTATACGTACTTACCTCAAGTCCTGCAGGCGGATGAAAAGAAGTGGTTTTGAGATGTCTCGACCTATTCC
TTCCCACCTTACTTCAGCAGTTGCAGAGAGTATCTTGGCTTCAGCTTGTGAGAGTGAGAGTAGAAATGCC
GCCAAGAGGATGCGTCTGGAGAGACAGCAGGATGAGTCTGCTCCAGCTGACAAACAGTGTAAACCAGAGG
CGACCCAGGCCACTTACTCAACATCAGCTGTTCCAGGCTCACAGGACGTGCTGTACATCAATGGAAATGG
GACCTATAGTTACCATAGTTACAGAGGGCTAGGAGGGGGTCTGCTAAATCTGAATGATGCTTCCAGCAGT
GGACCCACTGATCTCAGCATGAAGAGACAATTGGCGACTAGCTCAGGATCCTCCAGCAGCTCAAACTCCA
GACCCCAGCTGAGTCCAACTGAAATCAATGCCGTGAGACAGCTTGTTGCAGGATATCGAGAATCAGCTGC
ATTTTTATTGCGATCTGCAGATGAACTGGAAAATCTCATTTTACAACAGAACTGAGACAGACGACCACCA
TATTCACTGAGGTCTAAATTTGCAGTTCCACTAATGACATTTTGATTTCCCAACAGAGATACTTCTGGTC
TTACTGCACAGTCTTTTAAGAGAAATACTTCCATTATGCCACATTGTCCTTGATCCGTAAGTGATGTGTT
AAGGTGCTTCAAAGGAACTCTGACCTCTGAAGTACTTGAGCTACTTTAGTATGTCCAGCCTATTGCTTTT
TGTTTTAGTGTGTCACCATAAATATCAGGGGCATAAAAGGCTATCTATTCTTAATTCAAGGATAAAACAG
AAGAAGCTTGTGGTATAAAACAATAGTTCAAGATCCAGCTGAAATATTAGTGGAATTTGCTACTGACTCA
TTGGACTGAAAGCTGAAGTACCTGGCAAAAAAAA
```

FIGURE 170
SEQ ID NO: 162
Genbank ID       : NM_018276.1
Unigene ID(#167) : Hs.29173

FIGURE 170 Cont'd

Unigene name        :       slingshot 3 SSH-3
>gi|8922776|ref|NM_018276.1| Homo sapiens slingshot 3 (SSH-3), mRNA
TGTCCTGCGGGTCCAGGACTGTCCGCGGGGTTGAGGGAAGGGGCCGTGCCCGGTGCCAGCCCAGGTGCTC
GCGGCCTGGCTCCATGGCCCTGGTCACAGTGAGCCGTTCGCCCCCGGGCAGCGGCGCCTCCACGCCCGTG
GGGCCCTGGGACCAGGCGGTCCAGCGAAGGAGTCGACTCCAGCGAAGGCAGAGCTTTGCGGTGCTCCGTG
GGGCTGTCCTGGGACTGCAGGATGGAGGGGACAATGATGATGCAGCAGAGGCCAGTTCTGAGCCAACAGC
ACCCTAGTTTCATTCTCAACTCTAGCCCTGCACACTCACCTATGGCCCGGGAGATTGACAACTTCTACCC
TGAGCGCTTCACCTACCACAATGTGCGCCTCTGGGATGAGGAGTCGGCCCAGCTGCTGCCGCACTGGAAG
GAGACGCACCGCTTCATTGAGGCTGCAAGAGCACAGGGCACCCACGTGCTGGTCCACTGCAAGATGGGCG
TCAGCCGCTCAGCGGCCACAGTGCTGGCCTATGCCATGAAGCAGTACAATGCAGCCTGGAGCAGGCCCT
GCGCCACGTGCAGGAGCTCCGGCCCATCGCCCGCCCCAACCCTGGCTTCCTGCGCCAGCTGCAGATCTAC
CAGGGCATCCTGACGGCCAGAACCTGAGGGTGGTGGGGAGGAGAAGGTTGTAGGCATGGAAGAGAGCCAG
GCAGCCCCGAAAGAAGAGCCTGGGCCACGGCCACGTATAAACCTCCGAGGGGTCATGAGGTCCATCAGTC
TTCTGGAGCCCTCCTTGGAGCTGGAGAGCACCTCAGAGACCAGTGACATGCCAGAGGTCTTCTCTTCCCA
CGAGTCTTCACATGAAGAGCCTCTGCAGCCCTTCCCACAGCTTGCAAGGACCAAGGGAGGCCAGCAGGTG
GACAGGGGGCCTCAGCCTGCCCTGAAGTCCCGCCAGTCAGTGGTTACCCTCCAGGGCAGTGCCGTGGTGG
CCAACCGGACCCAGGCCTTCCAGGAGCAGGAGCAGGGGCAGGGGCAGGGGAGAGCCCTGCATTTC
CTCTACGCCCAGGTTCCGGAAGGTGGTGAGACAGGCCAGCGTGCATGACAGTGGAGAGGAGGGCGAGGCC
TGAGCCCTCACACATGCCCACGCTCCCTGACACTGAAGAGGATCCACAACTCCTTGGAGAAACACCCTC
ACGTCTGTTGCCGCACACATTCCTCTCAGCTCCGCCCCATACCCGTCACTACAGCCTCACCTCCCACCCC
TGTCACTACGGCCTCACCTCCCACCCCTGTCACTACAGCCTCACCTCCTACAGCCTTAAGTCCCAGGCCC
ATGTCTGCCTGTCCAAGGGCTCAAGACTTTCTAACTGGGATGTGGTAGAGGGACTGAAGGTACCTTTGGG
GGCAACAGCACCCTAGTTTCATTCTCAACTCTAGCCCTGCACCTCCTGTCCTCTCCCAGTTCATTCCTGG
AACCAGCCAGGCCAGGCAACCAGTGGCCCCAAAGGCAGGCAGGATCCTCAGGCCCCAGCCGCGGGAGGC
TGGAAGGGCTGGCAGATCGCTTCCCTCATCCACCTCCACCGGTCCAGGTCTTTGCTGCTGTCCCCAGACC
TCCTGTGACACCACGCCAGATCACAGGGCACCAGGCCAGAGATAGTCTTCTTTTTGTCCTTTCTGGCCTC
TGGCTAGTCAGTTTTTCATAGCCTTACAGTATCTGGCTTTGTACTGAGAAATAAAACACATTTTCATATT
TGGTT

FIGURE 171
SEQ ID NO: 163
Genbank ID        : BE271470
Unigene ID(#167)  : acc_BE271470
Unigene name      :
>gi|9145273|gb|BE271470.1|BE271470 601140646F1 NIH_MGC_9 Homo sapiens cDNA clon
e IMAGE:3049883 5', mRNA sequence
TGACAGCATGCCTGAACCAGCTAAGTCAGCTCCTGCTCCGAAGAAGGGTTCCAAGAAGGCTGTGACCAAG
GCGCAGAAGAAGGATGGCAAGAAGCGCAAGCGCAGTCGTAAGGAGAGCTACTCCGTGTATGTGTACAAGG
TGCTAAAACAGGTTCACCCCGATACTGGCATCTCATCCAAGGCCATGGGCATCATGAATTCCTTCGTTAA
CGACATCTTCGAACGCATCCCAGGCGAGGCTTCCCGTCTGGCCCACTACAACAAGCGCTCGACCATTACC
TCCAGGGAGATCCAGACCGCCGTGCGTCTGCTGCTTCCCGGAGAGCTGGCCAAGCACGCAGTGTCCGAAG
GTACCAAGGCTGTCACCAAGTATACAAGCTCCAAGTAAATGTGTGCTTAGGTGCTCTTACACTCCACGGC
TCTTCTTCACAGCCACCTCACGTCTCACCCTCAAGACGCTTCCCTCTCCGCCTTCTCACCGTTCTCTCGC
GGAATACTTTTTCCGCATTTCGTACTCCCAGCACTTCTGGCGAGGCGAGGCGTGCGGATCGACGACCTGT
TCGGCTAACGCGGCTACTCTCGCTTCTACTACCCCTACCACTCTCGCCGGGCCGTGGGGCCGTCGCGTGT
CTTCCACACCTCGGGTGCTGCGCCGAATCCCCTACCTGCCCGCTCGGTCCGTGCCCCTGCGCCTCGTC

FIGURE 172
SEQ ID NO: 164
Genbank ID        : AI859620
Unigene ID(#167)  : Hs.437023
Unigene name      :       interleukin 4 induced 1 IL4I1
>gi|5513236|gb|AI859620.1|AI859620 wm14d08.x1 NCI_CGAP_Ut4 Homo sapiens cDNA cl
one IMAGE:2435919 3' similar to SW:FIG1_MOUSE O09046 FIG-1 PROTEIN PRECURSOR. ;
, mRNA sequence

FIGURE 172 Cont'd

CCGAAAATACTTTAATGCGAGGTCCTCGTGTGGGTCGTGTTTTGGAGAGATAACTGGCCTTGGACTGGAG
GGTGGCTGCCTTCTTCCTTTGCCAGGTCATGCGAGGGGCTGCTGGCCACCCCATGCACATGCCCCTGCCC
CTCCATGTCAGATGCGTGCCCCTCGGGGCTGGCCGTGTCCGATGCAGGCCCCTTCCGGCTGTTGATCTTG
ATGGCGGCGCGCAGCGCCGACTTGACCGCCGTCTCCACCCAGCCGTGCGGGTAGGCGGTGTGCTCGCCGG
CAAAGTAGATGCGGCCATAAGGGACCGTCCAGTCATCCTTTTCGGTTTGCCAGAGCGCCGGCGGCTGTAC
CACAAAGCCACCCTGGCTGTGCTGGTCCTCCGCCCAACGCTTGACGACGCCGGTGCCGTCCCAGAGCTGG
CGCACGACAGGCCCGTGCAATGCCGCCACGTCGTCGAGCGCCAAGCGCAACGCCTCTTCCCGGCTCAAGC
CGGCGAACGCTTGCCGCGCGTNCGACCACGTGTACGAGGCCAGCAGCAGCGCGCCCTCGCGCGGCGGCGG
GTAGAAAATCATGCGCGACGGGCGATCGGTGTTGAGTGGCCGNCTTTTCATGTGCTCTCGCGCCAGAAGG
GCCTGCGGAAGCTTANGAACAACCTTTGTGGCCCGCACGTAGTGCAGCCTTCGCAGCGC

FIGURE 173
SEQ ID NO: 165
Genbank ID       : NM_002411.1 FIGURE 170 Cont'd
Unigene ID(#167) : Hs.46452
Unigene name     :       secretoglobin, family 2A, member 2   SCGB2A2
>gi|4505168|ref|NM_002411.1| Homo sapiens secretoglobin, family 2A, member 2 (S
CGB2A2), mRNA
GACAGCGGCTTCCTTGATCCTTGCCACCCGCGACTGAACACCGACAGCAGCAGCCTCACCATGAAGTTGC
TGATGGTCCTCATGCTGGCGGCCCTCTCCCAGCACTGCTACGCAGGCTCTGGCTGCCCCTTATTGGAGAA
TGTGATTTCCAAGACAATCAATCCACAAGTGTCTAAGACTGAATACAAAGAACTTCTTCAAGAGTTCATA
GACGACAATGCCACTACAAATGCCATAGATGAATTGAAGGAATGTTTTCTTAACCAAACGGATGAAACTC
TGAGCAATGTTGAGGTGTTTATGCAATTAATATATGACAGCAGTCTTTGTGATTTATTTTAACTTTCTGC
AAGACCTTTGGCTCACAGAACTGCAGGGTATGGTGAGAAACCAACTACGGATTGCTGCAAACCACACCTT
CTCTTTCTTATGTCTTTTTACTACAAACTACAAGACAATTGTTGAAACCTGCTATACATGTTTATTTTAA
TAAATTGATGGCA

FIGURE 174
SEQ ID NO: 166
Genbank ID       : AF083108.2
Unigene ID(#167) : Hs.511950
Unigene name     :       sirtuin (silent mating type information regulation
2 homolog) 3 (S. cerevisiae)   SIRT3
>gi|13259626|gb|AF083108.2|AF083108 Homo sapiens sirtuin type 3 (SIRT3) mRNA, c
omplete cds
GGCGCCGGGGGCGGGGGTGGGAGGCGGAGGCGGGGCCGGGGCGCCGCGGGCGGGGCGCCGGGGCGGGGC
GAGTCCGGAGGACTCCTCGGACTGCGCGGAACATGGCGTTCTGGGGTTGGCGCGCCGCGGCAGCCCTCCG
GCTGTGGGGCCGGGTAGTTGAACGGGTCGAGGCCGGGGAGGCGTGGGGCCGTTTCAGGCCTGCGGCTGT
CGGCTGGTGCTTGGCGGCAGGGACGATGTGAGTGCGGGCTGAGAGGCAGCCATGGGCCCGCGGTGAGC
CCTTGGACCCGGCGCGCCCCTTGCAGAGGCCTCCCAGACCCGAGGTGCCCAGGGCATTCCGGAGGCAGCC
GAGGGCAGCAGCTCCCAGTTTCTTCTTTTCGAGTATTAAAGGTGGAAGAAGGTCCATATCTTTTTCTGTG
GGTGCTTCAAGTGTTGTTGGAAGTGGAGGCAGCAGTGACAAGGGGAAGCTTTCCCTGCAGGATGTAGCTG
AGCTGATTCGGGCCAGAGCCTGCCAGAGGGTGGTGGTCATGGTGGGGGCCGGCATCAGCACACCCAGTGG
CATTCCAGACTTCAGATCGCCGGGGAGTGGCCTGTACAGCAACCTCCAGCAGTACGATCTCCCGTACCCC
GAGGCCATTTTTTGAACTCCCATTCTTCTTTTCACAACCCCAAGCCCTTTTTCACTTTGGCCAAGGAGCTGT
ACCCTGGAAACTACAAGCCCAACGTCACTCACTACTTTCTCCGGCTGCTTCATGACAAGGGGCTGCTTCT
GCGGCTCTACACGCAGAACATCGATGGGCTTGAGAGAGTGTCGGGCATCCCTGCCTCAAAGCTGGTTGAA
GCTCATGGAACCTTTGCCTCTGCCACCTGCACAGTCTGCCAAAGACCCTTCCCAGGGGAGGACATTCGGG
CTGACGTGATGGCAGACAGGGTTCCCCGCTGCCCGGTCTGCACCGGCGTTGTGAAGCCCGACATTGTGTT
CTTTGGGGAGCCGCTGCCCCAGAGGTTCTTGCTGCATGTGGTTGATTTCCCCATGGCAGATCTGCTGCTC
ATCCTTGGGACCTCCCTGGAGGTGGAGCCTTTTGCCAGCTTGACCGAGGCCGTGCGGAGCTCAGTTCCCC
GACTGCTCATCAACCGGGACTTGGTGGGGCCCTTGGCTTGGCATCCTCGCAGCAGGGACGTGGCCCAGCT
GGGGGACGTGGTTCACGGCGTGGAAAGCCTAGTGGAGCTTCTGGGCTGGACAGAAGAGATGCGGGACCTT
GTGCAGCGGGAAACTGGGAAGCTTGATGGACCAGACAAATAGGATGATGGCTGCCCCACACAATAAATG
GTAACATAGGAGACATCCACATCCCAATTCTGACAAGACCTCATGCCTGAAGACAGCTTGGGCAGGTGAA
ACCAGAATATGTGAACTGAGTGGACACCCGAGGCTGCCACTGGAATGTCTTCTCAGGCCATGAGCTGCAG FIGURE 174 Cont'd TGACTGGTAGGGCTGTGTTTACAGTCAGGGCCACCCCGTCACATATACAAAGGAGCTGCCTGCCTGTTTG
CTGTGTTGAACTCTTCACTCTGCTGAAGCTCCTAATGGAAAAAGCTTTCTTCTGACTGTGACCCTCTTGA
ACTGAATCAGACCAACTGGAATCCCAGACCGAGTCTGCTTTCTGTGCCTAGTTGAACGGCAAGCTCGGCA
TCTGTTGGTTACAAGATCCAGACTTGGGCCGAGCGGTCCCCAGCCCTCTTCATGTTCCGAAGTGTAGTCT
TGAGGCCCTGGTGCCGCACTTCTAGCATGTTGGTCTCCTTTAGTGGGGCTATTTTTAATGAGAGAAAATC
TGTTCTTTCCAGCATGAAATACATTTAGTCTCCTCAAAAAAAAAAAACA

FIGURE 175
SEQ ID NO: 167
Genbank ID       : NM_031217.1
Unigene ID(#167) : Hs.301052
Unigene name     :         kinesin family member 18A    DKFZP434G222
>gi|13654289|ref|NM_031217.1|   Homo    sapiens    hypothetical    protein
DKFZp434G2226 (
DKFZP434G2226), mRNA
CTGAAGCGCTGGGAGGCGGACATTAAAGTGAAGTGGTTGCGGTAACCTGGCCTGGGCCTGAAGTGAGTGA
GAGGCACATGAAGAGAAGTATTCAAGTATTTATACAGATAGGAATCAAGATAATCAACAATGTCTGTCAC
TGAGGAAGACCTGTGCCACCATATGAAAGTAGTAGTTCGTGTACGTCCGGAAAACACTAAAGAAAAAGCA
GCTGGATTTCATAAAGTGGTTCATGTTGTGGATAAACATATCCTAGTTTTTGATCCCAAACAAGAAGAAG
TCAGTTTTTTCCATGGAAAGAAAACTACAAATCAAAATGTTATAAAGAAACAAATAAGGATCTTAAATT
TGTATTTGATGCTGTTTTTGATGAAACGTCAACTCAGTCAGAAGTTTTTGAACACACTACTAAGCCAATT
CTTCCTAGTTTTTTGAATGGATATAATTGCACAGTACTTGCCTATGGTGCCACTGGTGCTGGGAAGACCC
ACACTATGCTAGGATCAGCTGATGAACCTGGAGTGATGTATCTAACAATGTTACACCTTTACAAATGCAT
GGATGAGATTAAAGAAGAGAAAATATGTAGTACTGCAGTTTCATATCTGGAGGTATATAATGAACAGATT
CGTGATCTCTTAGTAAATTCAGGGCCACTTGCTGTCCGGGAAGATACCCAAAAAGGGGTGGTCGTTCATG
GACTTACTTTACACCAGCCCAAATCCTCAGAAGAAATTTTACATTTATTGGATAATGGAAACAAAAACAG
GACACAACATCCCACTGATATGAATGCCACATCTTCTCGTTCTCATGCTGTTTTCCAAATTTACTTGCAA
CAACAAGACAAAACAGCAAGTATCAATCAAAATGTCCGTATTGCCAAGATGTCACTCATTGACCTGGCAG
GATCTGAGCGAGCAAGTACTTCCGGTGCTAAGGGGACCCGATTTGTAGAAGGCACAAATATTAATAGATC
ACTTTTAGCTCTTGGGAATGTCATCAATGCCTTAGCAGATTCAAAGAGAAAGAATCAGCATATCCCTTAC
AGAAATAGTAAGCTTACTCGCTTGTTAAAGGATTCTCTTGGAGGAAACTGTCAAACTATAATGATAGCTG
CTGTTAGTCCTTCCTCTGTATTCTACGATGACACATATAACACTCTTAAGTATGCTAACCGGGCAAGGA
CATTAAATCTTCTTTGAAGAGCAATGTTCTTAATGTCAATAATCATATAACTCAATATGTAAAGATCTGT
AATGAGCAGAAGGCAGAGATTTTATTGTTAAAAGAAAAACTAAAAGCCTATGAAGAACAGAAAGCCTTCA
CTAATGAAAATGACCAAGCAAAGTTAATGATTTCAAACCCTCAGGAAAAAGAAATCGAAAGGTTTCAAGA
AATCCTGAACTGCTTGTTCCAGAATCGAGAAGAAATTAGACAAGAATATCTGAAGTTGGAAATGTTACTT
AAAGAAAATGAACTTAAATCATTCTACCAACAACAGTGCCATAAACAAATAGAAATGATGTGTTCTGAAG
ACAAAGTAGAAAAGGCCACTGGAAAACGAGATCATAGACTTGCAATGTTGAAAACTCGTCGCTCCTACCT
GGAGAAAAGGAGGGAGGAGGAATTGAAGCAATTTGATGAGAATACTAATTGGCTCCATCGTGTCGAAAAA
GAAATGGGACTCTTAAGTCAAAACGGTCATATTCCAAAGGAACTCAAGAAAGATCTTCATTGTCACCATT
TGCACCTCCAGAACAAAGATTTGAAAGCACAAATTAGACATATGATGGATCTAGCTTGTCTTCAGGAACA
GCAACACAGGCAGACTGAAGCAGTATTGAATGCTTTACTTCCAACCCTAAGAAAACAATATTGCACATTA
AAAGAAGCCGGCCTGTCAAATGCTGCTTTTGAATCTGACTTCAAAGAGATCGAACATTTGGTAGAGAGGA
AAAAAGTGGTAGTTTGGGCTGACCAAACTGCCGAACAACCAAAGCAAAACGATCTACCAGGGATTTCTGT
TCTTATGACCTTTCCACAACTTGGACCAGTTCAGCCTATTCCTTGTTGCTCATCTTCAGGTGGAACTAAT
CTGGTTAAGATTCCTACAGAAAAAGAACTCGGAGAAAACTAATGCCATCTCCCTTGAAAGGACAGCATA
CTCTAAAGTCTCCACCATCTCAAAGTGTGCAGCTCAATGATTCTCTTAGCAAAGAACTTCAGCCTATTGT
ATATACACCAGAAGACTGTAGAAAAGCTTTTCAAAATCCGTCTACAGTAACCTTAATGAAACCATCATCA
TTTACTACAAGTTTTCAGGCTATCAGCTCAAACATAAACAGTGATAATTGTCTGAAAATGTTGTGTGAAG
TAGCTATCCCTCATAATAGAAGAAAAGAATGTGGACAGGAGGACTTGGACTCTACATTTACTATATGTGA
AGACATCAAGAGCTCGAAGTGTAAATTACCCGAACAAGAATCACTACCAAATGATAACAAAGACATTTA
CAACGGCTTGATCCTTCTTCATTCTCAACTAAGCATTCTATGCCTGTACCAAGCATGGTGCCATCCTACA
TGGCAATGACTACTGCTGCCAAAAGGAAACGGAAATTAACAAGTTCTACATCAAACAGTTCGTTAACTGC
AGACGTAAATTCTGGATTTGCCAAACGTGTTCGACAAGATAATTCAAGTGAGAAGCACTTACAAGAAAAC
AAACCAACAATGGAACATAAAAGAAACATCTGTAAAATAAATCCAAGCATGGTTAGAAAATTTGGAAGAA
ATATTTCAAAAGGAAATCTAAGATAAATCACTTCAAAACCAAGCAAAATGAAGTTGATCAAATCTGCTTT
TCAAAGTTTATCAATACCCTTTCAAAAATATATTTAAAATCTTTGAAAGAAGACCCATCTTAAAGCTAAG
TTTACCCAAGTACTTTCAGCAAGCAGAAAAATGAAACTCTTTGTTTTCTTCTTTTGTGTTCTAAAAAAAT
AAAATTTCAAAAGAAAAAAAAA

FIGURE 176
SEQ ID NO: 168
Genbank ID        : AF003934.1
Unigene ID(#167)  : Hs.296638
Unigene name      :    growth differentiation factor 15    GDF15
>gi|2290971|gb|AF003934.1|AF003934 Homo sapiens prostate differentiation factor
 mRNA, complete cds
AGCGTTTAAACTTAAGCTTGGAGTTATTTCCACCATGCCCGGGCAAGAACTCAGGACGCTGAATGGCTCT
CAGATGCTCCTGGTGTTGCTGGTGCTCTCGTGGCTGCCGCATGGGGGCGCCCTGTCTCTGGCCGAGGCGA
GCCGCGCAAGTTTCCCGGGACCCTCAGAGTTGCACTCCGAAGACTCCAGATTCCGAGAGTTGCGGAAACG
CTACGAGGACCTGCTAACCAGGCTGCGGGCCAACCAGAGCTGGGAAGATTCGAACACCGACCTCGTCCCG
GCCCCTGCAGTCCGGATACTCACGCCAGAAGTCGGCTGGGATCCGGCGGCCACCTGCACCTGCGTATCT
CTCGGGCCGCCCTTCCTGAGGGGCTCCCCGAGGCCTCCCGCCTTCACCGGGCTCTGTTCCGGCTGTCCCC
GACGGCGTCAAGGTCGTGGGACGTGACACGACCGCTGCGGCGTCAGCTCAGCCTTGCAAGACCCCAGGCG
CCCGCGCTGCACCTGCGACTGTCGCCGCCGCCGTCGCAGTCGGACCAACTGCTGGCAGAATCTTCGTCCG
CACGGCCCCAGCTGGAGTTGCACTTGCGGCCGCAAGCCGCCAGGGGGCGCCGCAGAGCGCGTGCGCGCAA
CGGGGACCACTGTCCGCTCGGGCCCGGGCGTTGCTGCCGTCTGCACACGGTCCGCGCGTCGCTGGAAGAC
CTGGGCTGGGCCGATTGGGTGCTGTCGCCACGGGAGGTGCAAGTGACCATGTGCATCGGCGCGTGCCCGA
GCCAGTTCCGGGCGGCAAACATGCACGCGCAGATCAAGACGAGCCTGCACCGCCTGAAGCCCGACACGGT
GCCAGCGCCCTGCTGCGTGCCCGCCAGCTACAATCCATGGTGCTCATTCAAAAGACCGACACCGGGGTG
TCGCTCCAGACCTATGATGACTTGTTAGCCAAAGACTGCCACTGCATATGAACTAGTACTAAGCCGAATT
CTGCAGATATCC

FIGURE 177
SEQ ID NO: 169
Genbank ID        : H37811
Unigene ID(#167)  : Hs.20575
Unigene name      :    hypothetical protein LOC283431    LOC283431
>gi|907310|gb|H37811.1|H37811 yp57c08.s1 Soares fetal liver spleen 1NFLS Homo s
apiens cDNA clone IMAGE:191534 3', mRNA sequence
AAATNNTGAGTATGTATTTATTTTCTAGGTTTCTTACTTCCAGTCATGACAAAATAATGGTCATCATCTT
CCTTTTTCTTTGCAGTAGGTTTTTTATCTCCACTATCTGCATCCTTAACAGATGAGGGTGGTTTCCTGAT
TGAAGCTGGGGTTTTGCCACTTCTGGGAGGCCCTTTAGTTGAATGCTGGCTCTTAGCGACAGTCTGTGCT
GACTTCGGTGCAGTTTGTGTTTTGGTAGAAGACTGGGGTAGGCTCACGATGGACAGTGGGGTACGGCCAG
GAGACTTCAAGGAGCTGGGTCCTGTCTTCTGAAATGCACTTTATTCTGAGGCTGCTTTTTGGGAGCTGA
AAACTATAATTCNTAATCTTTNGAATTTCNGTGTGGCCTTTAACAGGAGAAACCGAGGNCACAGAAACC
GGCCGATTTTAAAATTNCAAGGCCNATTTAAAGTTCCCGTGCNGG

FIGURE 178
SEQ ID NO: 170
Genbank ID        : AI354636
Unigene ID(#167)  : acc_AI354636
Unigene name      :
>gi|4094789|gb|AI354636.1|AI354636 qu95c03.x1 NCI_CGAP_Gas4 Homo sapiens cDNA c
lone IMAGE:1979812 3', mRNA sequence
TGAATTCCAAGAAAGTTTTATTTTTAAAAATCAAGTTTTGATATAATAAATGTTGGATTGAGGATAGAAA
TTTAAGCTGAGAAATGTTTAATTTGGACCTAAAAAAGTTTATTATTACTATTATTATTGTGGAAGGAAAT
ACATACAGGCACATTTTAGTATCTACAACAGTATTTGGGAGGCTGTTATGAAACACAAAACTTCATTTAA
ATTTTATTATAAAGACCTTTATTAGGAGAAAGGACATATTTTCTATTTCTTACTTTTATTTTGTGCCTTG
AAGGACTTGTGAATGTATAGAATAATTATTTTTTCTTACTGCTTCCTCTTTGCAACCCAACCTCCACCAA
GTCAATCGTGA

FIGURE 179
SEQ ID NO: 171
Genbank ID        : NM_006491.1
Unigene ID(#167)  : Hs.292511
Unigene name      :       neuro-oncological ventral antigen 1 NOVA1
>gi|6031188|ref|NM_006491.1| Homo sapiens neuro-oncological ventral antigen
1 (
NOVA1), transcript variant 3, mRNA
GAATTCCGACAAAACAAAAGGGAGAACCTTCTCCCGGTAGCAGCGGCAGGAACTGCAAACATGATGGCGG
CAGCTCCCATCCAGCAGAACGGGACCCACACTGGGGTTCCCATAGACCTGGACCCGCCGGACTCGCGGAA
AAGGCCGCTGGAAGCCCCCCCTGAAGCCGGCAGCACCAAGAGGACCAATACGGGCGAAGACGGCCAGTAT
TTTCTAAAGGTTCTCATACCTAGTTATGCTGCTGGATCTATAATTGGGAAGGGAGGACAGACAATTGTTC
AGTTGCAAAAAGAAACTGGAGCCACCATCAAGCTGTCTAAGTCCAAAGATTTTTACCCAGGTACTACTGA
GCGAGTGTGCTTGATCCAGGGAACGGTTGAAGCACTGAATGCAGTTCATGGATTCATTGCAGAAAAAATT
CGAGAAATGCCCCAAAATGTGGCCAAGACAGAACCAGTCAGCATTCTACAACCCCAGACCACCGTTAATC
CAGATCGCATCAAACAAACATTGCCATCTTCCCCAACTACCACCAAGTCCTCTCCATCTGATCCCATGAC
CACCTCCAGAGCTAATCAGAAGCATAATATCTCCTGGATATCATGAAGCAAGATATAAGAGAAGAACAAA
ACAAAATCCGTAATTCATTGAAAGAATTGTAATCATCAATCTTTCATATTATTAATACTTTGTAATTATT
TTCTCCCCAACAGTATTTTCCAGTAGATTCTAATCATGTGGTAGGGCAGAAGGAAATGTGTTTTTTGTTG
TTCATTTGTTTCTTGTCAATAGTCCTGATTATTTTAGCTTTGCTATACTGACTTATATCTGGAAGTATAT
AACCAAGATAAGAAAATAGGTTTTAATATGATCATCTTAAGCTAATTGTAATGAAAAGAACTAATGGACT
GTCAATATTCAGAAAACCAAAAATAAAAAATACGGAAAACTAAAAAAAACCCGAATTC

FIGURE 180
SEQ ID NO: 172
Genbank ID        : NM_022969.1
Unigene ID(#167)  : Hs.404081
Unigene name      :       fibroblast growth factor receptor 2 (bacteria-
expressed kinase, keratinocyte growth factor receptor, craniofacial
dysostosis 1, Crouzon syndrome, Pfeiffer syndrome, Jackson-Weiss syndrome)
        FGFR2
>gi|13186252|ref|NM_022969.1|   Homo   sapiens   fibroblast   growth   factor
receptor 2
(bacteria-expressed    kinase,   keratinocyte    growth    factor    receptor,
craniofacial d
ysostosis 1, Crouzon syndrome, Pfeiffer syndrome, Jackson-Weiss syndrome)
(FGFR
2), transcript variant 2, mRNA
GAGCGGGCGAGGGAGCGCGCGCGGCCGCCACAAAGCTCGGGCGCCGCGGGGCTGCATGCGGCGTACCTGG
CCCGGCGCGGCGACTGCTCTCCGGGCTGGCGGGGGCCGGCCGCGAGCCCCGGGGGCCCCGAGGCCGCAGC
TTGCCTGCGCGCTCTGAGCCTTCGCAACTCGCGAGCAAAGTTTGGTGGAGGCAACGCCAAGCCTGAGTCC
TTTCTTCCTCTCGTTCCCCAAATCCGAGGCAGCCCGCGGGCGTCATGCCCGCGCTCCTCCGCAGCCTGGG
GTACGCGCTGAAGCCCGGGAGGCTTGGCGCCGGCGAAGACCCAAGGACCACTCTTCTGCGTTTGGAGTTG
CTCCCCACAACCCCGGGCTCGTCGCTTTCTCCATCCCGACCCAGCCGGGGCGCGGGGACAACACAGGTCG
CGGAGGAGCGTTGCCATTCAAGTGACTGCAGCAGCAGCGGCAGCGCCTCGGTTCCTGAGCCCACCGCAGG
CTGAAGGCATTGCGCGTAGTCCATGCCCGTAGAGGAAGTGTGCAGATGGGATTAACGTCCACATGGAGAT
ATGGAAGAGGACCGGGGATTGGTACCGTAACCATGGTCAGCTGGGGTCGTTTCATCTGCCTGGTCGTGGT
CACCATGGCAACCTTGTCCCTGGCCCGGCCCTCCTTCAGTTTAGTTGAGGATACCACATTAGAGCCAGAA
GAGCCACCAACCAAATACCAAATCTCTCAACCAGAAGTGTACGTGGCTGCGCCAGGGGAGTCGCTAGAGG
TGCGCTGCCTGTTGAAAGATGCCGCCGTGATCAGTTGGACTAAGGATGGGGTGCACTTGGGGCCCAACAA
TAGGACAGTGCTTATTGGGGAGTACTTGCAGATAAAGGGCGCCACGCCTAGAGACTCCGGCCTCTATGCT
TGTACTGCCAGTAGGACTGTAGACAGTGAAACTTGGTACTTCATGGTGAATGTCACAGATGCCATCTCAT
CCGGAGATGATGAGGATGACACCGATGGTGCGGAAGATTTTGTCAGTGAGAACAGTAACAACAAGAGAGC
ACCATACTGGACCAACACAGAAAAGATGGAAAAGCGGCTCCATGCTGTGCCTGCGGCCAACACTGTCAAG
TTTCGCTGCCCAGCCGGGGGGAACCCAATGCCAACCATGCGGTGGCTGAAAAACGGGAAGGAGTTTAAGC
AGGAGCATCGCATTGGAGGCTACAAGGTACGAAACCAGCACTGGAGCCTCATTATGGAAAGTGTGGTCCC
ATCTGACAAGGGAAATTATACCTGTGTGGTGGAGAATGAATACGGGTCCATCAATCACACGTACCACCTG
GATGTTGTGGAGCGATCGCCTCACCGGCCCATCCTCCAAGCCGGACTGCCGGCAAATGCCTCCACAGTGG
TCGGAGGAGACGTAGAGTTTGTCTGCAAGGTTTACAGTGATGCCCAGCCCCACATCCAGTGGATCAAGCA

FIGURE 180 cont'd

```
CGTGGAAAAGAACGGCAGTAAATACGGGCCCGACGGGCTGCCCTACCTCAAGGTTCTCAAGCACTCGGGG
ATAAATAGTTCCAATGCAGAAGTGCTGGCTCTGTTCAATGTGACCGAGGCGGATGCTGGGGAATATATAT
GTAAGGTCTCCAATTATATAGGGCAGGCCAACCAGTCTGCCTGGCTCACTGTCCTGCCAAAACAGCAAGC
GCCTGGAAGAGAAAAGGAGATTACAGCTTCCCCAGACTACCTGGAGATAGCCATTTACTGCATAGGGGTC
TTCTTAATCGCCTGTATGGTGGTAACAGTCATCCTGTGCCGAATGAAGAACACGACCAAGAAGCCAGACT
TCAGCAGCCAGCCGGCTGTGCACAAGCTGACCAAACGTATCCCCCTGCGGAGACAGGTAACAGTTTCGGC
TGAGTCCAGCTCCTCCATGAACTCCAACACCCCGCTGGTGAGGATAACAACACGCCTCTCTTCAACGGCA
GACACCCCCATGCTGGCAGGGGTCTCCGAGTATGAACTTCCAGAGGACCCAAAATGGGAGTTTCCAAGAG
ATAAGCTGACACTGGGCAAGCCCCTGGGAGAAGGTTGCTTTGGGCAAGTGGTCATGGCGGAAGCAGTGGG
AATTGACAAAGACAAGCCCAAGGAGGCGGTCACCGTGGCCGTGAAGATGTTGAAAGATGATGCCACAGAG
AAAGACCTTTCTGATCTGGTGTCAGAGATGGAGATGATGAAGATGATTGGGAAACACAAGAATATCATAA
ATCTTCTTGGAGCCTGCACACAGGATGGGCCTCTCTATGTCATAGTTGAGTATGCCTCTAAAGGCAACCT
CCGAGAATACCTCCGAGCCCGGAGGCCACCCGGGATGGAGTACTCCTATGACATTAACCGTGTTCCTGAG
GAGCAGATGACCTTCAAGGACTTGGTGTCATGCACCTACCAGCTGGCCAGAGGCATGGAGTACTTGGCTT
CCCAAAAATGTATTCATCGAGATTTAGCAGCCAGAAATGTTTTGGTAACAGAAAACAATGTGATGAAAAT
AGCAGACTTTGGACTCGCCAGAGATATCAACAATATAGACTATTACAAAAAGACCACCAATGGGCGGCTT
CCAGTCAAGTGGATGGCTCCAGAAGCCCTGTTTGATAGAGTATACACTCATCAGAGTGATGTCTGGTCCT
TCGGGGTGTTAATGTGGGAGATCTTCACTTTAGGGGGCTCGCCCTACCCAGGGATTCCCGTGGAGGAACT
TTTTAAGCTGCTGAAGGAAGGACACAGAATGGATAAGCCAGCCAACTGCACCAACGAACTGTACATGATG
ATGAGGGACTGTTGGCATGCAGTGCCCTCCCAGAGACCAACGTTCAAGCAGTTGGTAGAAGACTTGGATC
GAATTCTCACTCTCACAACCAATGAGGAATACTTGGACCTCAGCCAACCTCTCGAACAGTATTCACCTAG
TTACCCTGACACAAGAAGTTCTTGTTCTTCAGGAGATGATTCTGTTTTTTCTCCAGACCCCATGCCTTAC
GAACCATGCCTTCCTCAGTATCCACACATAAACGGCAGTGTTAAAACATGAATGACTGTGTCTGCCTGTC
CCCAAACAGGACAGCACTGGGAACCTAGCTACACTGAGCAGGGAGACCATGCCTCCCAGAGCTTGTTGTC
TCCACTTGTATATATGGATCAGAGGAGTAAATAATTGGAAAAGTAATCAGCATATGTGTAAAGATTTATA
CAGTTGAAAACTTGTAATCTTCCCCAGGAGGAGAAGAAGGTTTCTGGAGCAGTGGACTGCCACAAGCCAC
CATGTAACCCCTCTCACCTGCCGTGCGTACTGGCTGTGGACCAGTAGGACTCAAGGTGGACGTGCGTTCT
GCCTTCCTTGTTAATTTTGTAATAATTGGAGAAGATTTATGTCAGCACACACTTACAGAGCACAAATGCA
GTATATAGGTGCTGGATGTATGTAAATATATTCAAATTATGTATAAATATATTATATATTTACAAGGA
GTTATTTTTTGTATTGATTTTAAATGGATGTCCCAATGCACCTAGAAAATTGGTCTCTCTTTTTTTAATA
GCTATTTGCTAAATGCTGTTCTTACACATAATTTCTTAATTTTCACCGAGCAGAGGTGGAAAAATACTTT
TGCTTTCAGGGAAAATGGTATAACGTTAATTTATTAATAAATTGGTAATATACAAAACAATTAATCATTT
ATAGTTTTTTTGTAATTTAAGTGGCATTTCTATGCAGGCAGCACAGCAGACTAGTTAATCTATTGCTTG
GACTTAACTAGTTATCAGATCCTTTGAAAAGAGAATATTTACAATATATGACTAATTTGGGGAAAATGAA
GTTTTGATTTATTTGTGTTTAAATGCTGCTGTCAGACGATTGTTCTTAGACCTCCTAAATGCCCCATATT
AAAAGAACTCATTCATAGGAAGGTGTTTCATTTTGGTGTGCAACCCTGTCATTACGTCAACGCAACGTCT
AACTGGACTTCCCAAGATAAATGGTACCAGCGTCCTCTTAAAAGATGCCTTAATCCATTCCTTGAGGACA
GACCTTAGTTGAAATGATAGCAGAATGTGCTTCTCTCTGGCAGCTGGCCTTCTGCTTCTGAGTTGCACAT
TAATCAGATTAGCCTGATTCTCTTCAGTGAATTTTGATAATGGCTTCCAGACTCTTTGCGTTGGAGACGC
CTGTTAGGATCTTCAAGTCCCATCATAGAAAATTGAAACACAGAGTTGTTCTGCTGATAGTTTTGGGGAT
ACGTCCATCTTTTTAAGGGATTGCTTTCATCTAATTCTGGCAGGACCTCACCAAAAGATCCAGCCTCATA
CCTACATCAGACAAAATATCGCCGTTGTTCCTTCTGTACTAAAGTATTGTGTTTTGCTTTGGAAACACCC
ACTCACTTTGCAATAGCCGTGCAAGATGAATGCAGATTACACTGATCTTATGTGTTACAAAATTGGAGAA
AGTATTTAATAAAACCTGTTAATTTTTATACTGACAATAAAAATGTTTCTACAGATATTAATGTTAACAA
GACAAAATAAATGTCACGCAACTT
```

FIGURE 181
SEQ ID NO: 173
Genbank ID        : NM_018131.1
Unigene ID(#167)  : Hs.14559
Unigene name      :       chromosome 10 open reading frame 3   C10orf3
>gi|8922501|ref|NM_018131.1| Homo sapiens hypothetical protein FLJ10540
(FLJ105
40), mRNA

```
GAAATTGCACACTTAAAGACATCAGTGGATGAAATCACAAGTGGGAAAGGAAAGCTGACTGATAAAGAGA
GACAGAGACTTTTGGAGAAAATTCGAGTCCTTGAGGCTGAGAAGGAGAAGAATGCTTATCAACTCACAGA
GAAGGACAAAGAAATACAGCGACTGAGAGACCAACTGAAGGCCAGATATAGTACTACCGCATTGCTTGAA
CAGCTGGAAGAGACAACGAGAGAAGGAGAAAGGAGGGAGCAGGTGTTGAAAGCCTTATCTGAAGAGAAAG
ACGTATTGAAACAACAGTTGTCTGCTGCAACCTCACGAATTGCTGAACTTGAAAGCAAAACCAATACACT
CCGTTTATCACAGACTGTGGCTCCAAACTGCTTCAACTCATCAATAAATAATATTCATGAAATGGAAATA
```

FIGURE 181 cont'd

```
CAGCTGAAAGATGCTCTGGAGAAAAATCAGCAGTGGCTCGTGTATGATCAGCAGCGGGAAGTCTATGTAA
AAGGACTTTTAGCAAAGATCTTTGAGTTGGAAAAGAAAACGGAAACAGCTGCTCATTCACTCCCACAGCA
GACAAAAAAGCCTGAATCAGAAGGTTATCTTCAAGAAGAGAAGCAGAAATGTTACAACGATCTCTTGGCA
AGTGCAAAAAAAGATCTTGAGGTTGAACGACAAACCATAACTCAGCTGAGTTTTGAACTGAGTGAATTTC
GAAGAAAATATGAAGAAACCCAAAAAGAAGTTCACAATTTAAATCAGCTGTTGTATTCACAAAGAAGGGC
AGATGTGCAACATCTGGAAGATGATAGGCATAAAACAGAGAAGATACAAAAACTCAGGGAAGAGAATGAT
ATTGCTAGGGGAAAACTTGAAGAAGAGAAGAAGAGATCCGAAGAGCTCTTATCTCAGGTCCAGTCTCTTT
ACACATCTCTGCTAAAGCAGCAAGAAGAACAAACAAGGGTAGCTCTGTTGGAACAACAGATGCAGGCATG
TACTTTAGACTTTGAAAATGAAAAACTCGACCGTCAACATGTGCAGCATCAATTGCATGTAATTCTTAAG
GAGCTCCGAAAAGCAAGAAAAAATAACACAGTTGGAATCCTTGAAACAGCTTCATGAGTTTGCCATCACA
GAGCCATTAGTCACTTTCCAAGGAGAGACTGAAAACAGAGAAAAAGTTGCCGCCTCACCAAAAAGTCCCA
CTGCTGCACTCAATGGAAGCCTGGTGGAATGTCCCAAGTGCAATATACAGTATCCAGCCACTGAGCATCG
CGATCTGCTTGTCCATGTGGAATACTGTTCAAAGTAGCAAAATAAGTATTTGTTTTGATATTAAAAGATT
CAATACTGTATTTTCTGTTAGCTTGTGGGCATTTTGAATTATATATTTCACATTTTGCATAAAACTGCCT
ATCTACCTTTGACACTCCAGCATGCTAGTGAATCATGTATCTTTTAGGCTGCTGTGCATTTCTCTTGGCA
GTGATACCTCCCTGACATGGTTCATCATCAGGCTGCAATGACAGAATGTGGTGAGCAGCGTCTACTGAGA
TACTAACATTTTGCACTGTCAAAATACTTGGTGAGGAAAGATAGCTCAGGTTATTGCTAATGGGTTAAT
GCACCAGCAAGCAAAATATTTTATGTTTCGGGGGTTTTGAAAAATCAAAGATAATTAACCAAGGATCTTA
ACTGTGTTCGCATTTTTTATCCAAGCACTTAGAAAACCTACAATCCTAATTTTGATGTCCATTGTTAAGA
GGTGGTGATAGATACTATTTTTTTTTCATATTGTATAGCGGTTATTAGAAAAGTTGGGGATTTTCTTGAT
CTTTATTGCTGCTTACCATTGAAACTTAACCCAGCTGTGTTCCCCAACTCTGTTCTGCGCACGAAACAGT
ATCTGTTTGAGGCATAATCTTAAGTGGCCACACACAATGTTTTCTCTTATGTTATCTGGCAGTAACTGTA
ACTTGAATTACATTAGCACATTCTGCTTAGCTAAAATTGTTAAAATAAACTTTAATAAACCCATGTAGCC
CTCTCATTTGATTGACAGTATTTTAGTTATTTTTGGCATTCTTAAAGCTGGGCAATGTAATGATCAGATC
TTTGTTTGTCTGAACAGGTATTTTTATACATGCTTTTTGTAAACCAAAAACTTTTAAATTTCTTCAGGTT
TTCTAACATGCTTACCACTGGGCTACTGTAAATGAGAAAAGAATAAAATTATTTAATGTTTT
```

FIGURE 182
SEQ ID NO: 174
```
Genbank ID          : AW173720
Unigene ID(#167)    : Hs.176227
Unigene name        :        hypothetical protein FLJ11155 FLJ11155
>gi|6439668|gb|AW173720.1|AW173720  xj11f05.x1  NCI_CGAP_Ut2  Homo  sapiens
cDNA cl
one IMAGE:2656929 3'  similar  to  contains  Alu  repetitive  element;,  mRNA
sequence
GTATTCTTAGTAGAGATAGAGTTTCACCATGTTGGACAGGCTGGTCTTGAACTCCTGAACTCAGGTGATC
TGCCCACCTTGACCTCCCACAGTGCTGGGATTACGGGCATGAGCCATCACGCCTGGCCAACTGAAGTGTT
CTTGATGTTATAATCCTATTATTTTTGTAAGAGACAAGAAAGTAGATTTGAATTCTTTGTCATGTGCTAA
GTCAAGTTTTCCTTTGGCAATAACGGTTTCTTTCATCATAAGGAGCTCATGATGCATGGTTCTGTACCCA
TCAATCATGCTGTTTATGGATCTTTAAACTTATTGCCTAGAAAAATCTCAGGCAGTTAGCCTACTGTGTA
TCTTTTACCAAGCTGCATTTATTTTATTATTTTGTTCCATTGTTTTGGAGGATGGTTGGGCAGGAGGTGT
CTGGATCCCTGAAGCAGGCAAGGAACCCTTTCCCAAAGCCAACT
```

FIGURE 183
SEQ ID NO: 175
```
Genbank ID          : AI685841
Unigene ID(#167)    : Hs.161354
Unigene name        :       Transcribed sequences
>gi|4897135|gb|AI685841.1|AI685841  tt90d12.x1  NCI_CGAP_Pr28  Homo  sapiens
cDNA c
lone IMAGE:2248823 3', mRNA sequence
TTTTTTTTTTTGCCCTTTATTGACTTGATCTTTGGATGTTTGAGGTTATTAGGGATCATGTTTCATTTCCC
TTGCTTTCAAATACAGTTCAGAATAAGGATTACATGAAGTCACTAGCAGTTTTACTATGTCTGAACTAGT
CCTGAAAGTAAATAAACATGCACATCCTGAGCACTAAAAGAGTTGCAGAATTAATGATACTCCAATCTCT
CAGGCCATGTGTCAGTTGGAAACTAACACAATGGTGAGAACATTTTAAATATTTACAGCCTCATGATGTG
AACAAACAGCATTCTCCCTAAAAGAGTAGACTGTAACTCTACACCAAGTTGAAAGAACAGTCTGTCAAAC
ATCAGGAAATAGTCACAAAAAACTGGAT
```

FIGURE 184
SEQ ID NO: 176
Genbank ID       : NM_004696.1
Unigene ID(#167) : Hs.351306
Unigene name     :     solute    carrier    family   16   (monocarboxylic   acid
transporters), member 4 SLC16A4
>gi|4759113|ref|NM_004696.1|   Homo   sapiens   solute   carrier   family   16
(monocarboxy
lic acid transporters), member 4 (SLC16A4), mRNA
CTTGGCTCTTACAATGCTCACTTGTTTTCACAATGCAGCAAAATGAAATGCCTTAGAAAAAGAGTAACAT
TCCAGAAAACGGTGTAATTTATTTTTCTTCCTTAATTGCCCCATCTGTGGAGGATTTCTTTGCTGAACAC
CACATCAAAGGGATCTTCTGCATTTAAAATAGAAGAGGCATCATGCTGAAGAGGGAGGGGAAGGTCCAAC
CTTACACTAAAACCCTGGATGGAGGATGGGGATGGATGATTGTGATTCATTTTTCCTGGTGAATGTGTT
TGTGATGGGGATGACCAAGACTTTTGCAATTTTCTTTGTGGTCTTTCAAGAAGAGTTTGAAGGCACCTCA
GAGCAAATTGGTTGGATTGGATCCATCATGTCATCTCTTCGTTTTTGTGCAGGTCCCCTGGTTGCTATTA
TTTGTGACATACTTGGAGAGAAAACTACCTCCATTCTTGGGCTTTCGTTGTTACTGGTGGATATCTGAT
CAGCAGCTGGGCCACAAGTATTCCTTTTCTTTGTGTGACTATGGGACTTCTACCCGGTTTGGGTTCTGCT
TTCTTATACCAAGTGGCTGCTGTGGTAACTACCAAATACTTCAAAAAACGATTGGCTCTTTCTACAGCTA
TTGCCCGTTCTGGGATGGGACTGACTTTTCTTTTGGCACCCTTTACAAAATTCCTGATAGATCTGTATGA
CTGGACAGGAGCCCTTATATTATTTGGAGCTATCGCATTGAATTTGGTGCCTTCTAGTATGCTCTTAAGA
CCCATCCATATCAAAAGTGAGAACAATTCTGGTATTAAAGATAAAGGCAGCAGTTTGTCTGCACATGGTC
CAGAGGCACATGCAACAGAAACACACTGCCATGAGACAGAAGAGTCTACCATCAAGGACAGTACTACGCA
GAAGGCTGGACTACCTAGCAAAAATTTAACAGTCTCACAAAATCAAAGTGAAGAGTTCTACAATGGGCCT
AACAGGAACAGACTGTTATTAAAGAGTGATGAAGAAAGTGATAAGGTTATTTCGTGGAGCTGCAAACAAC
TGTTTGACATTTCTCTCTTTAGAAATCCTTTCTTCTACATATTTACTTGGTCTTTTCTCCTCAGTCAGTT
AGCATACTTCATCCCTACCTTTCACCTGGTAGCCAGAGCCAAAACACTGGGGATTGACATCATGGATGCC
TCTTACCTTGTTTCTGTAGCAGGTATCCTTGAGACGGTCAGTCAGATTATTTCTGGATGGGTTGCTGATC
AAAACTGGATTAAGAAGTATCATTACCACAAGTCTTACCTCATCCTCTGCGGCATCACTAACCTGCTTGC
TCCTTTAGCCACCACATTTCCACTACTTATGACCTACACCATCTGCTTTGCCATCTTTGCTGGTGGTTAC
CTGGCATTGATACTGCCTGTACTGGTTGATCTGTGTAGGAATTCTACAGTAAACAGGTTTTTGGGACTTG
CCAGTTTCTTTGCTGGGATGGCTGTCCTTTCTGGACCACCTATAGCAGGCTGGTTATATGATTATACCCA
GACATACAATGGCTCTTTCTACTTCTCTGGCATATGCTATCTCCTCTCTTCAGTTTCCTTTTTTTTGTA
CCATTGGCCGAAAGATGGAAAAACAGTCTGACCTGAAAGAAAGAAGACTGCAATCAAGTGAGAGCTAAAC
AAAAGAAAACCTAAACTAATGTCATTGGAAACAAAAGCTTGAAAGAAACACATCGCATCTACATTTGTAA
CATGAGAAGGAAAACAATTTTTTTTTTTTTTTTTGAGACGGAGTCTCGCTCTTTCGCCCAGGCTGGAG
TGCAGTGGCGCAATCTCGGCTCACTGTAATCTCCGCCTCCTGGGTTCAAGGGATTCTCCTGCCTCAGCCT
CCCAAGTAGCTGGGACTACAGGCACACGCCACCACACCCAGCTAATTTTTGTATTTTTAGTAGAGGCGG
GGTTTCACCATGTTAGCCAGGATGGTCTCCATCTCCTGACCTCGTGATCCGCCCGCCTTGTCCTCCAAAG
TGCTGGGATTACAGGCATGAGCCACTGGGCGCGGCCAGATAAGTTTTTAAGGTTCCTTCTTGCTTTAGCA
TTCTGAGAAATGTCTAATTGGTAGTAAGACAAGAGTAATAGCAACCTGTATTGTTAGTATTTAACCAAAT
AGGCTAAAATTTTAATCAGGTACCTTATGTATTAAATAGAAATCGGAATGTACCATAATAAATCCAAACT
CTCAATTACGCCATGGTAATTCAGTCACTAAAATATGTAAAGATAGAAAATTTTTTAATTTAAAGAAGTG
TGAAACATAGCCATTGATTGATCAGAATTCTGGAATCTGAATATTAAAACCTTACTTAGTGACTGGAATG
GTATATGCTCCCTCCAAAAGTTTATCTTTGTTTATTGATTAAAGGTAATCCTTACTTTCTTTGTATTACT
TAGGTTCTCAATTAAAGGTAATCCTTACTTTCTTTGTATTACTTAGGTTCTTAAATTTCTATGATAAACA
TGTATTGCT

FIGURE 185
SEQ ID NO: 177
Genbank ID       : NM_000227.1
Unigene ID(#167) : Hs.83450
Unigene name     :      laminin, alpha 3    LAMA3
>gi|4557710|ref|NM_000227.1| Homo sapiens laminin, alpha 3 (LAMA3), mRNA
ATGGGATGGCTGTGGATCTTTGGGGCAGCCCTGGGGCAGTGTCTGGGCTACAGTTCACAGCAGCAAAGGG
TGCCATTTCTTCAGCCTCCCGGTCAAAGTCAACTGCAAGCGAGTTATGTGGAGTTTAGACCCAGCCAGGG
TTGTAGCCCTGGATACTATCGGGATCATAAAGGCTTGTATACCGGACGGTGTGTTCCCTGCAATTGCAAC
GGACATTCAAATCAATGCCAGGATGGCTCAGGCATATGTGTTAACTGTCAGCACAACACCGCGGGAGAGC FIGURE 185 cont'd ACTGTGAACGCTGCCAGGAGGGCTACTATGGCAACGCCGTCCACGGATCCTGCAGGGCCTGCCCATGTCC
TCACACTAACAGCTTTGCCACTGGCTGTGTGGTGAATGGGGGAGACGTGCGGTGCTCCTGCAAAGCTGGG
TACACAGGAACACAGTGTGAAAGGTGTGCACCGGGATATTTCGGGAATCCCCAGAAATTCGGAGGTAGCT
GCCAACCATGCAGTTGTAACAGCAATGGCCAGCTGGGCAGCTGTCATCCCTGACTGGAGACTGCATAAA
CCAAGAACCCAAAGATAGCAGCCCTGCAGAAGAATGTGATGATTGCGACAGCTGTGTGATGACCCTCCTG
AACGACCTGGCCACCATGGGCGAGCAGCTCCGCCTGGTCAAGTCTCAGCTGCAGGGCCTGAGTGCCAGCG
CAGGGCTTCTGGAGCAGATGAGGCACATGGAGACCCAGGCCAAGGACCTGAGGAATCAGTTGCTCAACTA
CCGTTCTGCCATTTCAAATCATGGATCAAAAATAGAAGGCCTGGAAAGAGAACTGACTGATTTGAATCAA
GAATTTGAGACTTTGCAAGAAAAGGCTCAAGTAAATTCCAGAAAAGCACAAACATTAAACAACAATGTTA
ATCGGGCAACACAAAGCGCAAAAGAACTGGATGTGAAGATTAAAAATGTCATCCGGAATGTGCACATTCT
TTTAAAGCAGATCTCTGGGACAGATGGAGAGGGAAACAACGTGCCTTCAGGTGACTTTTCCAGAGAGTGG
GCTGAAGCCCAGCGCATGATGAGGGAACTGCGGAACAGGAACTTTGGAAAGCACCTCAGAGAAGCAGAAG
CTGATAAAAGGGAGTCGCAGCTCTTGCTGAACCGGATAAGGACCTGGCAGAAAACCCACCAGGGGGAGAA
CAATGGGCTTGCTAACAGTATCCGGGATTCTTTAAATGAATACGAAGCCAAACTCAGTGACCTTCGTGCT
CGGCTGCAGGAGGCAGCTGCCCAAGCCAAGCAGGCAAATGGCTTGAACCAAGAAAACGAGAGAGCTTTGG
GAGCCATTCAGAGACAAGTGAAAGAAATAAATTCCCTGCAGAGTGATTTCACCAAGTATCTAACCACTGC
AGACTCATCTTTGTTGCAAACCAACATTGCGCTGCAGCTGATGGAGAAAAGCCAGAAGGAATATGAAAAA
TTAGCTGCCAGTTTAAATGAAGCAAGACAAGAACTAAGTGACAAAGTAAGAGAACTTTCCAGATCTGCTG
GCAAAACATCCCTTGTGGAGGAGGCAGAAAAGCACGCGCGGTCCTTACAAGAGCTGGCAAAGCAGCTGGA
AGAGATCAAGAGAAACGCCAGCGGGGATGAGCTGGTGCGCTGTGCTGTGGATGCCGCCACCGCCTACGAG
AACATCCTCAATGCCATCAAAGCGGCCGAGGACGCAGCCAACAGGGCTGCCAGTGCATCTGAATCTGCCC
TCCAGACAGTGATAAAGGAAGATCTGCCAAGAAAAGCTAAAACCCTGAGTTCCAACAGTGATAAACTGTT
AAATGAAGCCAAGATGACACAAAAGAAGCTAAAGCAAGAAGTCAGTCCAGCTCTCAACAACCTACAGCAA
ACCCTGAATATTGTGACAGTTCAGAAAGAAGTGATAGACACCAATCTCACAACTCTCCGAGATGGTCTTC
ATGGGATACAGAGAGGTGATATTGATGCTATGATCAGTAGTGCAAAGAGCATGGTCAGAAAGGCCAACGA
CATCACAGATGAGGTTCTGGATGGGCTCAACCCCATCCAGACAGATGTGGAAAGAATTAAGGACACCTAT
GGGAGGACACAGAACGAAGACTTCAAAAAGGCTCTGACTGATGCAGATAACTCGGTGAATAAGTTAACCA
ACAAACTACCTGATCTTTGGCGCAAGATTGAAAGTATCAACCAACAGCTGTTGCCCTTGGGAAACATCTC
TGACAACATGGACAGAATACGAGAACTAATTCAGCAGGCCAGAGATGCTGCCAGTAAGGTTGCTGTCCCC
ATGAGGTTCAATGGTAAATCTGGAGTCGAAGTCCGACTGCCAAATGACCTGGAAGATTTGAAAGGATATA
CATCTCTGTCCTTGTTTCTCCAAAGGCCCAACTCAAGAGAAAATGGGGGTACTGAGAATATGTTTGTGAT
GTACCTTGGAAATAAAGATGCCTCCCGGGACTACATCGGCATGGCAGTTGTGGATGGCCAGCTCACCTGT
GTCTACAACCTGGGGGACCGTGAGGCTGAACTCCAAGTGGACCAGATCTTGACCAAGAGTGAGACTAAGG
AGGCAGTTATGGATCGGGTGAAATTTCAGAGAATTTATCAGTTTGCAAGGCTTAATTACACCAAAGGAGC
CACATCCAGTAAACCAGAAACACCCGAGTCTATGACATGGATGGTAGAAATAGCAATACACTCCTTAAT
TTGGATCCTGAAAATGTTGTATTTATGTTGGAGGTTACCCACCTGATTTTAAACTTCCCAGTCGACTAA
GTTTCCCTCCATACAAAGGTTGTATTGAATTAGATGACCTCAATGAAAATGTTCTGAGCTTGTACAACTT
CAAAAAAACATTCAATCTCAACAACTGAAGTGGAGCCTTGTAGAAGGAGGAAGGAAGAGTCAGACAAA
AATTATTTTGAAGGTACGGGCTATGCTCGAGTTCCAACTCAACCACATGCTCCCATCCCAACCTTTGGAC
AGACAATTCAGACCACCGTGGATAGAGGCTTGCTGTTCTTTGCAGAAAACGGGGATCGCTTCATATCTCT
AAATATAGAAGATGGCAAGCTCATGGTGAGATACAAACTGAATTCAGAGCTACCAAAAGAGAGGAGTT
GGAGACGCCATAAACAACGGCAGAGACCATTCGATTCAGATCAAAATTGGAAAACTCCAAAAGCGTATGT
GGATAAATGTGGACGTTCAAAACACTATAATTGATGGTGAAGTATTTGATTTCAGCACATATTATCTGGG
AGGAATTCCAATTGCAATCAGGGAAAGATTTAACATTTCTACGCCTGCTTTCCGAGGCTGCATGAAAAAT
TTGAAGAAACCAGTGGTGTCGTTAGATTGAATGATACTGTGGGAGTAACCAAAAAGTGCTCGGAAGACT
GGAAGCTTGTGCGATCTGCCTCATTCTCCAGAGGAGGACAATTGAGTTTCACTGATTTGGGCTTACCACC
TACTGACCACCTCCAGGCCTCATTTGGATTTCAGACCTTTCAACCCAGTGGCATATTATTAGATCATCAG
ACATGGACAAGGAACCTGCAGGTCACTCTGGAAGATGGTTACATTGAATTGAGCACCAGCGATAGCGGCG
GCCCAATTTTTAAATCTCCACAGACGTATATGGATGGTTACTGCATTATGTATCTGTAATAAGCGACAA
CTCTGGACTACGGCTTCTCATCGATGACCAGCTTCTGAGAAATAGCAAAAGGCTAAAACATTTCAAGT
TCCCGGCAGTCTCTGCGTCTGGGCGGGAGCAATTTTGAGGGTTGTATTAGCAATGTTTTGTCCAGAGGT
TATCACTGAGTCCTGAAGTCCTAGATTTGACCAGTAACTCTCTCAAGAGAGATGTGTCCCTGGGAGGCTG
CAGTTTAAACAAACCACCTTTTCTAATGTTGCTTAAAGGTTCTACCAGGTTTAACAAGACCAAGACTTTT
CGTATCAACCAGCTGTTGCAGGACACACCAGTGGCCTCCCCAAGGAGCGTGAAGGTGTGGCAAGATGCTT
GCTCACCACTTCCCAAGACCCAGGCCAATCATGGAGCCCTCCAGTTTGGGGACATTCCCACCAGCCACTT
GCTATTCAAGCTTCCTCAGGAGCTGCTGAAACCCAGGTCACAGTTTGCTGTGGACATGCAGACAACATCC
TCCAGAGGACTGGTGTTTCACACGGGCACTAAGAACTCCTTTATGGCTCTTTATCTTTCAAAGGACGTC
TGGTCTTTGCACTGGGGACAGATGGGAAAAATTGAGGATCAAAAGCAAGGAGAAATGCAATGATGGGAA
ATGGCACACGGTGGTGTTTGGCCATGATGGGAAAAGGGGCGCTTGGTTGTGGATGGACTGAGGGCCGG
GAGGGAAGTTTGCCTGGAAACTCCACCATCAGCATCAGAGCGCCAGTTTACCTGGGATCACCTCCATCAG
GGAAACCAAAGAGCCTCCCCACAAACAGCTTTGTGGGATGCCTGAAGAACTTTCAGCTGGATTCAAAACC FIGURE 185 cont'd CTTGTATACCCCTTCTTCAAGCTTCGGGGTGTCTTCCTGCTTGGGTGGTCCTTTGGAGAAAGGCATTTAT
TTCTCTGAAGAAGGAGGTCATGTCGTCTTGGCTCACTCTGTATTGTTGGGGCCAGAATTTAAGCTTGTTT
TCAGCATCCGCCCAAGAAGTCTCACTGGGATCCTAATACACATCGGAAGTCAGCCCGGGAAGCACTTATG
TGTTTACCTGGAGGCAGGAAAGGTCACGGCCTCTATGGACAGTGGGGCAGGTGGGACCTCAACGTCGGTC
ACACCAAAGCAGTCTCTGTGTGATGGACAGTGGCACTCGGTGGCAGTCACCATAAAACAACACATCCTGC
ACCTGGAACTGGACACAGACAGTAGCTACACAGCTGGACAGATCCCCTTCCCACCTGCCAGCACTCAAGA
GCCACTACACCTTGGAGGTGCTCCAGCCAATTTGACGACACTGAGGATCCCTGTGTGGAAATCATTCTTT
GGCTGTCTGAGGAATATTCATGTCAATCACATCCCTGTCCCTGTCACTGAAGCCTTGGAAGTCCAGGGGC
CTGTCAGTCTGAATGGTTGTCCTGACCAGTAACCCAAGCCTATTTCACAGCAAGGAAATTCACCTTCAAA
AGCACTGATTACCCAATGCACCTCCCTCCCCAGCTCGAGATCATTCTTCAATTAGGACACAAACCAGACA
GGTTTAATAGCGAATCTAATTTTGAATTCTGACCATGGATACCCATCACTTTGGCATTCAGTGCTACATG
TGTATTTTATATAAAAATCCCATTTCTTGAAGATAAAAAAATTGTTATTCAAATTGTTATGCACAGAATG
TTTTTGGTAATATTAATTTCCACTAAAAAATTAAATGTCTTTT

FIGURE 186
SEQ ID NO: 178
Genbank ID        : NM_031299.1
Unigene ID(#167)  : Hs.30114
Unigene name      :    cell  division  cycle  associated  3    CDCA3
>gi|13876383|ref|NM_031299.1|   Homo   sapiens   hypothetical   protein   MGC2577
(MGC257
7), mRNA
ATGGGCTCAGCCAAGAGCGTCCCAGTCACACCAGCGCGGCCTCCGCCGCACAACAAGCATCTGGCTCGAG
TGGCGGACCCCCGTTCACCTAGTGCTGGCATCCTGCGCACTCCCATCCAGGTGGAGAGCTCTCCACAGCC
AGGCCTACCAGCAGGGGAGCAACTGGAGGGTCTTAAACATGCCCAGGACTCAGATCCCCGCTCTCCTACT
CTTGGTATTGCACGGACACCTATGAAGACCAGTCAGTGGAGACCCCCAAGCCCACTGGTGAAACAGCTGA
GTGAAGTATTTGAAACTGAAGACTCTAAATCAAATCTTCCCCAGAGCCTGTTCTGCCCCAGAGGCACC
TTTATCTTCTGAATTGGACTTGCCTCTGGGTACCCAGTTATCTGTTGAGGAACAGATGCCACCTTGGAAC
CAGACTGAGTTCCCCTCCAAACAGGTGTTTTCCAAGGAGGAAGCAAGACAGCCCACAGAAACCCCTGTGG
CCAGCCAGAGCTCCGACAAGCCCTCAAGGGACCCTGAGACTCCCAGATCTTCAGGTTCTATGCGCAATAG
ATGGAAACCAAACAGCAGCAAGGTACTAGGGAGATCCCCCCTCACCATCCTGCAGGATGACAACTCCCCT
GGCACCCTGACACTACGACAGGGTAAGCGGCCTTCACCCCTAAGTGAAAATGTTAGTGAACTAAAGGAAG
GAGCCATTCTTGGAACTGGACGACTTCTGAAAACTGGAGGACGAGCATGGGAGCAAGGCCAGGACCATGA
CAAGGAAAATCAGCACTTTCCCTTGGTGGAGAGCTAG

FIGURE 187
SEQ ID NO: 179
Genbank ID        : NM_006419.1
Unigene ID(#167)  : Hs.100431
Unigene name      :    chemokine   (C-X-C   motif)   ligand   13   (B-cell
chemoattractant)  CXCL13
>gi|5453576|ref|NM_006419.1|  Homo  sapiens  chemokine  (C-X-C  motif)  ligand  13
(B-
cell chemoattractant) (CXCL13), mRNA
TTCGGCACTTGGGAGAAGATGTTTGAAAAAACTGACTCTGCTAATGAGCCTGGACTCAGAGCTCAAGTCT
GAACTCTACCTCCAGACAGAATGAAGTTCATCTCGACATCTCTGCTTCTCATGCTGCTGGTCAGCAGCCT
CTCTCCAGTCCAAGGTGTTCTGGAGGTCTATTACACAAGCTTGAGGTGTAGATGTGTCCAAGAGAGCTCA
GTCTTTATCCCTAGACGCTTCATTGATCGAATTCAAATCTTGCCCCGTGGGAATGGTTGTCCAAGAAAAG
AAATCATAGTCTGGAAGAAGAACAAGTCAATTGTGTGTGTGGACCCTCAAGCTGAATGGATACAAAGAAT
GATGGAAGTATTGAGAAAAGAAGTTCTTCAACTCTACCAGTTCCAGTGTTAAGAGAAAGATTCCCTGA
TGCTGATATTTCCACTAAGAACACCTGCATTCTTCCCTTATCCCTGCTCTGGATTTTAGTTTTGTGCTTA
GTTAAATCTTTTCCAGGGAGAAAGAACTTCCCCATACAAATAAGGCATGAGGACTATGTGAAAAATAACC
TTGCAGGAGCTGATGGGGCAAACTCAAGCTTCTTCACTCACAGCACCCTATATACACTTGGAGTTTGCAT
TCTTATTCATCAGGGAGGAAAGTTTCTTTGAAAATAGTTATTCAGTTATAAGTAATACAGGATTATTTTG
ATTATATACTTGTTGTTTAATGTTTAAAATTTCTTAGAAAACAATGGAATGAGAATTTAAGCCTCAAATT FIGURE 187 cont'd TGAACATGTGGCTTGAATTAAGAAGAAAATTATGGCATATATTAAAAGCAGGCTTCTATGAAAGACTCAA
AAAGCTGCCTGGGAGGCAGATGGAACTTGAGCCTGTCAAGAGGCAAAGGAATCCATGTAGTAGATATCCT
CTGCTTAAAAACTCACTACGGAGGAGAATTAAGTCCTACTTTTAAAGAATTTCTTTATAAAATTTACTGT
CTAAGATTAATAGCATTCGAAGATCCCCAGACTTCATAGAATACTCAGGGAAAGCATTTAAAGGGTGATG
TACACATGTATCCTTTCACACATTTGCCTTGACAAACTTCTTTCACTCACATCTTTTTCACTGACTTTTT
TTGTGGGGGCGGGGCCGGGGGGACTCTGGTATCTAATTCTTTAATGATTCCTATAAATCTAATGACATTC
AATAAAGTTGAGCAAACATTTTACTT

FIGURE 188
SEQ ID NO: 180
Genbank ID       : NM_018410.1
Unigene ID(#167) : Hs.104859
Unigene name     :       hypothetical protein DKFZp762E1312   DKFZp762E131
>gi|8922180|ref|NM_018410.1|   Homo   sapiens   hypothetical   protein
DKFZp762E1312 (D
KFZp762E1312), mRNA
ATGACATTTGCAATGTGACCATCAGTGACCTGTACGCAGGGATGCTGCACTCCATGAGCCGGCTGTTGAG
CACAAAGCCATCAAGCATCATCTCCACCAAAACGTTCATCATGCAAAACTGGAACTCCAGGAGGAGGCAC
AGATATAAGAGCAGGATGAACAAAACATATTGCAAAGGAGCCAGACGTTCTCAGAGGAGCTCCAAGGAGA
ACTTCATACCCTGCTCTGAGCCTGTGAAAGGGACAGGGGCATTAAGAGATTGCAAGAACGTATTAGATGT
TTCTTGCCGTAAGACAGGTTTAAAATTGGAAAAAGCTTTTCTTGAAGTCAACAGACCCCAAATCCATAAG
TTAGATCCAAGTTGGAAGGAGCGCAAAGTGACACCCTCGAAGTATTCTTCCTTGATTTACTTCGACTCCA
GTGCAACATATAATCTTGATGAGGAAAATAGATTTAGGACATTAAAATGGTTAATTTCTCCTGTAAAAAT
AGTTTCCAGACCAACAATACGACAGGGCCATGGAGAGAACCGTCAGAGGGAGATTGAAATCTGATTTGAT
CAGCTTCATCGGGAATATTGCCTGAGTCCCAGGAACCAGCCTCGCCGGATGTGCCTCCCGGACTCCTGGG
CCATGAACATGTACAGAGGGGTCCTGCGAGTCCTGGTGGCCTTCAGGGCTTAGAAACCCGCAGGCTGAG
TTTACCTTCCAGCAAAGCAAAAGCAAAAAGTTTAAGTGAGGCTTTTGAAAACCTAGGCAAAAGATCTCTG
GAAGCAGGTAGGTGCCTGCCCAAGAGCGATTCATCTTCATCACTTCCAAAGACCAACCCCACACACAGCG
CAACTCGCCCGCAGCAGACATCTGACCTTCACGTTCAGGGAAATAGTTCTGGAATATTTAGAAAGTCAGT
GTCACCCAGCAAAACTCTTTCAGTCCCAGATAAAGAAGTGCCAGGCCACGGAAGGAATCGTTACGATGAA
ATTAAAGAAGAATTTGACAAGCTTCATCAAAAGTATTGCCTCAAATCTCCTGGGCAGATGACAGTGCCTT
TATGTATTGGAGTGTCTACAGATAAAGCAAGTATGGAAGTTCGATATCAAACAGAAGGCTTCTTAGGAAA
ATTAAATCCAGACCCTCACTTCCAGGGTTTCCAGAAGTTGCCATCATCACCCCTGGGGTGCAGAAAAAGT
CTACTGGGCTCAACTGCAATTGAGGCTCCTTCATCTACATGTGTTGCTCGTGCCATCACGAGGGATGGCA
CGAGGGACCATCAGTTCCCTGCAAAAAGACCCAGGCTATCAGAACCCCAGGGCTCCGGACGCCAGGGCAA
TTCCCTGGGTGCCTCAGATGGGGTGGACAACACCGTCAGACCGGGAGACCAGGGCAGCTCTTCACAGCCC
AACTCAGAAGAGAGAGGAGAGAACACGTCTTACAGGATGGAAGAGAAAAGTGATTTCATGCTAGAAAAAT
TGGAAACTAAAAGTGTGTAGCTAGGTTATTTCGGAGTGTTATTTATCTTCCCACTTGCTCTCTGTTTGTA
TTTTTGTTTTGTTTTTGATTCTTGAGACTGTGAGGACTTGGTTGACTTCTCTGCCCTTAAAGTAAATATT
AGTGAAATTGGTTCCATCAGAGATAACCTCGAGTTCTTGGTGTAGAAATTATGTGAATAAAGTTGCTCAA
TTAGAAAAAAAAAAAAAAAAAAAAAA

FIGURE 189
SEQ ID NO: 181
Genbank ID       : NM_016629.1
Unigene ID(#167) : acc_NM_016629.1
Unigene name     :
>gi|7706171|ref|NM_016629.1|   Homo   sapiens   hypothetical   protein   LOC51323
(LOC513
23), mRNA
AGTCTTTATGTCTCTTAACATTCACACCTACTTTTTAAAAACAAATATTATTACTATTTTTATTATTGTT
TGTCCTTTATAAATTTTCTTAAAGATTAAGAAAATTTAAGACCCCATTGAGTTACTGTAATGCAATTCAA
CTTTGAGTTATCTTTTAAATATGTCTTGTATAGTTCATATTCATGGCTGAAACTTGACCACACTATTGCT
GATTGTATGGTTTTCACCTGGACACCGTGTAGAATGCTTGATTACTTGTACTCTTCTTATGCTAATATGC
TCTGGGCTGGAGAAATGAAATCCTCAAGCCATCAGGATTTGCTATTTAAGTGGCTTGACAACTGGGCCAC
CAAAGAACTTGAACTTCACCTTTTAGGATTTGAGCTGTTCTGGAACACATTGCTGCACTTTGGAAAGTCA
AAATCAAGTGCCAGTGGCGCCCTTTCCATAGAGAATTTGCCCAGCTTTGCTTTAAAAGATGTCTTGTTTT
TTATATACACATAATCAATAGGTCCAATCTGCTCTCAAGGCCTTGGTCCTGGTGGGATTCCTTCACCAAT FIGURE 189 Cont'd TACTTTAATTAAAAATGGCTGCAACTGTAAGAACCCTTGTCTGATATATTTGCAACTATGCTCCCATTTA
CAAATGTACCTTCTAATGCTCAGTTGCCAGGTTCCAATGCAAAGGTGGCGTGGACTCCCTTTGTGTGGGT
GGGGTTTGTGGGTAGTGGTGAAGGACCGATATCAGAAAAATGCCTTCAAGTGTACTAATTTATTAATAAA
CATTAGGTGTTTGTTAAAAAAAAAAAAA

FIGURE 190
SEQ ID NO: 182
Genbank ID        : T90295
Unigene ID(#167)  : acc_T90295
Unigene name      :
>gi|718808|gb|T90295.1|T90295 yd42f02.s1 Soares fetal liver spleen 1NFLS Homo s
apiens cDNA clone IMAGE:110907 3', mRNA sequence
TTGTAGGTTCAACTCAAATGAGTTTATTTATTAGGAACTTTTGAAACACTGAGGTTGAACAGAGAATGGG
AACTAGACAGATCATTTCAGCATAGATGGTTACTTTCCCTCTTGCCACAGACTCTGCAGGAAATGTCAAT
TACTGCTTTCTTTCTCCATTATGTTCAATCCTTTCCAAGGCAGTCAGAGAGCTCTCTCCCTTCCCATTAA
GAGAGGATCTTCTCCGGTAGCCTTTGAACTGGGAAGTGGCTTTAGTATTTGCAAGTGTAGATATACAAAA
GCTCTTCCCTCCTCTTACCAGGGTTCATCGGGAAGGAACCCAGCAGCAGGGCCCTGGGGTGTTTTCTGGG
ATCCTGAGGACGGGAGGGTGCCCATCTNCGGGTTTTTGTCTGGGAGGGCANAGTTTCTTTTATGGGGGAG
ACATACTTTCAAATCCNCTGCTTGTCCAAACGTACATATTGTTCTTCTTTTTGGCNTTTTTGGGGANTGG
GANGGAAGTGGAAGTTGAAATCCNTACAAGACCC

FIGURE 191
SEQ ID NO: 183
Genbank ID        : NM_024053.1
Unigene ID(#167)  : Hs.208912
Unigene name      :        chromosome 22 open reading frame 18 C22orf18
>gi|13129021|ref|NM_024053.1| Homo sapiens chromosome 22 open reading frame 18
(C22orf18), mRNA
GGCACGAGGGCACCGCAGGAGCAACGGTTGGTCCTGCGGCTGTGATGTCGGTGTTGAGGCCCCTGGACAA
GCTGCCCGGCCTGAACACGGCCACCATCTTGCTGGTGGGCACGGAGGATGCTCTTCTGCAGCAGCTGGCG
GACTCGATGCTCAAAGAGGACTGCGCCTCCGAGCTGAAGGTCCACTTGGCAAAGTCCCTCCCTTTGCCCT
CCAGTGTGAATCGGCCCCGAATTGACCTGATCGTGTTTGTGGTTAATCTTCACAGCAAATACAGTCTCCA
GAACACAGAGGAGTCCCTGCGCCATGTGGATGCCAGCTTCTTCTTGGGGAAGGTGTGTTTCCTCGCCACA
GGTGCTGGGCGGGAGAGCCACTGCAGCATTCACCGGCACACCGTGGTGAAGCTGGCCCACACCTATCAAA
GCCCCCTGCTCTACTGTGACCTGGAGGTGGAAGGCTTTAGGGCCACCATGGCGCAGCGCCTGGTGCGCGT
GCTGCAGATCTGTGCTGGCCACGTGCCCGGTGTCTCAGCTCTGAACCTGCTGTCCCTGCTGAGAAGCTCT
GAGGGCCCCTCCCTGGAGGACCTGTGAGGGTGGCTGGCCCCTGGGCTGCCCCTTCTCATGGCTTCGTGCT
GACTCCATAAACATTCTCTGTTGAGGATGTCCAGTCAGGGCTTGACAGGCCCAGGCTCAGCCCGCCGTGG
CTGGGAAGGTTCCCTGCAGTGCCAGTGCTGCAGCAGGGAGAGCTGGGCAGAAGCAGCGAGGGGGCCCAGC
TGGCGAGACTGTAGCCCCCTCCCACTCCCACACTCACTCTTGCAGAGCCTGTGTCTTTAAGCAGCTGGCG
TGTTACATCTCCATTTAAGGTTTCCTTTGAACAAAAGGTCTGTGGCTAAAAAAAGTTTAAAAATCAAAAA
AAAAAAAAAAAA

FIGURE 192
SEQ ID NO: 184
Genbank ID        : NM_005924.1
Unigene ID(#167)  : Hs.77858
Unigene name      :        mesenchyme homeo box 2 (growth arrest-specific homeo box) MEOX2
>gi|5174548|ref|NM_005924.1| Homo sapiens mesenchyme homeo box 2 (growth arrest
-specific homeo box) (MEOX2), mRNA
GGGACCACCTTCTTTTGGCTTCAACCTCTCCCACTCTTGACATCTGAGTAGCTCAGGGAAGCTCTTCCAG
GTCCGACTGTTCATATGTAAAGGAGACTGGCCGCTGGGCTCAGGACCGGGATTATCCGAGCTCTGCAGAA
GTGCACCGCTATTGCTTTGGGAGGGAAAAAAAAAAATCACACGGTTTCCAGTGAAAAGTGACAGAGGG FIGURE 192 con'd TGGTGGCCTTTGGAACCGTCGTCCCGTCTCTCCCTGAACCCGAAACTTGCATGCTATGGAACACCCGCTC
TTTGGCTGCCTGCGCAGCCCTCACGCCACGGCGCAAGGCTTGCACCCGTTCTCCCAATCCTCTCTCGCCC
TCCATGGAAGATCTGACCATATGTCTTACCCCGAGCTCTCTACTTCTTCCTCATCTTGCATAATCGCGGG
ATACCCCAACGAAGAGGGCATGTTTGCCAGCCAGCATCACAGGGGGCACCACCACCACCACCACCACCAC
CATCACCACCATCAGCAGCAGCAGCACCAGGCTCTGCAAACCAACTGGCACCTCCCGCAGATGTCTTCCC
CACCGAGTGCGGCTCGGCACAGCCTCTGCCTCCAGCCCGACTCTGGAGGGCCCCCAGAGTTGGGGAGCAG
CCCGCCCGTCCTGTGCTCCAACTCTTCCAGCTTGGGCTCCAGCACCCCGACTGGGGCCGCGTGCGCGCCG
GGGGACTACGGCCGCCAGGCACTGTCACCTGCGGAGGCGGAGAAGCGAAGCGGCGGCAAGAGGAAAAGCG
ACAGCTCAGACTCCCAGGAAGGAAATTACAAGTCAGAAGTCAACAGCAAACCCAGGAAAGAAAGGACAGC
ATTTACCAAAGAGCAAATCAGAGAACTTGAAGCAGAATTTGCCCATCATAATTATCTCACCAGACTGAGG
CGATACGAGATAGCAGTGAATCTGGATCTCACTGAAAGACAGGTGAAAGTCTGGTTCCAAAACAGGCGGA
TGAAGTGGAAGAGGGTAAAGGGTGGACAGCAAGGAGCTGCGGCTCGGGAAAAGGAACTGGTGAATGTGAA
AAAGGGAACACTTCTCCCATCAGAGCTGTCGGGAATTGGTGCAGCCACCCTCCAGCAAACAGGGGACTCT
ATAGCAAATGAAGACAGTCACGACAGTGACCACAGCTCAGAGCATGCGCACTTATGATATAAACAGAGGA
CCAGCTCCATTCTCAGGAAAGAAATGTTGTGGATGGCAAGCCTTTACCCAAATATCGTTTACACAGAGAG
ATGACTATGGCAGTGATGTTTAATATTATTAAATCCAGGCATTTCGAATCTGTTTTTCATTGATTTATTA
GAGGGTTTACACAAAGAGCTTCCACAGTGAAGATGGAGAAGGTGAACTTGCTTTGAATATNCCAGATTTG
TTTGGTCATGCGTATGGCAGTGAGCAGGTATGTGTTTTCTTTTCTTCACGAAAATTAAATTGCTATCAAG
AGCAAACTATGAACATTATATTCAAGATGTCTCCAGAGTGAAGATGCCGAGGATGAACTTGCATTGAACA
TTCCAGATGTGTGAGATCATGTGTATTGCAGTGGGCAGGTATTTGCTTTTGCTTGCACTGAAAATTAAAT
TGCTATCAAGAATAAACCATGAAACATTTTATCCTGAACAGCCACAGTGCCTGAATTCACTCAAGTGGAT
AAAAAAGTGTATTTTAACTCTGTATATTACCCTTAAGTCATTTTCCTGTCTTCACTAATTTAGCAATGCA
TTCATATTAGCTGATGAAATAGGCACTCACAATGACAACCAGAGCCAGTTTCTTGTCTTTTTATACATTT
TGTCATCCCAGAGACTCGGTATTTGCTTACTGTGTTTCAAGTAGAGGAAATCGTGGTCTTGAACTATTCT
GTACCACAGCAAACAATCTATGTTGCTTTACTATCAACTGCTGTAATCGTTTATAAAACTTACCTAGCTC
CTTCCCTTCTTCTATCATAGCTTTAAACATTAGAATTCATAGGCAAATCAGTTAAAACATTAGGATCATA
GGCAAATCAGTTACCTTGCAGAAAGAGCTTTGTATGACAGACATTGTCTTATTTTATTTCTGTAAAATAT
TAGCTGTATGAATATGATTTAATTAACAAGAAAACATTTCTTCCTGATTGACAACAGTGTTAGCAAGGTG
CAAAGCGAAACTGGTTGCTCAAGTTGATAGAAAACAAAATTCTGAATATCTTCAAATTAATTCGGTAAAA
ACACATTATTTTTTCATATGTGATGTATTCATGCAGAACAACTATCTTGTATTTTGTTTTTAAAATGTGT
TTAATAAATGATCCTTTGTAAATAAAAAAAAAAAAAAAAAAAAAAAA

FIGURE 193
SEQ ID NO: 185
Genbank ID        : AI798959
Unigene ID(#167)  : Hs.131686
Unigene name      :         Transcribed sequences
>gi|5364431|gb|AI798959.1|AI798959    we94g10.x1    Soares_NFL_T_GBC_S1    Homo sapiens
cDNA clone IMAGE:2348802 3', mRNA sequence
TTTACAGCTGCATTAGAAAGTTAACATGGGGGCAGGGTGGGGGAAGGAGTCCGAGAGCCTGAGGCCTGA
GAACAAGACGGGAAGACATTGCTGGACATTTATTTTATGACGTGCCTCATCAGCAGAACAAAGAAGGGCA
TGGACTTATGTTTAAAAACTGTCCAGAAGTGACCAAAGAAATTCACCAGTGATGCAGATGAGCTCCTAAT
AATCATGCCATCGGAGCAGGCTGTGATAGCCTGGAAATCCTGCCTGAAACCAAACTGCAACATTTCCAAC
TAAGAAATCAAGCGGTGATAAACCTCAGTATCTGAAAGGGTTAAATATTGTGCCCACGTGACTACTGTTC
TTTCTTTCTGTGAATTAATGTGTGTGCCAGAAAATATTTGTGAATAAAAAACAATTACATAATCTCATTG
TCATGAATGTGGT

FIGURE 194
SEQ ID NO: 186
Genbank ID        : NM_018518.1
Unigene ID(#167)  : Hs.198363
Unigene name      :     MCM10 minichromosome maintenance deficient 10 (S. cerevisiae) MCM10
>gi|8924142|ref|NM_018518.1| Homo sapiens MCM10 minichromosome maintenance defi
cient 10 (S. cerevisiae) (MCM10), mRNA
GAATTCCCACCTGAGGAGTTCAAGGAACTGATGGACCTGCCGACGTGTGGAGCCAGGAACTTAAAACAAC

FIGURE 194 cont'd

```
ATTTAGCCAAAGCCACAGCTTCAGGGATTATGGGGAGCCCAAAACCAGCCATCAAGTCCATCTCGGCCTC
AGCACTCTTGAAGCAACAGAAGCAGCGGATGTTGGAGATGAGGAGAAGGAAATCAGAAGAAATACAGAAG
CGATTTCTGCAGAGCTCAAGTGAAGTTGAGAGCCCAGCTGTGCCATCTTCATCAAGACAGCCCCCTGCTC
AGCCTCCACGGACAGGATCCGAGTTCCCCAGGCTGGAGGGAGCCCCGGCCACAATGACGCCCAAGCTGGG
GCGAGGTGTCTTGGAAGGAGATGATGTTCTCTTTTATGATGAGTCACCACCACCAAGACCAAAACTGAGT
GCTTTAGCAGAAGCCAAAAAGTTAGCTGCTATCACCAAATTAAGGGCAAAAGGCCAGGTTCTTACAAAAA
CAAACCCAAACAGCATTAAGAAGAAACAAAAGGACCCTCAGGACATCCTGGAGGTGAAGGAACGTGTAGA
AAAAAACACCATGTTTTCTTCTCAAGCTGAGGATGAATTGGAGCCTGCCAGGAAAAAAGGAGAGAACAA
CTTGCCTATCTGGAATCTGAGGAATTTCAGAAAATCCTAAAAGCAAAATCAAAACACACAGGCATCCTGA
AAGAGGCCGAGGCTGAGATGCAGGAGCGCTACTTTGAGCCACTGGTGAAAAAAGAACAAATGGAAGAAAA
GATGAGAAACATCAGAGAAGTGAAGTGCCGTGTCGTGACATGCAAGACGTGCGCCTATACCCACTTCAAG
CTGCTGGAGACCTGCGTCAGTGAGCAGCATGAATACCACTGGCATGATGGTGTGAAGAGGTTTTTCAAAT
GTCCCTGTGGAAACAGAAGCATCTCCTTGGACAGACTCCCGAACAAGCACTGCAGTAACTGTGGCCTCTA
CAAATGGGAACGGGACGGAATGCTAAAGGAAAAGACTGGTCCAAAGATAGGAGGAGAAACTCTGTTACCA
AGAGGAGAAGAACATGCTAAATTTCTGAACAGCCTTAAATAACCCGAACTTCAGACATTTTCCCACAGAC
TTCCTGGCCTCCTGTGACTCTGGAAAGCAAAGGATTGGCTGTGTATTGTCCATTGATTCCTGATTGACGC
CGTCAAAAACAAATGCTTGTTAAGCCCATAAGCTTTGCCTGCTTACTTTCTGCCATTGGGTTGGTTTGAT
ACCACATTTAACATTGACATTTAAGTGGAAAACCAAGTTATCATTGTCTTTTCTAAGCTCAGTGTGGATG
ATTGCATTACTTCATTCACTGAAGTTTTTGCCCAAAAATTGGAAGGTAAACAGAGAGCTATGTTTCTGTA
TCTTTTGGTTATAGAGTGTTCACTTCTTTATCATAACAAAATTCTAGTGTTTATACGAACACCCAGAGGC
AAAAGAATTTGGCTTAATTCTCACTCCAGGTAAGTAGCTTAACTTCTGGGCTTCAGTTTTCTCATCTGTA
AAATCAGGAAGATTGGACTAAGTGATCCTGAAATGTATTTTTTAGCACTGGATTTCTACAAATAATAAAA
CTTTCCCATCTAAAAAAAAAAAAAAAAAAAAAAAAAAAAAAAAAAAAA
```

FIGURE 195
SEQ ID NO: 187
Genbank ID       : AK022548.1
Unigene ID(#167) : Hs.74369
Unigene name     :        integrin, alpha 7 ITGA7
>gi|10434001|dbj|AK022548.1|  Homo   sapiens   cDNA   FLJ12486   fis,   clone
NT2RM2000566
, highly similar to Homo sapiens integrin alpha-7 mRNA

```
AGTGTTCGGAGCCAGGGGCCTGGGGGCAAGATTGTTACCTGTGCACACCGATATGAGGCAAGGCAGCGAG
TGGACCAGATCCTGGAGACGCGGGATATGATTGGTCGCTGCTTTGTGCTCAGCCAGGACCTGGCCATCCG
GGATGAGTTGGATGGTGGGGAATGGAAGTTCTGTGAGGGACGCCCCCAAGGCCATGAACAATTTGGGTTC
TGCCAGCAGGGCACAGCTGCCGCCTTCTCCCCTGATAGCCACTACCTCCTCTTTGGGGCCCCAGGAACCT
ATAATTGGAAGGGGTTGCTTTTTGTGACCAACATTGATAGCTCAGACCCCGACCAGCTGGTGTATAAAAC
TTTGGACCCTGCTGACCGGCTCCCAGGACCAGCCGGAGACTTGGCCCTCAATAGCTACTTAGGCTTCTCT
ATTGACTCGGGGAAAGGTCTGGTGCGTGCAGAAGAGCTGAGCTTTGTGGCTGGAGCCCCCCGCGCCAACC
ACAAGGGTGCTGTGGTCATCCTGCGCAAGGACAGCGCCAGTCGCCTGGTGCCCGAGGTTATGCTGTCTGG
GGAGCGCCTGACCTCCGGCTTTGGCTACTCACTGGCTGTGGCTGACCTCAACAGTGATGGCTGGCCAGAC
CTGATAGTGGGTGCCCCCTACTTCTTTGAGCGCCAAGAAGAGCTGGGGGGTGCTGTGTATGTGTACTTGA
ACCAGGGGGGTCACTGGGCTGGGATCTCCCCTCTCCGGCTCTGCGGCTCCCCTGACTCCATGTTCGGGAT
CAGCCTGGCTGTCCTGGGGGACCTCAACCAAGATGGCTTTCCAGATATTGCAGTGGGTGCCCCCTTTGAT
GGTGATGGGAAAGTCTTCACCTACCATGGGAGCAGCCTGGGGGTTGTCGCCAAACCTTCACAGGTGCTGG
AGGGCGAGGCTGTGGGCATCAAGAGCTTCGGCTACTCCCTGTCAGGCAGCTTGGATATGGATGGGAACCA
ATACCCTGACCTGCTGGTGGGCTCCCTGGCTGACACCGCAGTGCTCTTCAGGGCCAGACCCATCCTCCAT
GTCTCCCATGAGGTCTCTATTGCTCCACGAAGCATCGACCTGGAGCAGCCCAACTGTGCTGGCGGCCACT
CGGTCTGTGTGGACCTAAGGGTCTGTTTCAGCTACATTGCAGTCCCCAGCAGCTATAGCCCTACTGTGGA
TGCGGACACAGACCGGAGGCTCCGGGGCCAGGTTCCCCGTGTGACGTTCCTGAGCCGTAACCTGGAAGAA
CCCAAGCACCAGGCCTCGGGCACCGTGTGGCTGAAGCACCAGCATGACCGAGTCTGTGGAGACGCCATGT
TCCAGCTCCAGGAAAATGTCAAAGACAAGCTTCGGGCCATTGTAGTGACCTTGTCCTACAGTCTCCAGAC
CCCTCGGCTCCGGCGACAGGCTCCTGGCCAGGGGCTGCCTCCAGTGGCCCCCATCCTCAATGCCCACCAG
CCCAGCACCCAGCGGGCAGAGATCCACTTCCTGAAGCAAGGCTGTGGTGAAGACAAGATCTGCCAGAGCA
ATCTGCAGCTGGTCCGCGCCCGCTTCTGTACCCGGGTCAGCGACACGGAATTCCAACCTCTGCCCATGGA
TGTGGATGGAACAACAGCCCTGTTTGCACTGAGTGGGCAGCCAGTCATTGGCCTGGAGCTGATGGTCACC
AACCTGCCATCGGACCCAGCCCAGCCCCAGGCTGATGGGGATGATGCCCATGAAGCCCAGCTCCTGGTCA
TGCTTCCTGACTCACTGCACTACTCAGGGGTCCGGGCCCTGGACCCTGCGGAGAAGCCACTCTGCCTGTC
CAATGAGAATGCCTCCCATGTTGAGTGTGAGCTGGGGAACCCCATGAAGAGAGGTGCCCAGGTCACCTTC
TACCTCATCCTTAGCACCTCCGGGATCAGCATTGAGACCACGGAACTGGAGGTAGAGCTGCTGTTGGCCA
```

FIGURE 195 con'd

```
CGATCAGTGAGCAGGAGCTGCATCCAGTCTCTGCACGAGCCCGTGTCTTCATTGAGCTGCCACTGTCCAT
TGCAGGAATGGCCATTCCCCAGCAACTCTTCTTCTCTGGTGTGGTGAGGGGCGAGAGAGCCATGCAGTCT
GAGCGGGATGTGGGCAGCAAGGTCAAGTATGAGGTCACGGTTTCCAACCAAGGCCAGTCGCTCAGAACCC
TGGGCTCTGCCTTCCTCAACATCATGTGGCCTCATGAGATTGCCAATGGGAAGTGGTTGCTGTACCCAAT
GCAGGTTGAGCTGGAGGGCGGGCAGGGGCCTGGGCAGAAAGGGCTTTGCTCTCCCAGGCCCAACATCCTC
CACCTGGATGTGGACAGTAGGGATAGGAGGCGGCGGGAGCTGGAGCCACCTGAGCAGCAGGAGCCTGGTG
AGCGGCAGGAGCCCAGCATGTCCTGGTGGCCAGTGTCCTCTGCTGAGAAGAAGAAAAACATCACCCTGGA
CTGCGCCCGGGGCACGGCCAACTGTGTGGTGTTCAGCTGCCCACTCTACAGCTTTGACCGCGCGGCTGTG
CTGCATGTCTGGGCCGTCTCTGGAACAGCACCTTTCTGGAGGAGTACTCAGCTGTGAAGTCCCTGGAAG
TGATTGTCCGGGCCAACATCACAGTGAAGTCCTCCATAAAGAACTTGATGCTCCGAGATGCCTCCACAGT
GATCCCAGTGATGGTATACTTGGACCCCATGGCTGTGGTGGCAGAAGGAGTGCCCTGGTGGGTCATCCTC
CTGGCTGTACTGGCTGGGCTGCTGGTGCTAGCACTGCTGGTGCTGCTCCTGTGGAAGATGGGATTCTTCA
AACGGGCGAAGCACCCCGAGGCCACCGTGCCCAGTACCATGCGGTGAAGATTCCTCGGGAAGACCGACA
GCAGTTCAAGGAGGAGAAGACGGGCACCATCCTGAGGAACAACTGGGGCAGCCCCCGGCAGGAGGGCCCG
GATGCACACCCCATCCTGGCTGCTGACGGGCATCCCGAGCTGGGCCCCGATGGGCATCCAGGGCCAGGCA
CCGCCTAGGTTCCCATGTCCCAGCCTGGCCTGTGGCTGCCCTCCATCCCTTCCCAGAGATGGCTCCTTG
GGATGAAGAGGGTAGAGTGGGCTGCTGGTGTCGCATCAAGATTTGGCAGGATCGGCTTCCTCAGGGGCAC
AGACCTCTCCCACCCACAAGAACTCCTCCCACCCAACTTCCCCTTAGAGTGCTGTGAGATGAGAGTGGGT
AAATCAGGGACAGGGCCATGGGGTAGGGTGAGAAGGGCAGGGGTGTCCTGATGCAAAGGTGGGGAGAAGG
GATCCTAATCCCTTCCTCTCCCATTCACCCTGTGTAACAGGACCCCAAGGACCTGCCTCCCCGGAAGTGC
CTTAACCTAGAGGGTCGGGGAGGAGGTTGTGTCACTGACTCAGGCTGCTCCTTCTCTAGTTTCCCCTCTC
ATCTGACCTTAGTTTGCTGCCATCAGTCTAGTGGTTTCGTGGTTTCGTCTATTTATTAAAAAATATTTGA
GAAC
```

FIGURE 196
SEQ ID NO: 188
Genbank ID         : AU148391
Unigene ID(#167)   : Hs.181245
Unigene name       :     MRNA;     cDNA     DKFZp686B15184     (from     clone DKFZp686B15184)
>gi|11009912|gb|AU148391.1|AU148391 AU148391 NT2RM4 Homo sapiens cDNA clone NT2
RM4000200 3', mRNA sequence

```
ATAATAAAGTCTGTTTATTACAGCAATTAACAGAGCAGCGTTTGCCGGCATGCTTTTCAGTGGCAACCAG
AAAAGTGCTTACTCCAGGTGCATAGATTCGGGAAACCATGCAACTTGAGCCAAAATGAAACCAATTAGAG
GCTTAGTAAATGGGTTCCAGCCACCCCAGGAAACTTAACCATCCACGAGTCAGTTCAGCCGAGGTAGAAC
CTCAGTGCAGGAATTTAGCATGATATAGATTGCTACTTTACAGAATTAATCCAGACCTGTCGCCAGGGTT
GTGGTCTTGAGGACGTGAAATGTATCCGCCCAACACAGCCACCCAGGTGCTGGGTTCAAATCTCGATAAA
CTACATAGGGGTATATAGGTGGGGAACGTTAGCACCATTGACTCTTAAGGGTCTCTTGCCACTGCCATGG
ANGTGGGGACATAAGGAGAGGACTAGAAGCTGGGCCNAAAGGGACNAGACNGAGAAAGAACCGAAATCCT
TCNTTAACCTGGCTTCAAAANCTGGANTGGAAAGTGGCCGCTTGATAGGGGTAAGAGGAATTCNTTTNAC
CTGGANAAA
```

FIGURE 197
SEQ ID NO: 189
Genbank ID         : N32557
Unigene ID(#167)   : Hs.192822
Unigene name       :     protein    phosphatase    1,    regulatory    (inhibitor) subunit 14C PPP1R14C
>gi|1152956|gb|N32557.1|N32557                                              yw86d02.s1
Soares_placenta_8to9weeks_2NbHP8to9W
Homo sapiens cDNA clone IMAGE:259107 3', mRNA sequence

```
GTAAGCAGCTCCATTTATTTGAGTAAATATCTTGTAAATAAATCATTGGTAAACAATACAAAATTAAATA
CATTTTCAAAAGCTTGCCAGTATACGCAAAATTCACAAACATAGTTTTTTTAAAAAATAAAATATGTTCA
GAGCACCCTTGATATAAAATGCCTGACCCCATCCTTGGACAAGGCCACCTGAAGACATCTTATGGTAGG
TGGGTTTCTGTGGGAGTCAGCGGGGGCCTCCTGGAGGGAAGGGTTTCTACTCTCACCTATTACCCATCCC
ACATTCCATCTGAATTTTGATCCTTCTCCAAAGAGCTGGGTAACTGAGAGGGCTAGAGCACGCCACCAGG
CCTAGCTCCAAGCACGGGGATCAGGGTGCACAATTAGGGCCAGGAGCACCCAGAGTCCTCAACACAAGCC
```

FIGURE 197 cont'd

ATTGAGAGAAGCCAGAAATGCAATCTCCACACTTCCAAACCAGCAACTCAGCTCCTAGAGCAACTGTCNT
GAGAGAATGTGAGGCTTTCTCACCTTGACACTTAACACTCGGNTTACTCCCACTGGGTCTGATACTACCC
AGGCACAGAAGCTACCAGAACCTATTTTTATT

FIGURE 198
SEQ ID NO: 190
Genbank ID          : BG324504
Unigene ID(#167)    : Hs.321127
Unigene name        :     solute     carrier    family    4,    sodium    bicarbonate
cotransporter, member 5 SLC4A5
>gi|13130941|gb|BG324504.1|BG324504    602422453F1    NIH_MGC_14    Homo    sapiens
cDNA cl
one IMAGE:4560493 5', mRNA sequence
GTGACCTCCTGACCTCTGCTGATTCCCCCCACCTCTGCCTCCCAAGTAGCGGGATTACAGGTGTGAGCCA
CTGTGTCTGACAAGAATTTATACTTAAGCATAGGAGATGGTTCTGGAAATTCTAAGAAATTCTGCTCTCA
GTAAGAGTAGAGGTTGGAGCTTTACCTCTTGGCAGTATCCCTTGGAAGGGAGCTCTGAGATTAAATGTAA
TCAAACACTTATGAGAGCTTTCTATGGACCAGGCACTACACTAGACGCTGGGAATTACAGAGGCAATTAC
CTGTCCTATACTCAAGGTGTTAATGATCTAGTGTCATTTTTCTTTAAAAAAGAAAGCACCTGCATTGTCA
TCTTGAGCAAATATAGTAACTCTAACCTCAAGGTTCAAGTGATTTACTCAAGGTTTAAATCATAGTTGTT
TGGAGAAAGTAAGTGTCAGATGCACTGTGGCTGTCAGGGTCATAGTAGGCATTTAATCAACATGGTTGGT
GTTCATTAAATGTGGATTGAAGATAAAATGACTGATCTTAAGTTTCATGAGGAATAGGTTGCTTCATTGA
AACTGGTTTTTATCTTCCCAAATAGTTTTCAATCATTCCTTTAAAGTACTAGGTTGATTAATATTGGCAA
AGTGTAATGTAAAATGTGACTTACCTCTGTCTAACCTGTATTGTCACATGAATGGGAGTTTGACTTTGGG
GAATAACCTCGAAATTTGCGGGAGGACCCAAAAAAAAAAAAAACCGGAGGATAATGTGGGGGGAAAAAAG
TAAGAAGG

FIGURE 199
SEQ ID NO: 191
Genbank ID          : L38019.1
Unigene ID(#167)    : Hs.149900
Unigene name        :     inositol    1,4,5-triphosphate    receptor,    type    1
        ITPR1
>gi|1464750|gb|L38019.1|HUMITR    Homo    sapiens    (clone    HUM-IP3R1)    inositol
1,4,5-tr
isphosphate receptor type 1 mRNA, complete cds
CGGGAGAGAAAGCGCACGCCGAGAGGAGGTGTGGGTGTTCCGCTTCCATCCTAACGGAACGAGCTCCCTC
TTCGCGGACATGGGATTACCCAGCGGCTGCTAACCCCTCTCCTCGCCCTGCTCCCCCAAACCGGCGTGGC
TCCCCGGGCACCAAGGAGCTGACTACAGAGGAGCAGGATTTGCACCCCTCGCTGGGCTTGCTTTGGCAAC
AGAGTGCCTGACCCAGGTCAGGATTTTCAAGAAAGACATGTCTGACAAAATGTCTAGCTTCCTACATATT
GGAGACATTTGTTCTCTGTACGCGGAGGGATCGACAAATGGATTTATTAGCACCTTGGGCCTGGTTGATG
ATCGTTGTGTTGTACAGCCAGAAACCGGGGACCTTAACAATCCACCTAAGAAATTCAGAGACTGCCTCTT
TAAGCTATGTCCCATGAACCGCTACTCTGCCCAAAAGCAGTTCTGGAAAGCCGCTAAGCCTGGGGCCAAC
AGCACCACAGACGCAGTGCTACTCAACAAACTGCACCACGCTGCAGACTTGGAAAAGAAGCAGAATGAGA
CAGAAAACAGGAAATTGCTGGGGACCGTAATCCAGTATGGCAATGTGATCCAGCTCCTGCATTTGAAAAG
TAATAAATACCTAACAGTGAATAAGAGGCTTCCTGCTCTGTTGGAGAAGAATGCCATGAGAGTCACATTG
GACGAGGCTGGAAATGAAGGGTCCTGGTTTTATATTCAGCCATTCTACAAGCTGCGATCCATTGGAGACA
GCGTGGTCATAGGTGACAAGGTGGTTCTGAACCCCGTCAATGCTGGTCAGCCCCTACATGCTAGCAGCCA
TCAACTGGTAGATAACCCAGGCTGCAATGAGGTCAATTCCGTCAACTGCAATACAAGCTGGAAAATAGTC
CTTTTCATGAAATGGAGTGATAACAAAAGACGACATATTAAAGGGGGTGACGTGGTGAGGCTGTTTCATG
CTGAGCAGGAGAAGTTTCTCACCTGTGACGAACACAGGAAGAAGCAGCACGTCTTCCTGAGAACCACGGG
CCGGCAGTCGGCCACATCTGCCACCAGTTCAAAAGCCCTGTGGGAGGTGGAGGTGGTCCAGCATGACCCA
TGTCGGGGCGGAGCAGGGTATTGGAACAGCCTTTTCCGTTTCAAGCATCTGGCCACGGGGCATTACTTGG
CAGCAGAGGTAGACCCTGACTTTGAGGAAGAATGCCTGGAGTTTCAGCCCTCAGTGGACCCTGATCAGGA
CGCCTCTCGAAGTAGGTTGCGGAATGCCCAAGAAAGATGGTATACTCCCTGGTCTCTGTGCCTGAAGGC
AATGACATCTCCTCCATTTTCGAGCTAGATCCCACCACTCTGCGTGGAGGTGACAGCCTTGTCCCAAGGA
ACTCTTATGTTCGGCTCAGACACCTATGTACTAATACCTGGGTTCACAGCACAAATATTCCTATTGACAA
GGAAGAAGAAAAGCCCGTGATGCTGAAAATTGGCACCTCTCCTGTGAAGGAGGATAAGGAAGCATTTGGC
ATAGTTCCGGTTTCTCCTGCTGAAGTTCGGGACCTGGACTTTGCCAATGATGCCAGCAAGGTGCTGGGCT FIGURE 199 cont'd

```
CCATTGCTGGGAAGCTAGAGAAGGGCACCATCACCCAGAATGAAAGGAGGTCTGTAACCAAGCTGCTAGA
AGATTTGGTTTACTTCGTCACTGGTGGAACTAATTCTGGTCAAGATGTTCTCGAAGTTGTCTTCTCCAAG
CCCAACAGAGAACGGCAGAAACTGATGAGAGAACAGAATATTCTCAAGCAGATCTTCAAGTTGTTACAAG
CCCCATTCACAGACTGCGGTGATGGCCCAATGCTTCGGCTGGAAGAGCTCGGGGACCAGCGGCACGCTCC
TTTCAGACACATCTGCCGGCTCTGCTACAGGGTGCTGAGACACTCGCAGCAAGACTACAGGAAGAACCAG
GAGTATATAGCCAAGCAGTTTGGCTTCATGCAGAAGCAGATTGGCTATGATGTGTTGGCTGAAGACACTA
TCACTGCCCTGCTCCACAATAATCGGAAACTCCTGGAAAAACACATTACCGCGGCAGAGATTGACACATT
TGTCAGCCTGGTGCGAAAGAACAGGGAGCCCAGATTCTTAGATTACCTCTCCGACCTCTGTGTCTCCATG
AACAAATCAATTCCAGTGACCCAGGAACTGATATGTAAAGCTGTGCTGAACCCCACCAACGCTGACATCC
TGATTGAGACCAAATTGGTTCTTTCTCGTTTTGAATTTGAAGGTGTCTCTTCCACTGGAGAGAATGCTCT
GGAGGCAGGAGAAGACGAGGAAGAGGTGTGGCTGTTTTGGAGGGACAGCAACAAAGAGATTCGCAGCAAG
AGTGTGAGGGAATTGGCTCAGGATGCTAAAGAAGGGCAGAAGGAGGACCGAGACGTTCTCAGCTACTACA
GATATCAGCTGAACCTCTTTGCGAGGATGTGTCTGGACCGCCAATACCTGGCCATCAACGAAATCTCAGG
CCAGCTGGATGTCGATCTCATTCTCCGCTGCATGTCTGACGAGAACCTGCCCTATGACCTCAGGGCGTCC
TTCTGCCGCCTCATGCTTCACATGCATGTGGACCGAGATCCCCAGGAACAAGTCACCCCCGTGAAATATG
CCCGCCTCTGGTCGGAGATTCCCTCGGAGATCGCCATTGACGACTATGATAGTAGTGGAGCTTCCAAAGA
TGAAATTAAGGAGAGATTTGCTCAGACCATGGAGTTTGTGGAGGAGTATTTAAGAGATGTGGTTTGTCAG
AGGTTCCCTTTCTCTGATAAAGAGAAGAATAAGCTTACGTTTGAGGTTGTAAATTTAGCTAGGAATCTCA
TATACTTTGGTTTCTACAACTTCTCTGACCTTCTACGATTAACTAAGATCCTTCTGGCCATATTGGACTG
TGTACATGTGACAACAATCTTCCCCATTAGCAAGATGGCGAAAGGAGAAGAGAATAAAGGCAGTAACGTG
ATGAGATCTATTCATGGCGTGGGAGAGCTGATGACCCAGGTGGTGCTCCGGGGAGGAGGCTTTTTGCCCA
TGACTCCCATGGCTGCTGCCCCTGAAGGCAATGTGAAGCAGGCAGAGCCTGAGAAGGAGGACATCATGGT
CATGGACACCAAGCTGAAGATCATTGAGATACTCCAGTTTATTTTGAATGTGAGGTTGGATTATAGGATC
TCCTGCCTCCTGTGTATATTTAAGCGAGAGTTTTGGATGAAAGCAATTCCCAGGACTTCAGAAACATCCT
CCGGAAACAGCAGCCAAGAAGGGCCAAGTAATGTACCAGGTGCTCTTGACTTTGAACACATTGAAGAACA
AGCAGAAGGCATCTTTGGAGGAAGTGAGGAGAACACCCCACTGGACTTGGATGACCACGGCGGCAGAACC
TTTCTCCGTGTCCTGCTCCACTTGACGATGCATGACTACCCACCCCTGGTGTCAGGGCCCTGCAGCTCC
TCTTCCGGCACTTCAGCCAGAGGCAGGAGGTGCTCCAGGCCTTCAAACAGGTTCAACTGCTGGTTACCAG
CCAAGATGTGGACAACTACAAACAGATCAAACAAGACTTGGATCAACTGAGGTCCATCGTGGAAAAGTCA
GAGCTTTGGGTGTACAAAGGGCAGGGCCCCGATGAGACTATGGATGGTGCATCTGGAGAAAATGAACATA
AGAAAACGGAGGAGGGAAATAACAAGCCACAAAAGCATGAAAGCACCAGCAGCTACAACTACAGAGTGGT
CAAAGAGATTTTGATTCGGCTTAGCAAACTCTGTGTTCAAGAGAGTGCCTCAGTGAGAAAGAGCAGGAAG
CAGCAACAGCGTCTGCTCCGGAACATGGGCGCGCACGCCGTGGTGCTGGAGCTGCTGCAGATTCCCTATG
AGAAGGCCGAAGATACCAAGATGCAAGAGATAATGAGGTTGGCTCATGAATTTTTGCAGAATTTCTGCGC
AGGCAACCAGCAGAATCAAGCTTTGCTACATAAACACATAAACCTGTTTCTCAACCCAGGGATCCTGGAG
GCAGTAACCATGCAGCACATCTTCATGAACAATTTCCAGCTTTGCAGTGAGATCAACGAGAGAGTTGTTC
AGCACTTCGTTCACTGCATAGAGACTCACGGTCGGAATGTCCAGTATATAAAGTTCTTACAGACAATTGT
CAAGGCAGAAGGGAAATTTATTAAAAAATGCCAAGACATGGTTATGGCCGAGCTGGTCAATTCGGGAGAG
GATGTCCTCGTGTTCTACAACGACAGAGCCTCTTTCCAGACTCTGATCCAGATGATGCGGTCAGAACGGG
ATCGGATGGATGAGAACAGCCCTCTCATGTACCACATCCACTTGGTCGAGCTCCTGGCTGTGTGCACGGA
GGGTAAGAATGTCTACACAGAGATCAAGTGCAACTCCCTGCTCCCGCTGGATGACATCGTTCGCGTTGTG
ACCCACGAGGACTGCATCCCTGAGGTTAAAATTGCATACATTAACTTCCTGAATCACTGCTATGTGGATA
CAGAGGTGGAAATGAAGGAGATTTATACCAGCAATCACATGTGGAAATTGGTTGAGAATTTCCTTGTAGA
CATCTGCAGGGCCTGTAACAACACTAGTGACAGGAAACATGCAGACTCGATTTTGGAGAAGTATGTCACC
GAAATCGTCATGAGTATTGTTACTACTTTCTTCAGCTCTCCCTTCTCAGACCAGAGTACGACTTTGCAGA
CTCGCCAGCCTGTCTTTGTGCAACTGCTGCAAGGCGTGTTCAGGGTTTACCACTGCAACTGGTTAATGCC
AAGCCAAAAAGCCTCCGTGGAGAGCTGTATTCGGGTGCTGTCTGATGTAGCCAAGAGCCGGGCCATTGCC
ATTCCCGTGGACCTGGACAGCCAAGTCAACAACCTCTTTCTCAAGTCCCACAGCATTGTGCAGAAAACAG
CCATGAACTGGCGGCTCTCAGCCCGCAATGCCGCACGCAGGGACTCTGTTCTGGCAGCTTCCAGAGACTA
CCGGAATATCATTGAGAGATTGCAGGACATCGTCTCCGCGCTGGAGGACCGTCTCCAGGCCCCTGGTGCAG
GCAGAGTTATCTGTGCTCGTGGATGTTCTCCACAGACCCGAGCTGCTTTTCCCAGAACACAGACGCCA
GAAGGAAATGTGAAAGTGGCGGTTTCATTTGCAAGTTAATAAAGCATACAAAACAGCTGCTAGAAGAAAA
TGAAGAGAAGCTCTGCATTAAGGTCCTACAGACCCTGAGGGAAATGATGACCAAAGATAGAGGCTATGGA
GAAAAGGGTGAGGCGCTCAGGCAAGTTCTGGTCAACCGTTACTATGGAAACGTCAGACCTTCGGGACGAA
GAGAGAGCCTTACCAGCTTTGGCAATGGCCCACTGTCAGCAGGAGGACCCGGCAAGCCCGGGGAGGAGG
GGGAGGTTCCGGATCCAGCTCTATGAGCAGGGTGAGATGAGTCTGGCCGAGGTTCAGTGTCACCTTGAC
AAGGAGGGGGCTTCCAATCTAGTTATCGACCTCATCATGAACGTATCCAGTGACCGAGTGTTCCATGAAA
GCATTCTCCTGGCCATTGCCCTTCTGGAAGGAGGCAACACCACCATCCAGCACTCCTTTTTCTGTCGCTT
GACAGAAGATAAGAAGTCAGAGAAATTCTTTAAGGTGTTTTATGACCGGATGAAGGTGGCCCAGCAAGAA
ATCAAAGCAACAGTGACAGTGAACACCAGTGACTTGGGAAATAAAAAGAAAGACGATGAGGTAGACAGGG
ATGCCCCATCACGGAAAAAAGCTAAAGAGCCCACAACACAGATAACAGAAGAGGTCCGGGATCAGCTCCT
```

FIGURE 199 cont'd

```
GGAGGCCTCCGCTGCCACCAGGAAAGCCTTCACCACTTTCAGGAGGGAGGCTGATCCCGACGACCACTAC
CAGCCTGGAGAGGGCACCCAGGCCACTGCCGACAAGGCCAAGGACGACCTGGAGATGAGCGCGGTCATCA
CCATCATGCAGCCCATCCTCCGCTTCCTTCAGCTCCTGTGTGAAAACCACAACCGAGACCTGCAGAACTT
CCTCCGTTGCCAAAATAACAAGACCAACTACAATTTGGTATGTGAGACCCTGCAGTTTCTGGACTGTATT
TGTGGAAGCACAACTGGAGGCCTTGGTCTTCTGGGCTTGTATATAAATGAAAAGAACGTAGCGCTTATCA
ACCAAACCCTGGAAAGTCTGACCGAATACTGTCAAGGACCTTGCCATGAGAACCAGAACTGCATAGCCAC
CCATGAATCCAATGGCATTGACATCATCACAGCCCTGATCCTCAATGATATCAATCCTTTGGGAAAGAAG
AGGATGGACCTTGTGTTAGAACTGAAGAACAATGCCTCGAAGTTGCTCCTGGCCATCATGGAAAGCAGGC
ACGACAGTGAAAACGCAGAGAGGATACTTTATAACATGAGGCCCAAGGAACTGGTGGAAGTGATCAAGAA
AGCCTACATGCAAGGTGAAGTGGAATTTGAGGATGGAGAAAACGGTGAGGATGGGGCGGCGTCCCCCAGG
AACGTGGGGCACAACATCTACATATTAGCCCATCAGTTGGCTCGGCATAACAAAGAACTTCAGAGCATGC
TGAAACCTGGTGGCCAAGTGGACGGAGATGAAGCCCTGGAGTTTTATGCCAAGCACACGGCGCAGATAGA
GATTGTCAGATTAGACCGAACAATGGAACAGATAGTCTTTCCCGTGCCCAGCATATGTGAATTCCTAACC
AAGGAGTCAAAACTACGAATTTACTATACTACAGAGAGAGACGAACAAGGCAGCAAAATCAATGATTTCT
TTCTGCGGTCTGAAGACCTCTTCAATGAAATGAATTGGCAGAAGAAACTGAGAGCCCAGCCCGTGTTGTA
CTGGTGTGCCCGCAACATGTCTTTCTGGAGCAGCATTTCGTTTAACCTGGCCGTCCTGATGAACCTGCTG
GTGGCGTTTCTCTACCCGCTTAAGGGAGTCCGAGGAGGAACCCTGGAGCCCCACTGGTCGGGACTCCTGT
GGACAGGCATGCTCATCTCTCTGGGCATCGTCATTGGCCTCCCCAATCCCCATGGCATCCGGGCCTTAAT
TGGCTCCACTATTCTACGACTGATATTTTCAGTCGGGTCACAACCCGCGTTGTTTCTTCTGGGCGCTTTC
AATGTATGCAAGAAAATCATCTTTCTAATGAGCTTTGTGGGCAACTGTGGGACATTCACAAGAGGCTACC
GAGCCATGGTTCTGGTTCTGGATGTCGAGTTCCTCTATCATTTGTTGTATCTGGTGATCTGTGCCATGGG
GCTCTTTGTCCATGTATTCTTCTACAGTCTGCTGCTTTTAGATTTAGTGTACAGAGAAGAGTCTTTGCTT
AATGTCATTAAAAGTGTCACTCGCAATGGACGGTCCATCATCCTGACAGCAGTTCTGGCTCTGATCCTCG
TTTACCTGTTCTCAATAGTGGGCTATCTTTTCTTCAAGGATGACTTTATCTTGGAAGTAGATAGGCTGCC
CAATGAAACAGCTGTTCCAGAAACCGGCGAGAGTTTGGCAAGCGAGTTCCTGTTCTCCGATGTGTGTAGG
GTGGAGAGTGGGGAGAACTGCTCCTCTCCTGCACCCAGAGAAGAGCTGGTCCCTGCAGAAGAGACGGAAC
AGGATAAAGAGCACACATGTGAGACGCTGCTGATGTGCATTGTCACCGTGCTGAGTCACGGGCTGCGGAG
CGGGGGTGGAGTAGGAGATGTACTCAGGAAGCCGTCCAAAGAGGAACCCCTGTTTGCTGCTAGAGTTATT
TATGACCTCTTGTTCTTCTTCATGGTCATCATCATTGTTCTTAACCTGATTTTTGGGGTTATCATTGACA
CTTTTGCTGACCTGAGGAGTGAGAAGCAGAAGAAGGAAGAGATCTTGAAGACCACGTGCTTTATCTGTGG
CTTGGAAAGAGACAAGTTTGACAACAAGACTGTCACCTTTGAAGAGCACATCAAGGAAGAACACAACATG
TGGCACTATCTGTGCTTCATCGTCCTGGTGAAAGTAAAGGACTCCACCGAATATACTGGGCCTGAGAGTT
ACGTGGCAGAAATGATCAAGGAAAGAAACCTTGACTGGTTCCCCAGGATGAGAGCCATGTCATTGGTCAG
CAGTGATTCTGAAGGAGAACAGAATGAGCTGAGAAACCTGCAGGAGAAGCTGGAGTCCACCATGAAACTT
GTCACGAACCTTTCTGGCCAGTTGTCGGAATTAAAGGATCAGATGACAGAACAAAGGAAGCAGAAACAAA
GAATGGGTCTTCTTGGACATCCTCCTCACATGAATGTCAACCCACAACAACCAGCATAAGCAAATGAAAG
AAAGGAATTGTATTTACCTTTTATAATTATTATTAGTGTGGGTATGGCTAATGAGTTCTGATTCACCCAC
GAAGGTTACATTTATGCTGAATACATTTGTAAATACTCAGTTTTATACTGTATGTATATGATTGCTACTC
TAAAGGTTTGGATATATGTATTGTAATTAGAATTGTTGGCATGATGACATTTCATTTGTGCCAAAAATAT
TAAAAATGCCTTTTTTGGAAGGACTAACAGAAAGCACCTGATTTGCACTTGAACCAGTCCG
```

FIGURE 200
SEQ ID NO: 192
Genbank ID         : NM_002888.1
Unigene ID(#167)   : Hs.82547
Unigene name       :     retinoic    acid    receptor    responder    (tazarotene
induced) 1   RARRES1
>gi|4506424|ref|NM_002888.1| Homo sapiens retinoic acid receptor responder
(taz
arotene induced) 1 (RARRES1), mRNA

```
CCACGTCCGGGGTGCCGAGCCAACTTTCCTGCGTCCATGCAGCCCGCCGGCAACGGCTGCCCGCTCCCT
GGTCCGGGCCCAGGGGCCCGCGCCCCACCGCCCCGCTGCTCGCGCTGCTGCTGTTGCTCGCCCCGGTGGC
GGCGCCCGCGGGGTCCGGGGGCCCCGACGACCCTGGGCAGCCTCAGGATGCTGGGGTCCCGCGCAGGCTC
CTGCAGCAGAAGGCGCGCGCGGCGCTTCACTTCTTCAACTTCCGGTCCGGCTCGCCCAGCGCGCTGCGAG
TGCTGGCCGAGGTGCAGGAGGGCCGCGCGTGGATTAATCAAAAGAGGGATGTAAAGTTCACGTGGTCTT
CAGCACAGAGCGCTACAACCCAGAGTCTTTACTTCAGGAAGGTGAGGGACGTTTGGGGAAATGTTCTGCT
CGAGTGTTTTTCAAGAATCAGAAACCCAGACCAACCATCAATGTAACTTGTACACGGCTCATCGAGAAAA
AGAAAAGACAACAAGAGGATTACCTGCTTTACAAGCAAATGAAGCAACTGAAAAACCCCTTGGAAATAGT
CAGCATACCTGATAATCATGGACATATTGATCCCTCTCTGAGACTCATCTGGGATTTGGCTTTCCTTGGA
AGCTCTTACGTGATGTGGGAAATGACAACACAGGTGTCACACTACTACTTGGCACAGCTCACTAGTGTGA
```

FIGURE 200 cont'd

```
GGCAGTGGGTAAGAAAAACCTGAAAATTAACTTGTGCCACAAGAGTTACAATCAAAGTGGTCTCCTTAGA
CTGAATTCATGTGAACTTCTAATTTCATATCAAGAGTTGTAATCACATTTATTTCAATAAATATGTGAGT
TCCTGC
```

FIGURE 201
SEQ ID NO: 193
```
Genbank ID         : AW971134
Unigene ID(#167)   : Hs.212787
Unigene name       :      KIAA0303 protein  KIAA0303
>gi|8160979|gb|AW971134.1|AW971134  EST383221  MAGE  resequences,  MAGL  Homo
sapien
s cDNA, mRNA sequence
TTGAATTTAGGTGACACTATAGAAGAGCTATGACGTCGCATGCACGCGTACGTAAGCTTGGATCCTCTAG
AGCGGCCGCCTACTACTACTAAAATTCGCGCCGCGTCGACTTTTTTTTTTTTTTGGCTTTTTTTTTCCTT
TTTGTGGAGAACGGGGTCTCACTATATTGCCCGGGCTGGTCTTGAACTGCTGGGCTTACGCTATCTTCTT
GCCTCTGCCTCTCTAAGTGCTGGGATTAGAGGCGTGAGCCACTATGCCTGGCAGTTATGAGACTTTACAA
TCCTACAGTCAACTGTCCGCAGATATCTTTGCTTATGTCAAGGACTGAGCCTTCTCCTTTTGTTGTACTC
TGTGTAATCCCTCGGAGATGACTCTGTACACAGTGAAGCTCGCGCTCTTCATCCTGAGTTGAAAGCAATG
AGTGATACCTTTGCAGCCTGGCATTGAGCCAGGTGAGAGACGTTCAAAGCCAGGTCATCATATAAGTAGC
GTCG
```

FIGURE 202
SEQ ID NO: 194
```
Genbank ID         : AI380207
Unigene ID(#167)   : Hs.368802
Unigene name       :      Similar to zinc finger protein Sp5  (LOC375292),
mRNA
>gi|4190060|gb|AI380207.1|AI380207  tf98h02.x1  NCI_CGAP_CLL1  Homo  sapiens
cDNA c
lone IMAGE:2107347 3', mRNA sequence
TTTTTTTTTTTTTTTTTTTTTCAACGGGGTCTTCCTGTAGTGACCCCTGAGTTAAAGTATTTATTTTCA
CGCTGCAACTGCTGATCACTTTACAGAGACATATCATGCTGTAGCTCTGCATGGAGCTGAAGACAAAAGC
AACATTTTTATTAATGTTATAATTATTATAATTATCTTTAACAAAGCTATTAAATAACCTGTACAAAGCC
CAAACCGGTCCTAGCGAAAACCCGAGCACTGTTTCAAATCTCCCAAGTTCCTTTCTATTCAGTTCAGCAG
CATTTCCTATATACAAGGCCAGCCCAGGGTGGTCCCCCGAAACTGTAGGTCTCCCTGACGGTGGGAACGG
TTTAGAGTTTGGAACCGCCCTGGCGTACGGCAGAGCTCCCAATTACAATCCAAATGCCCCAGCCCCAACC
CTACCTCCCCGCTCCTGGGAACTGGGTCCCTATGTCCGAAGGCAGCGGAAGTTGGAAGCCTGGCTCCATT
TTGGGAGGCAGGCAACGGA
```

FIGURE 203
SEQ ID NO: 195
```
Genbank ID         : AA744613
Unigene ID(#167)   : Hs.292925
Unigene name       :      KIAA1212    KIAA1212
>gi|2783377|gb|AA744613.1|AA744613  ny65f03.s1  NCI_CGAP_GCB1  Homo  sapiens
cDNA c
lone IMAGE:1283165 3', mRNA sequence
TTTTTTTTTTTTTTTTTTTTGATTATAATTTGGTTTATTTCTCTTTGACTCTCTATAAAAAAGAACT
GGAAAACTATTGTATTAACTGATTTCAAGTATAGAAGCCATCTTGAAGAAAAGACAGTTACTTGAGCTC
TTGAATTTATCAGATGATGAAAAGTGCAGAGAAGAAACAATAAATACAAATGTTCCTAGTCACTGTGTAA
ATCACATTTAAATTTGATGGGGTTTTCTAAGAATAACACTAAGTTTATAAGTATTAACAATCTTTTAAAT
CTGAAAAATGTTTTATAAATATGGGTATTAGTTAATATTTGTTATATAAAGTGTTGAATTATTAACTATT
TCTTTAAAACAGGACAGATGGCCTAATTAAATGACAAAAGAAAACAACATCTTTTTACATTTTCCCACTG
ATACTGTACATATGTAATATAAAGTACACATTCTGGAAGAAAAAAAGGAGTGA
```

FIGURE 204
SEQ ID NO: 196
Genbank ID        : NM_002591.1
Unigene ID(#167)  : Hs.1872
Unigene name      :      phosphoenolpyruvate    carboxykinase    1    (soluble)
   PCK1
>gi|4505638|ref|NM_002591.1| Homo sapiens phosphoenolpyruvate carboxykinase 1 (
soluble) (PCK1), mRNA
TGGGAACACAAACTTGCTGGCGGGAAGAGCCCGGAAAGAAACCTGTGGATCTCCCTTCGAGATCATCCAA
AGAGAAGAAAGGTGACCTCACATTCGTGCCCCTTAGCAGCACTCTGCAGAAATGCCTCCTCAGCTGCAAA
ACGGCCTGAACCTCTCGGCCAAAGTTGTCCAGGGAAGCCTGGACAGCCTGCCCCAGGCAGTGAGGGAGTT
TCTCGAGAATAACGCTGAGCTGTGTCAGCCTGATCACATCCACATCTGTGACGGCTCTGAGGAGGAGAAT
GGGCGGCTTCTGGGCCAGATGGAGGAAGAGGGCATCCTCAGGCGGCTGAAGAAGTATGACAACTGCTGGT
TGGCTCTCACTGACCCCAGGGATGTGGCCAGGATCGAAAGCAAGACGGTTATCGTCACCCAAGAGCAAAG
AGACACAGTGCCCATCCCCAAAACAGGCCTCAGCCAGCTCGGTCGCTGGATGTCAGAGGAGGATTTTGAG
AAAGCGTTCAATGCCAGGTTCCCAGGGTGCATGAAAGGTCGCACCATGTACGTCATCCCATTCAGCATGG
GGCCGCTGGGCTCACCTCTGTCGAAGATCGGCATCGAGCTGACGGATTCGCCCTACGTGGTGGCCAGCAT
GCGGATCATGACGCGGATGGGCACGCCCGTCCTGGAAGCACTGGGCGATGGGGAGTTTGTCAAATGCCTC
CATTCTGTGGGGTGCCCTCTGCCTTTACAAAAGCCTTTGGTCAACAACTGGCCCTGCAACCCGGAGCTGA
CGCTCATCGCCCACCTGCCTGACCGCAGAGAGATCATCTCCTTTGGCAGTGGGTACGGCGGGAACTCGCT
GCTCGGGAAGAAGTGCTTTGCTCTCAGGATGGCCAGCCGGCTGGCAGAGGAGGAAGGGTGGCTGGCAGAG
CACATGCTGATTCTGGGTATAACCAACCCTGAGGGTGAGAAGAAGTACCTGGCGGCCGCATTTCCCAGCG
CCTGCGGGAAGACCAACCTGGCCATGATGAACCCCAGCCTCCCCGGGTGGAAGGTTGAGTGCGTCGGGGA
TGACATTGCCTGGATGAAGTTTGACGCACAAGGTCATTTAAGGGCCATCAACCCAGAAAATGGCTTTTTC
GGTGTCGCTCCTGGGACTTCAGTGAAGACCAACCCCAATGCCATCAAGACCATCCAGAAGAACACAATCT
TTACCAATGTGGCCGAGACCAGCGACGGGGCGTTTACTGGGAAGGCATTGATGAGCCGCTAGCTTCAGG
CGTCACCATCACGTCCTGGAAGAATAAGGAGTGGAGCTCAGAGGATGGGGAACCTTGTGCCCACCCCAAC
TCGAGGTTCTGCACCCCTGCCAGCCAGTGCCCCATCATTGATGCTGCCTGGGAGTCTCCGGAAGGTGTTC
CCATTGAAGGCATTATCTTTGGAGGCCGTAGACCTGCTGGTGTCCCTCTAGTCTATGAAGCTCTCAGCTG
GCAACATGGAGTCTTTGTGGGGGCGGCCATGAGATCAGAGGCCACAGCGGCTGCAGAACATAAAGGCAAA
ATCATCATGCATGACCCCTTTGCCATGCGGCCCTTCTTTGGCTACAACTTCGGCAAATACCTGGCCCACT
GGCTTAGCATGGCCCAGCACCCAGCAGCCAAACTGCCCAAGATCTTCCATGTCAACTGGTTCCGGAAGGA
CAAGGAAGGCAAATTCCTCTGGCCAGGCTTTGGAGAGAACTCCAGGGTGCTGGAGTGGATGTTCAACCGG
ATCGATGGAAAAGCCAGCACCAACGTCACGCCCATAGGCTACATCCCCAAGGAGGATGCCCTGAACCTGA
AAGGCCTGGGGCACATCAACATGATGGAGCTTTTCAGCATCTCCAAGGAATTCTGGGACAAGGAGGTGGA
AGACATCGAGAAGTATCTGGTGGATCAAGTCAATGCCGACCTCCCCTGTGAAATCGAGAGAGAGATCCTT
GCCTTGAAGCAAAGAATAAGCCAGATGTAATCAGGGCCTGAGAATAAGCCAGATGTAATCAGGGCCTGAG
TGCTTTACCTTTAAAATCATTAAATTAAAATCCATAAGGTGCAGTAGGAGCAAGAGAGGGCAAGTGTTCC
CAAATTGACGCCACCTAATAATCATCACCACACCGGGAGCAGATCTGAAGGCACACTTTGATTTTTTAA
GGATAAGAACCACAGAACACTGGGTAGTAGCTAATGAAATTGAGAAGGGAAATCTTAGCATGCCTCCAAA
AATTCACATCCAATGCATACTTTGTTCAAATTTAAGGTTACTCAGGCATTGATCTTTTCAGTGTTTTTC
ACTTAGCTATGTGGATTAGCTAGAATGCACACCAAAAAGATACTTGAGCTGTATATATATATGTGTGTCT
GTGTGTGTGTGTGTGTGTGCATGTATGTGCACATGTGTCTGTGTGATATTTGGTATGTGTATTTGT
ATGTACTGTTATTCAAAATATATTTAATACCTTTGGAAAATCTTGGGCAAGATGACCTACTAGTTTTCCT
TGAAAAAAGTTGCTTTGTTATTAATATTGTGCTTAAATTATTTTTATACACCATTGTTCCTTACCTTTA
CATAATTGCAATATTTCCCCCTTACTACTTCTTGGAAAAAAATTAGAAAATGAAGTTTATAGAAAAG

FIGURE 205
SEQ ID NO: 197
Genbank ID        : NM_000662.1
Unigene ID(#167)  : Hs.458430
Unigene name      :     N-acetyltransferase    1    (arylamine    N-
acetyltransferase)      NAT1
>gi|4505334|ref|NM_000662.1| Homo sapiens N-acetyltransferase 1 (arylamine N-ac
etyltransferase) (NAT1), mRNA
ATGGACATTGAAGCATATCTTGAAAGAATTGGCTATAAGAAGTCTAGGAACAAATTGGACTTGGAAACAT
TAACTGACATTCTTCAACACCAGATCCGAGCTGTTCCCTTTGAGAACCTTAACATCCATTGTGGGGATGC

FIGURE 205 cont'd
```
CATGGACTTAGGCTTAGAGGCCATTTTTGATCAAGTTGTGAGAAGAAATCGGGGTGGATGGTGTCTCCAG
GTCAATCATCTTCTGTACTGGGCTCTGACCACTATTGGTTTTGAGACCACGATGTTGGGAGGGTATGTTT
ACAGCACTCCAGCCAAAAAATACAGCACTGGCATGATTCACCTTCTCCTGCAGGTGACCATTGATGGCAG
GAACTACATTGTCGATGCTGGGTTTGGACGCTCATACCAGATGTGGCAGCCTCTGGAGTTAATTTCTGGG
AAGGATCAGCCTCAGGTGCCTTGTGTCTTCCGTTTGACGGAAGAGAATGGATTCTGGTATCTAGACCAAA
TCAGAAGGGAACAGTACATTCCAAATGAAGAATTTCTTCATTCTGATCTCCTAGAAGACAGCAAATACCG
AAAAATCTACTCCTTTACTCTTAAGCCTCGAACAATTGAAGATTTTGAGTCTATGAATACATACCTGCAG
ACATCTCCATCATCTGTGTTTACTAGTAAATCATTTTGTTCCTTGCAGACCCCAGATGGGGTTCACTGTT
TGGTGGGCTTCACCCTCACCCATAGGAGATTCAATTATAAGGACAATACAGATCTAATAGAGTTCAAGAC
TCTGAGTGAGGAAGAAATAGAAAAAGTGCTGAAAAATATATTTAATATTTCCTTGCAGAGAAAGCTTGTG
CCCAAACATGGTGATAGATTTTTTACTATTTAG
```

FIGURE 206
SEQ ID NO: 198
```
Genbank ID       : BE501559
Unigene ID(#167) : Hs.380824
Unigene name     :        NS5ATP13TP2 protein      NS5ATP13TP2
>gi|9703967|gb|BE501559.1|BE501559 hw33g11.x1 NCI_CGAP_Kid11 Homo sapiens
cDNA
clone IMAGE:3184772 3', mRNA sequence
TTTTTTGGAGTTGTAATGGCTAGAAATCTTAGACATTCTTATTCAGTAGATCTGGGGAGAGGTCTCAAGA
TGCCCTTGGTGCTTCTGATTGGCCAGGCTCCTGGCCACCGACCTCTGAGTGAGTGGAGTGGTGGGGCCGG
GACGGGGTGAGGGCAGAGTGGAGGCTGGCTGCAGCTGTTGCAGCCTTCCGGCCTGAGGGAGCTAGGATG
CCTCGCCTCTTCCTTTCCCTCCCCACTTCCCCTTTCCCCATGGGGTCGCTAATGGCATTGCCGCAGTCC
AAGGGCTCCTTCCTGTTACTGACTCACTGTGTGAATGGGGGGTCTGCAGCAGGATGGAGGGAGTAGAGCT
GTAGGGTGGGCTGGGGCCCCCTTCCCTATCCGGCTGCTGGAGCCCTGTGCTCTGCTCACCTGTACCGCTC
ACCACATGAGAAGTGGCCCCTTGCCTTCTTACCCATCTCTGTGACTTGATTAACTCTGCTCCCAGTGAGA
AGTTAGTGGGTC
```

FIGURE 207
SEQ ID NO: 199
```
Genbank ID       : NM_017669.1
Unigene ID(#167) : acc_NM_017669.1
Unigene name     :
>gi|8923111|ref|NM_017669.1| Homo sapiens hypothetical protein FLJ20105
(FLJ201
05), mRNA
TCATTAATAAGACAAACTACTGGTGAAAAAAAGAACCCTTTCCGATATTTTAGTAAACAAGAATTAAGAG
AGCTCTTTACAATCGAGGATCTTCAGAACTCTGTAACCCAGCTGCAGCTTCAGTCTTTGCATGCTGCTCA
GAGGAAATCTGATATAAAACTAGATGAACATATTGCCTACCTGCAGTCTTTGGGGATAGCTGGAATCTCA
GACCATGATTTGATGTACACATGTGATCTGTCTGTTAAAGAAGAGCTTGATGTGGTAGAAGAATCTCACT
ATATTCAACAAAGGGTTCAGAAAGCTCAATTCCTCGTTGAATTCGAGTCTCAAAATAAAGAGTTCCTGAT
GGAACAACAAAGAACTAGAAATGAGGGGGCCTGGCTAAGAGAACCTGTATTTCCTTCTTCAACAAAGAAG
AAATGCCCTAAATTGAATAAACCACAGCCTCAGCCTTCACCTCTTCTAAGTACTCATCATACTCAGGAAG
AAGATATCAGTTCCAAAATGGCAAGTGTAGTCATTGATGATCTGCCCAAAGAGGGTGAGAAACAAGATCT
CTCCAGTATAAAGGTGAATGTTACCACCTTGCAAGATGGGTAAGGTACAGGTAGTGCTGACTCTATAACT
ACTTTACCAAAGGGGTTTGGAAGTGTAGAAGAACTTTGTACTAACTCTTCATTGGGAATGGAAAAAAGCT
TTGCAACTAAAAATGAAGCTGTACAAAAAGAGACATTACAAGAGGGGCCTAAGCAGGAGGCACTGCAAGA
GGATCCTCTGGAAAGTTTTAATTATGTACTTAGCAAATCAACCAAAGCTGATATTGGGCCAAATTTAGAT
CAACTAAAGGATGATGAGATTTTACGTCATTGCAATCCTTGGCCCATTATTTCCATAACAAATGAAAGTC
AAAATGCAGAATCAAATGTATCCATTATTGAAATAGCTGATGACCTTTCAGCCATCCCATAGTGCACTGCA
GGATGCTCAAGCAAGTGAGGCCAAGTTGGAAGAGGAACCTTCAGCATCTTCACCCACAGTATGCATGTGAT
TTCAATCTTTTCTTGGAAGACTCAGCAGACAACAGACAAAATTTTTCCAGTCAGTCTTTAGAGCATGTTG
AGAAAGAAAATAGCTTGTGTGGCTCTGCACCTAATTCCAAAGCAGGGTTTGTGCATAGCAAAACATGTCT
CAGTTGGGAGTTTTCTGAGAAAGACGATGAACCAGAAGAAGTAGTAGTTAAAGCAAAAATCAGAAGTAAA
GCTAGAAGGATTGTTTCAGATGGCGAAGATGAAGATGATTCTTTTAAAGATACCTCAAGCATAAATCCAT
TCAACACATCTCTCTTTCAATTCTCATCTGTGAAACAATTTGATGCTTCAACTCCCAAAAATGACATCAG
TCCACCAGGAAGGTTCTTTTCATCTCAAATACCCAGTAGTGTAAATAAGTCTATGAACTCTAGAAGATCT
```

FIGURE 207 cont'd

CTGGCTTCTAGGAGGTCTCTTATTAATATGGTTTTAGACCACGTGGAGGACATGGAGGAAAGACTTGACG
ACAGCAGTGAAGCAAAGGGTCCTGAAGATTATCCAGAAGAAGGGGTGGAGGAAAGCAGTGGCGAAGCCTC
CAAGTATACAGAAGAGGATCCTTCCGGAGAAACACTGTCTTCAGAAAACAAGTCCAGCTGGTTAATGACG
TCTAAGCCTAGTGCTCTAGCTCAAGAGACCTCTCTTGGTGCCCCTGAGCCTTTGTCTGGTGAACAGTTGG
TTGGTTCTCCCCAGGATAAGGCGGCAGAGGCTACAAATGACTATGAGACTCTTGTAAAGCGTGGAAAAGA
ACTAAAAGAGTGTGTGGAAAAATCCAGGAGGCCCTAAACTGCTTAGTTAAAGCGCTTGACATAAAAAGTGCA
GATCCTGAAGTTATGCTCTTGACTTTAAGTTTGTATAAGCAACTTAATAACAATTGAGAATGTAACCTGT
TTATTGTATTTTAAAGTGAAACTGAATATGAGGGAATTTTTGTTCCCATAATTGGATTCTTTGGGAACAT
GAAGCATTCAGGCTTAAGGCAAGAAAGATCTCAAAAAGCAACTTCTGCCCTGCAACGCCCCCCACTCCAT
AGTCTGGTATTCTGAGCACTAGCTTAATATTTCTTCACTTGAATATTCTTATATTTTAGGCATATTCTAT
AAATTTAACTGTGTTGTTTCTTGGAAAGTTTTGTAAAATTATTCTGGTCATTCTTAATTTTACTCTGAAA
GTGATCATCTTTGTATATAACAGTTCAGATAAGAAAATTAAAGTTACTTTTCTCAAAAAAAAAAAAAAAA
AA

FIGURE 208
SEQ ID NO: 200
Genbank ID        : AF098158.1
Unigene ID(#167)  : Hs.9329
Unigene name      :    TPX2,    microtubule-associated    protein    homolog
(Xenopus laevis)  TPX2
>gi|6073830|gb|AF098158.1|AF098158    Homo    sapiens    restricted    expressed
proliferat
ion associated protein 100 mRNA, complete cds
GAATTCGCGGCCGCGTCGACCAGATCTGAGGCGAGGCTAGGTGAGCCGTGGGAAGAAAAGAGGGAGCAGC
TAGGGCGCGGGTCTCCCTCCTCCCGGAGTTTGGAACGGCTGAAGTTCACCTTCCAGCCCCTAGCGCCGTT
CGCGCCGCTAGGCCTGGCTTCTGAGGCGGTTGCGGTGCTCGGTCGCCGCCTAGGCGGGGCAGGGTGCGAG
CAGGGGCTTCGGGCCACGCTTCTCTTGGCGACAGGATTTTGCTGTGAAGTCCGTCCGGGAAACGGAGGAA
AAAAAGAGTTGCGGGAGGCTGTCGGCTAATAACGGTTCTTGATACATATTTGCCAGACTTCAAGATTTCA
GAAAAGGGGTGAAAGAGAAGATTGCAACTTTGAGTCAGACCTGTAGGCCTGATAGACTGATTAAACCACA
GAAGGTGACCTGCTGAGAAAAGTGGTACAAATACTGGGAAAAACCTGCTCTTCTGCGTTAAGTGGGAGAC
AATGTCACAAGTTAAAAGCTCTTATTCCTATGATGCCCCTCGGATTTCATCAATTTTTCATCCTTGGAT
GATGAAGGAGATACTCAAAACATAGATTCATGGTTTGAGGAGAAGGCCAATTTGGAGAATAAGTTACTGG
GGAAGAATGGAACTGGAGGGCTTTTTCAGGGCAAAACTCCTTTGAGAAAGGCTAATCTTCAGCAAGCTAT
TGTCACACCTTTGAAACCAGTTGACAACACTTACTACAAAGAGGCAGAAAAAGAAAATCTTGTGGAACAA
TCCATTCCGTCAAATGCTTGTTCTTCCCTGGAAGTTGAGGCAGCCATATCAAGAAAAACTCCAGCCCAGC
CTCAGAGAAGATCTCTTAGGCTTTCTGCTCAGAAGGATTTGGAACAGAAAGAAAAGCATCATGTAAAAAT
GAAAGCCAAGAGATGTGCCACTCCTGTAATCATCGATGAAATTCTACCCTCTAAGAAAATGAAAGTTTCT
AACAACAAAAGAAGCCAGAGGAAGAAGGCAGTGCTCATCAAGATACTGCTGAAAAGAATGCATCTTCCC
CAGAGAAAGCCAAGGGTAGACATACTGTGCCTTGTATGCCACCTGCAAAGCAGAAGTTTCTAAAAAGTAC
TGAGGAGCAAGAGCTGGAGAAGAGTATGAAAATGCAGCAAGAGGTGGTGGAGATGCGGAAAAAGAATGAA
GAATTCAAGAAACTTGCTCTGGCTGGAATAGGGCAACCTGTGAAGAAATCAGTGAGCCAGGTCACCAAAT
CAGTTGACTTCCACTTCCGCACAGATGAGCGAATCAAACAACATCCTAAGAACCAGGAGGAATATAAGGA
AGTGAACTTTACATCTGAGACTACGAAAGCATCCTTCATCTCCTGCCCGAGTGACTAAGGGATGTACCATT
GTTAAGCCTTTCAACCTGTCCCAAGGAAAGAAAAGAACATTTGATGAAACAGTTTCTACATATGTGCCCC
TTGCACAGCAAGTTGAAGACTTCCATAAACGAACCCCTAACAGATATCATTTGAGGAGCAAGAAGGATGA
TATTAACCTGTTACCCTCCAAATCTTCTGTGACCAAGATTTGCAGAGACCCACAGACTCCTGTACTGCAA
ACCAAACACCGTGCACGGGCTGTGACCTGCAAAAGTACAGCAGAGCTGGAGGCTGAGGAGCTCGAGAAAT
TGCAACAATACAAATTCAAAGCACGTGAACTTGATCCCAGAATACTTGAAGGTGGGCCCATCTTGCCCAA
GAAACCACCTGTGAAACCACCCACCGAGCCTATTGGCTTTGATTTGGAAATTGAGAAAAGAATCCAGGAG
CGAGAATCAAAGAAGAAAACAGAGGATGAACACTTTGAATTTCATTCCAGACCTTGCCCTACTAAGATTT
TGGAAGATGTTGTGGGTGTTCCTGAAAAGAAGGTACTTCCAATCACCGTCCCCAAGTCACCAGCCTTTGC
ATTGAAGAACAGAATTCGAATGCCCACCAAAGAAGATGAGGAAGAGGACGAACCGGTAGTGATAAAAGCT
CAACCTGTGCCACATTATGGGGTGCCTTTTAAGCCCCAAATCCCAGAGGCAAGAACTGTGGAAATATGCC
CTTTCTCCTTTGATTCTCGAGACAAAGAACGTCAGTTACAGAAGGAGAAGAAAAATAAAAGAACTGCAGAA
AGGGGAGGTGCCCAAGTTCAAGGCACTTCCCTTGCCTCATTTTGACACCATTAACCTGCCAGAGAAGAAG
GTAAAGAATGTGACCCAGATTGAACCTTTCTGCTTGGAGACTGACAGAAGAGGTGCTCTGAAGGCACAGA
CTTGGAAGCACCAGCTGGAAGAAGAACTGAGACAGCAGAAAGAAGCAGCTTGTTTCAAGGCTCGTCCAAA
CACCGTCATCTCTCAGGAGCCCTTTGTTCCCAAGAAAGAGAAGAAATCAGTTGCTGAGGGCCTTTCTGGT
TCTCTAGTTCAGGAACCTTTTCAGCTGGCTACTGAGAAGAGAGCCAAAGAGCGGCAGGAGCTGGAGAAGA
GAATGGCTGAGGTAGAAGCCCAGAAAGCCCAGCAGTTGGAGGAGGCCAGACTACAGGAGGAAGAGCAGAA FIGURE 208 cont'd AAAAGAGGAGCTGGCCAGGCTACGGAGAGAACTGGTGCATAAGGCAAATCCAATACGCAAGTACCAGGGT
CTGGAGATAAAGTCAAGTGACCAGCCTCTGACTGTGCCTGTATCTCCCAAATTCTCCACTCGATTCCACT
GCTAAACTCAGCTGTGAGCTGCGGATACCGCCCGGCAATGGGACCTGCTCTTAACCTCAAACCTAGGACC
GTCTTGCTTTGTCATTGGGCATGGAGAGAACCCATTTCTCCAGACTTTTACCTACCCGTGCCTGAGAAAG
CATACTTGACAACTGTGGACTCCAGTTTTGTTGAGAATTGTTTTCTTACATTACTAAGGCTAATAATGAG
ATGTAACTCATGAATGTCTCGATTAGACTCCATGTAGTTACTTCCTTTAAACCATCAGCCGGCCTTTTAT
ATGGGTCTTCACTCTGACTAGAATTTAGTCTCTGTGTCAGCACAGTGTAATCTCTATTGCTATTGCCCCT
TACGACTCTCACCCTCTCCCCACTTTTTTTAAAAATTTTAACCAGAAAATAAAGATAGTTAAATCCTGGA
AAAAAAAAAAAAAAAAAAAA

FIGURE 209
SEQ ID NO: 201
Genbank ID       : NM_005424.1
Unigene ID(#167) : Hs.78824
Unigene name     :      tyrosine   kinase   with   immunoglobulin   and   epidermal
growth factor homology domains       TIE
>gi|4885630|ref|NM_005424.1|    Homo      sapiens      tyrosine      kinase      with
immunoglobulin a
nd epidermal growth factor homology domains (TIE), mRNA
CGCTCGTCCTGGCTGGCCTGGGTCGGCCTCTGGAGTATGGTCTGGCGGGTGCCCCCTTTCTTGCTCCCCA
TCCTCTTCTTGGCTTCTCATGTGGGCGCGGCGGTGGACCTGACGCTGCTGGCCAACCTGCGGCTCACGGA
CCCCCAGCGCTTCTTCCTGACTTGCGTGTCTGGGGAGGCCGGGGCGGGGAGGGGCTCGGACGCCTGGGGC
CCGCCCCTGCTGCTGGAGAAGGACGACCGTATCGTGCGCACCCCGCCCGGGCCACCCCTGCGCCTGGCGC
GCAACGGTTCGCACCAGGTCACGCTTCGCGGCTTCTCCAAGCCCTCGGACCTCGTGGGCGTCTTCTCCTG
CGTGGGCGGTGCTGGGGCGCGGCGCACGCGCGTCATCTACGTGCACAACAGCCCTGGAGCCCACCTGCTT
CCAGACAAGGTCACACACACTGTGAACAAAGGTGACACCGCTGTACTTTCTGCACGTGTGCACAAGGAGA
AGCAGACAGACGTGATCTGGAAGAGCAACGGATCCTACTTCTACACCCTGGACTGGCATGAAGCCCAGGA
TGGGCGGTTCCTGCTGCAGCTCCCAAATGTGCAGCCACCATCGAGCGGCATCTACAGTGCCACTTACCTG
GAAGCCAGCCCCTGGGCAGCGCCTTCTTTCGGCTCATCGTGCGGGGTTGTGGGGCTGGGCGCTGGGGGC
CAGGCTGTACCAAGGAGTGCCCAGGTTGCCTACATGGAGGTGTCTGCCACGACCATGACGGCGAATGTGT
ATGCCCCCTGGCTTCACTGGCACCCGCTGTGAACAGGCCTGCAGAGAGGGCCGTTTTGGGCAGAGCTGC
CAGGAGCAGTGCCCAGGCATATCAGGCTGCCGGGGCCTCACCTTCTGCCTCCCAGACCCCTATGGCTGCT
CTTGTGGATCTGGCTGGAGAGGAAGCCAGTGCCAAGAAGCTTGTGCCCCTGGTCATTTTGGGGCTGATTG
CCGACTCCAGTGCCAGTGTCAGAATGGTGGCACTTGTGACCGGTTCAGTGGTTGTGTCTGCCCCTCTGGG
TGGCATGGAGTGCACTGTGAGAAGTCAGACCGGATCCCCCAGATCCTCAACATGGCCTCAGAACTGGAGT
TCAAACTTAGAGACGATGCCCCGGATCAACTGTGCAGCTGCAGGGAACCCCTTCCCCGTGCGGGGCAGCAT
AGAGCTACGCAAGCCAGACGGCACTGTGCTCCTGTCCACCAAGGCCATTGTGGAGCCAGAGAAGACCACA
GCTGAGTTCGAGGTGCCCCGCTTGGTTCTTGCGGACAGTGGGTTCTGGGAGTGCCGTGTGTCCACATCTG
GCGGCCAAGACAGCCGGCGCTTCAAGGTCAATGTGAAAGTGCCCCCGTGCCCCTGGCTGCACCTCGGCT
CCTGACCAAGCAGAGCCGCCAGCTTGTGGTCTCCCCGCTGGTCTCGTTCTCTGGGGATGGACCCATCTCC
ACTGTCCGCCTGCACTACCGGCCCCAGGACAGTACCATGGACTGGTCGACCATTGTGGTGGACCCCAGTG
AGAACGTGACGTTAATGAACCTGAGGCCAAAGACAGGATACAGTGTTCGTGTGCAGCTGAGCCGGCCAGG
GGAAGGAGGAGAGGGGGCCTGGGGCCTCCCACCCTCATGACCACAGACTGTCCTGAGCCTTTGTTGCAG
CCGTGGTTGGAGGGCTGGCATGTGAAGGCACTGACCGGCTGCGAGTGAGCTGGTCCTTGCCCTTGGTGC
CCGGGCCACTGGTGGGCGACGGTTTCCTGCTGCGCCTGTGGGACGGGACACGGGGGCAGGAGCGGCGGGA
GAACGTCTCATCCCCCAGGCCCGCACTGCCCTCCTGACGGGACTCACGCCTGGCACCCACTACCAGCTG
GATGTGCAGCTCTACCACTGCACCCTCCTGGGCCCGGCCTCGCCCCTGCACACGTGCTTCTGCCCCCCA
GTGGGCCTCCAGCCCCCCGACACCTCCACGCCCAGGCCCTCTCAGACTCCGAGATCCAGCTGACATGGAA
GCACCCGGAGGCTCTGCCTGGGCCAATATCCAAGTACGTTGTGGAGGTGCAGGTGGCTGGGGGTGCAGGA
GACCCACTGTGGATAGACGTGGACAGGCCTGAGGAGACAAGCACCATCATCCGTGGCCTCAACGCCAGCA
CGCGCTACCTCTTCCGCATGCGGGCCAGCATTCAGGGCTCGGGACTGGAGCAACACAGTAGAAGAGTC
CACCCTGGGCAACGGGCTGCAGGCTGAGGGCCCAGTCCAAGAGAGCCGGGCAGCTGAAGAGGGCCTGGAT
CAGCAGCTGATCCTGGCGGTGGTGGGCTCCGTGTCTGCCACCTGCCTCACCATCCTGGCCGCCCTTTTAA
CCCTGGTGTGCATCCGCAGAAGCTGCCTGCATCGGAGACGCACCTTCACCTACCAGTCAGGCTCGGGCGA
GGAGACCATCCTGCAGTTCAGCTCAGGGACCTTGACACTTACCCGGCGGCCAAAACTGCAGCCCGAGCCC
CTGAGCTACCCAGTGCTAGAGTGGGAGGACATCACCTTTGAGGACCTCATCGGGGAGGGGAACTTCGGCC
AGGTCATCCGGGCCATGATCAAGAAGGACGGGCTGAAGATGAACGCAGCCATCAAAATGCTGAAAGAGTA
TGCCTCTGAAAATGACCATCGTGACTTTGCGGGAGAACTGGAAGTTCTGTGCAAATTGGGGCATCACCCC
AACATCATCAACCTCCTGGGGGCCTGTAAGAACCGAGGTTACTTGTATATCGCTATTGAATATGCCCCCT
ACGGGAACCTGCTAGATTTTCTGCGGAAAAGCCGGGTCCTAGAGACTGACCCAGCTTTTGCTCGAGAGCA FIGURE 209 cont'd TGGGACAGCCTCTACCCTTAGCTCCCGGCAGCTGCTGCGTTTCGCCAGTGATGCGGCCAATGGCATGCAG
TACCTGAGTGAGAAGCAGTTCATCCACAGGGACCTGGCTGCCCGGAATGTGCTGGTCGGAGAGAACCTAG
CCTCCAAGATTGCAGACTTCGGCCTTTCTCGGGGAGAGGAGGTTTATGTGAAGAAGACGATGGGGCGTCT
CCCTGTGCGCTGGATGGCCATTGAGTCCCTGAACTACAGTGTCTATACCACCAAGAGTGATGTCTGGTCC
TTTGGAGTCCTTCTTTGGGAGATAGTGAGCCTTGGAGGTACACCCTACTGTGGCATGACCTGTGCCGAGC
TCTATGAAAAGCTGCCCCAGGGCTACCGCATGGAGCAGCCTCGAAACTGTGACGATGAAGTGTACGAGCT
GATGCGTCAGTGCTGGCGGGACCGTCCCTATGAGCGACCCCCCTTTGCCCAGATTGCGCTACAGCTAGGC
CGCATGCTGGAAGCCAGGAAGGCCTATGTGAACATGTCGCTGTTTGAGAACTTCACTTACGCGGGCATTG
ATGCCACAGCTGAGGAGGCCTGAGCTGCCATCCAGCCAGAACGTGGCTCTGCTGGCCGGAGCAAACTCTG
CTGTCTAACCTGTGACCAGTCTGACCCTTACAGCCTCTGACTTAAGCTGCCTCAAGGAATTTTTTTAACT
TAAGGGAGAAAAAAAGGGATCTGGGGATGGGGTGGGCTTAGGGGAACTGGGTTCCCATGCTTTGTAGGTG
TCTCATAGCTATCCTGGGCATCCTTCTTTCTAGTTCAGCTGCCCCACAGGTGTGTTTCCCATCCCACTGC
TCCCCCAACACAAACCCCCACTCCAGCTCCTTCGCTTAAGCCAGCACTCACACCACTAACATGCCCTGTT
CAGCTACTCCCACTCCCGGCCTGTCATTCAGAAAAAAATAAATGTTCTAATAAGCTCCAAAAAAA

FIGURE 210
SEQ ID NO: 202
Genbank ID      : BC001453.1
Unigene ID(#167) : Hs.26403
Unigene name    :    glutathione transferase zeta 1 (maleylacetoacetate
isomerase) GSTZ1
>gi|12655190|gb|BC001453.1| Homo sapiens glutathione transferase zeta 1
(maleyl
acetoacetate isomerase), transcript variant 1, mRNA (cDNA clone MGC:2029
IMAGE:
3139094), complete cds
GCCAGAGGCGACCGGAAGGATCTTTCTAGTCCAGCCCCTCGCTTTACCCGGACGAAAGACACGGGCCTGA
TTCGTCGAGTCTCACTGAGCCTTAGTCGTCGGCAGGTCCCAGGCGCGAAGTTTCTCGGCCTGGAGGAGGG
GGTCGCGCGAAGTGCCAGATGCAGGCGGGGAAGCCCATCCTCTATTCCTATTTCCGAAGCTCCTGCTCAT
GGAGAGTTCGAATTGCTCTGGCCTTGAAAGGCATCGACTACGAGACGGTGCCCATCAATCTCATAAAGGA
TGGGGGCCAACAGTTTTCTAAGGACTTCCAGGCACTGAATCCTATGAAGCAGGTGCCAACCCTGAAGATT
GATGGAATCACCATTCACCAGTCACTGGCCATCATTGAGTATCTAGAGGAGATGCGTCCCACTCCGCGAC
TTCTGCCTCAGGACCCAAAGAAGAGGGCCAGCGTGCGTATGATTTCTGACCTCATCGCTGGTGGCATCCA
GCCCCTGCAGAACCTGTCTGTCCTGAAGCAAGTGGGAGAGGAGATGCAGCTGACCTGGGCCCAGAACGCC
ATCACTTGTGGCTTTAACGCCCTGGAGCAGATCCTACAGAGCACAGCGGGCATATACTGTGTAGGAGACG
AGGTGACCATGGCTGATCTGTGCTTGGTGCCTCAGGTGGCAAATGCTGAAAGATTCAAGGTGGATCTCAC
CCCCTACCCTACCATCAGCTCCATCAACAAGAGGCTGCTGGTCTTGGAGGCCTTCCAGGTGTCTCACCCC
TGCCGGCAGCCAGATACACCCACTGAGCTGAGGGCCTAGCTCCCAAATCCTGCCCCGTTGGCACAGGGCC
ACAGGAGCAGAAGCTGGGTGGGCTGAAGAGGCCTGGAAACGAGAGTCTTAATTGAGGAGATGGGAGACTC
GAACTCTAGCCCTGGATCTGCCTTCCTGCTGAAACTTGTTCCACCTCAGTCCCCTCATCTGTCACACGCA
TGTGGGGTGGAGTAGGGAGATGCGGGGAGCAGGGTGGGCAGGAATACTGTTATCTATGTGACGGGCAGT
CGTGAGGCTGAGATGAGAATGCGGATTAAAATGCCTGGCGTGCTCACCGTAACACCAAAAAAAAAAAAA
AAAAAA

FIGURE 211
SEQ ID NO: 203
Genbank ID      : AC004522
Unigene ID(#167) : acc_AC004522
Unigene name    :
>gi|28261661|gb|AC004522.3| Homo sapiens PAC clone RP4-604G5 from 7,
complete s
equence
GATCTCGGCTCACTGCAAGCTCCGCCTCCCAGGTTGACGCCATTCTCCTGCCTCAGCCTCCTGAGTAGCT
GGGACTACAGGCGCCCGCCACCACGCCCGGCTAATTTTTTGTATTTTTAGTGTAGACGGGGTTTCACCAT
GTTAGCCAGGATAGTCTCGATCTCCTGACCTCGTGATCCACCCGCCTCGGCCTCCCAAAGTGCTGGGATT
ACAGGCGTGAGCCACCACGCCTGGCCTACGCCCGGGTAACTTTTGTATTTTTTTAGTAGACACGGGGTTT
CACCATGTTGGCCAGACTGCTCTCAAACTCCTGACCTCAGGTGATCCACCTGCCCTGGCCTCCCAAAGTG
ATGGGATTACAGGCATGAGCCACTGCACCCGGCCTGACTTCACAATATTAATTGGACATAAAATAGGAGA FIGURE 211 cont'd

```
AAAACAAGGGGAAAAACTGGGACAACAGGAAGATCTGTTGTCCTAGTTTTGGAACAACAAAAATTTGGAA
AATGAGAGCGCAGGCAAAGAGTGGAGAGTAAGGGGAAATGACAACAGAGGGAGCATGGGGAGAGGATGGA
AGAAACAGACACAAGGGGAATGAGCAGAGGGAAGACAACAAATCACAGCAGAAGGGAAGGGATGAGAAGC
AGGAGCCTTCAGAGGTCACAGGTCTACTACTGGATCACCTGATAATTAATTGGAAGGTTTATGTATACAT
TTAAAACATCATGTTCCATTTCTAACATTATTCATAAGTTCAAAAAAAGAACAGGTCTTTCATAGAAAAT
GATTAGTGGTATTAGCAGAAAGAAAGGAATAGTAAATATTTCTCCAATTCTGTGAGTTTTCTATCAACAA
GCTGATGATTAACAAACAAGAAACTTTGTTTTGTTTTGTTTTGAGACAGGGTCTTGTTCTGTCAGCCA
GGCTGGAGTACAGTGGCATGAGCACAGCTCACTGCAGCCTCGATCTCCTGGGCTCAAGTGATCCTCCTGC
CTCAGCCTCCCAAGTAGCTGGGACTATAGGCCTGCACCACCCCGCCTGGCTAATTTTTAAATTTTTTGT
AGAGACAGTGGTCTTGCTATATTGCCCATGCTGGTCCTGAACTCCTGGCTTCAAGCGATCCTCTTGCCAC
AGCCTCCTCGAGTGTTGGGATTACAGGTGTGAGCCATTGTGCCTGGTCAAGGAACTTGTTTTGAACCTGG
CAGGCTACAGGAATCTTCAGACACAGGAAATAGTTTCTATCCAACAAGGAGAGGAACACAGAGCTGACAG
TGCTCAAGTAACAGAGGAGTAGGTGGAAAAAAGTGGTTACGACATTAGTAAAAATAATTAAACCCTTCAC
TGACTGACACAGAATAACTCAGAACAAAAAAGAAACAGAAAACAATGCTGGAGACCAGGTGCAGTGGCTC
ACTCCTGTTAAATCCCAGAACTCCAGGAAGTGGAGACAGGTGGATCACTTTAGCCCAAGGGTTTGAGAC
CAGCCTAGGCAACATGGCGAAACCTCTTCTCTACAGAACATGTAAAAATTAGCTGGGCATGGTGATGCAT
GCCTGTAGTCCCAGCTACTTGGGAGGCTGAGGTGGGAGGATTGCTTGAGCCTGAGAGGTCGAGGCTGCAG
TGAGCTGTGATCGCAGCACTGCATGCCAGCCTGGGAAACAGCAAGACCCTGTCTCAAAAAAAAAAAAAAA
AAAAAAAAATCATCTAGTACAAAGAGCAAGTACCAAGAGAAATTATAAGCCCCATTTATGCCTGATCAAA
AATAGAACTTGATGTTTCATTAGTAACATCCTTCATGTTCACGCTTTATTCACACTCCCTTTGCCCTCTC
CAGGTAGAAGCTTGCTGTGGACCTCCCTATTGCTGTACTCACGTGAGGGCTTCTTTGCAGCACTGTCCTG
AGGGGTTAAGATCCAGCAGAGACAAATGGAAATGTCTGCCAACAGTGTCACCTTGTCTTATCTGGCTGAT
GCCTCTTGAACTTCCTCGTTCTTACTACACATCCAGGACCCAGAGCTCTTCATAGAAAATCACCATTAAG
TTTGGAAGCTGGGAATCCTCATCACAAGGACAGTCCAGGTGCAAGTTCGTGGAATTACACAAAGCAGTGT
ATTGGAATCACACTAATCACACAGGATGGAAGAAGACAGAAAGCCAACAGAAGGATGCTTGGTAGTTTCG
GGAATGTGGTACCGGGACAATGGGTTGGGATTAGACGGATGATCAGTTCGCCTGGTCATCTCTGCTAGGA
AAGATATTCCCCCGACAGAGGCACCTAAATTGTAATCCATGGGAACGGAGCAGAACTGCCTCCCAGGCAA
CTGAGTGGCTGAAGAGGTGAGGACTTGGAACTCAATTATTTCTGATTTTAAAGAGCAAAAACTACTTAGC
AATAAAAAACCCACCTGGAATCAGGGTCACAGTACCATGCTTCTGGAGTTAAATGAACACAAACATTCTC
ACTTTCCATCTGGTCTACAAAAGGGGATAGGTAGTCTCTAACTCCTCAACACTCAATTGAACACATCAGA
GATCCCACAGCTAACACACAGAGAGACAAAACCATCTTATCAGACAGTAAGCCTGCATCCGTCTTACCCT
GGGGAAATGCGCTCCCATAATTCTCCTGCCTGTTGTCCCTACTGAGATTCCTCCGAGCCAGATTCTGACA
TCCCCATTCCTCCAGAATGAGGGACACAGCCATGTCCTCGATCTTCACCATTGCCTAAAATAACACGAGA
CAAACAGTCATTTCCCCCCAAACTCAGGGACAATCCCATTGCTCAAACCTGGAGTCAGGAAGAGAGGTGG
CTGCAAAGCTACAGGACGCTGGGAAGAAAAGGGTGGCCAGAACCTGGGGGTGGAGGGGAGTTTGTGGTAG
AAAGATGCTAAAAGGAGAGGACAGGGTTGGGGCTTCTTTGAGAGCAGGGCATCCAGAGTGGCCTGTGGA
GATAATGAAGAGAGCTCAGGAACAGAGGCAGACACTGAGGACTCAGGAGAGCAGAGGGGCCACAGCTCAC
CTGGGAATCCGCTGTGAATAGTGCAGATGCCATCGCCTGGTCTCTGGGACTACCCTCATGAGGGGGTGCA
GGAATGTGGGCAGCAGGAAGAGCTGGGGGAGGAGAAAGGGTCTGTGAGTAAATCAGCTCCGCTCTGAGCC
TTGCTCAAAGAAGGGCTCGGGGCATGTTCCTTCCTGCACCAGCATGTTCACTGTTCAGTGTTTAGGTCCC
AAATACAGAATTCCAGACAACACAAACGAGAGAACACAGGGCCTCAGTTTTCCCAAGACCTCTACTCTTG
AGCAGGAGTCATAAAAGGGTCCTAATCACCTGGTCCAACCCTTTTATTTTAAAGAAGGGGAAACTTGAGT
CCCTGAGACTGCAAATGACTTCCCTAATGTCACATTCCCAGTGGCAGAGCCAGGATGGGGACCCAGGTTC
CTATTCTCAGCTATAAAAGTGGGTACCTTCAGCCCATAGCTCAAGTCTGGCTCCTAATTTCCTCCAGTCC
AAGGAACGATACCAGGATATGAGAATCCCATTTATGCCTACACTTGTGGAAAACACAACACAGCTTTAAA
ATCTTTAGTGGCAGGTGAGGCGGGAGGATTGCTTGAGCTCAAGGGGTCGAGGCTGCAGTGAGCTATGATC
ACGCACTCCAGCCTGGATGATAGAGTGAGACCCCGTCTCAATGAAATCCAGAAAACAACAACAAAAAAA
ACACTTTAGTAGCAATATCCAGAAAGGCAGGGAAGTAAGGAGGTCTCCTTAGCTCTGGGTAAGTTTTTTT
TTTTTTTTTTTTTTTTGAGACAGAGTTTTGCTCTTGTTGCCCAGGCTGGAGTGCAATGGTGCGATCTT
AGCTCATCGCAACTTTCGGCTCCCGGGTTCAAGTGATTCTCCTGCCTCAGCCTCCAGAGTAGCTGGGATT
ACAGGCATGAGCCACCACGCCCAGCTAATTTTGTATTTTAGTAGAGGCGGGGTTTCTCCATGTTGGTCA
GGCTGGTCTCGAACTCCTGACCTCAGGTGATCTGCCCGCCTCGGCCTCCAAAGCTCTGGGATTACAAGT
GTTAGCCACTGTGTCCGGCACCTCTGGCTAAGTTTTGCCAGTTTTGTCCCTCTACTTTTCTCCCTCA
CTTGGCCACAATAAATACTGTTTTTTTTTTTTTTTTGATAAGATGTATGCATGGTTCAAATGCTGAGA
CAAAAGTTGGGGCTGACACACAACAAAAGACATGCATAACATTATCACGTGATCACAATAACTGTGATGC
ATAACAATTATGAAAATTTAAATTGTGCAATTTAACCCCCTCCCCATCTCTTGCCAAGTACTATTAGAT
TTGGAAATGTTACTGGTAGACAGATGATGTTAGTGAGATACAAGGATATTTGAGAAATGAATTTGAAACT
GAATGACCAAACCTTGTACCTATTTCAAACCTTTATACAACAATAAGATAGGCTCTCTGTCACCCAGGTT
GGAATGCAGTGCTCAAACATGTCTCACTGCAGCCTTGACCTCCCAGGCTCAAGTGATCCTCCCACCTTGG
TCTCCCCAAATGCTAGGATTACAGGTGTGAGCCACTGTACCCAAGTACTTTTTTTTTTTTGGAGATGGA
GTCTCGCTCTATCACCCAGGCTGGTGTGCATGGCGCGATCTCGGCTCACTGCAACCTCCCCTCCTGGGTT
```

FIGURE 211 cont'd

```
CAAGTGATTCTGCTGCCTCAGCCTCCCAAATAGCTGGGACTACAGGTGCCTGCCACCACGCTCAGCTAGT
TTTTGTATTTTTAGTAGAGACGGGGTTTCACCATGTTGGCCAGGATGATCTCGATCTCTTGACCTTATGA
TCTGGCCACCTCAGCCTCCCAAAGTGCTGGGATTACAGGCGTGAGTCACTGCGCCCAGCCCCAAGTACTT
AATTTTTTAAACTTCTGAGAGTAAGGAAACACTCTGGAAAACAAATAAGAAAGAGGAAATTGAGAATAAA
TGTACATGTCTCAATTTATTTAAGAACTATTTACTAAAGAGCAACTGTGTGTGCCAGGATCTTTGAAACT
GTTACTCTGGCAACCTAAACTCTATAATCTAGTGCTTAAGACCATGAATATCCTCTCCAGTTTCCTAAGG
TCGCCCTGTGACTTCTGCTTGTAGAGTGTGGAGAAACCTTACAAGAACATCAACAGTAGTGGAGTTAAAC
ATCACGGTGCACCGGTGTTTTTTTTTTTTTTTTGAGACAGCATCTCCCTCTGTTGCCCAGGCTGGAGT
GCAGTGGCGCAATCTCGGCTCACTGCAAGCTCCGCCTCCGGGTTCACGCCATTCTCCTGCCTCAGCCTC
CTGAGTAGCTGGGACTACAGGCACCCGCCACCATGCCTGGCTAATTTTTGTATTTTAGGAGAGACGGG
GTTTCACCGTTAGCCAGGATGGTCTCAATCTCCTGACCTTGTGATCCTCCTGCCTCGGCTTCCCAAAGTG
CTGGAATTACAGGCGTGAGCCACCACGCCTGGCCACGGTGCACCAGTTTACACAGCTTTCTCTAGCACAT
ACCTGCTGGCTGTCCTCCAGGATGCACGGAAGAGAGGATGCATCCTTAAGCTCCATGTCTAATATTCCTT
AAATGTCATCACCAATAAACACACTGGTTAAGGAATGTGCCTCGACCAATTCTTTTTTTTTTTTTTTGA
GATGAGTGTTGCTCTGTCGCCCAGGCTGGAGTGCAGAGGAGCCATCTTGGTTTGCTGCAACCTCCACCTC
CCGGGTTCAAGCGTTCTTGTGTCTCAGCCTCCTGAGTAGCTGCATTACAGGTGTACACCACCAACCA
ACTAATTTTTGTATTTTTAGTACAGACGGCGTTTCGCCATGCTGTTGGCCAGGCTGGTCTTGAACTCCTGACC
TCAAGTGATTTGCCCACCTTCGCCTCCCAAAGTGCCAGGATTAGAGGCGTGGGCCACTGCGCCTGGCCTT
TTTTTTTCTTTTTTGAGATGGAGTTTTGCTCTGTTGCCTAGCTTGGAGGGTGTATGAATTTTTAACAAAA
AAAGCTTAAAAAGTATAAAATAAAAATTTTTTTAACTAGAAAAACCCCTATAGAATAGGGGGATAAAAAA
TGTTTTTGTATAGCTGTGCAACATGTTTGTCTTTTGAGTTATGTTATTACAACAGTCAAAAAGTTAAAAA
AATCAAAAAGTTCATAAAGTAAAAAAGTTACAGTAAGCTAATTTATTATTTGTATTTATTTATTTATTTT
TTTTTTCTGAGACAGAGTCTCACTCTGTCACCCAGGCTGGAGTGCAGTGGTGCAATCTTGGCTCACCACA
ACCTCTGCCTACAGGTTCAAGCAATTCTTGTGCCTCAGCCTCCTGAGTAACTGGAATTACAGGCATGCAC
CACCACGCCTGGCTAATTTTTTATTTTGTAGAGACAGTGTTTCACTATGTTGGCCAAACCAGTCTGAGA
CTCCTGGCCTCAAGTAATCCGCCCACCTTGGACTCCCAAGTGCTGGGATTAAGCCATGAGCCACCATGC
CTGGCTGATTTATTATTGAAGAAACAAAAATTTTAAAGATAAATTTAGTGTAGCCTAAGTGTACAGTGTT
TCTACAGTCTATGGTAGAGTAGTGTCCTAGGCTTTCACATTCACTCACCACTCACTCACTGACTCATCCA
GAGCAACTTCCGGTCCTGCAAGCTCCAGTCATGGTTAAGTGTTCCATACAGGTGTACTTTTTTTTTTTT
TTTTTTTTTTGAGATGAGTTTCACTCTTGTTGCTCAGGCTGGAGTGCGATGGCATGACAATGGTGCGA
TTTTGGCTCACCGCAACCTCTGCTGCCTGAGTTCAAGCAATTCTCCTGCCTCAGCCTCCTGAGTAGCTGG
GATTATAGGCACCTGCCACCAGGCCTGGCTAATTTTGTATTTTAGTAAAGACGGGGTTTCTCCACGTTG
GTCAGGCTGATCTCGAACTCCTGACCTCAGGTGATCTGCCTGCCTTGGCCTCCTAAAGTGCTGGGATTAT
AGGTGTGAGCCACTGCGCTCAGCCAATTTTGTATTTTCAGTAGAGACCGGGTTTTAACATGTTGGCCAG
GCTGGTCACAAACTCCTAACCTCAAGTGATCCACCCACCTTGGCCTCCCAAAGTGCTGGGATTACAGGCG
TGAGCCACTGTGCCTGGGCTAAAAATCTTTTATACTCTGTTTTTACTTTTTCGATGTTTAGATACACAAA
TACTTACCACTGTGTTACAATTCCCTACAGTGTTTAGTACAGTAACATACTGTACAGCTTTGTAGCGTAG
GTGTGGAGAAGGCTAGACCATCTAGGTTTGTATAAGTATACTTTATGATGTTCGCACAACAAAATCACTT
AACATTGCACTTACCATAACTTATCCCTGCCATTAAGTGATAAATGTACTTTTAGCATTCCTTGTCTTTA
CATTCTAAGCACATACTTTGATTTTAAAACTGGATAAATGTATTACATATTTCCGTCAAAAGAGAAAAAA
CAAGTAACATGACTTTTTATTTATATGACTGTGAACTGATCTTTTTCGTGTTCCTCAACTCCCCTCAAA
AGTTCTTCCATTCTTTTCCCATTGTTTGAAATTTCTGAAAATAACCTAGAAAAGACTGATGCTATAGTTT
TTTTTTTTTTTTTGGAAACAGACTCTCTGTCACCCAGGCTGCAGTGCAGTGATTATTTTATATATTTT
AAATAAAATGGACCTTTAAAAAAGATTTATGATCCTTTTGAAGATAATTCATGACATACTAAAATGTTTT
AAAACCTAGGCTGAAAATAATGACATCTGTTCCCAATACTTTCCTATTAAAAATGTGCTGGACATCTGGA
ATGCTGATAATTCAATAAATAATGCCTACCAGGTTCATTACGCATAGTTCATTTGCCTTCGTAGTAACAT
TTAACTCCTGAGATTGGTCTGTAAGTTGTATTTTCCCAATATTTGGTAATAATGACAACAATGTAGAAT
AACTAAAAACAAAAAACAAGCATGCAGCTTTTTTCATTTTTTTTAAATTTTTAATTAATTCTTTTTTT
TTTTTTTTTTTTTAAGACAGTCTCGCTCTGTCACCAAGGCTAGAGCACAGTGGTACGATCTCGGCTTA
CTGCAACCTCCACCTCCTGGGTTCAAGTGATTCTCCTGCCTCAGCCTCCCGAGTAGCTGGGATTACAGGA
ATGTGCCACCATGCCTGGCTAATTTTCATATTTTAGTAGAGACAAGGTTTCACCATGTTGGCCAGGCTG
GTCTCAAACTCCTGACCTCAAGTGATCTGCCCGCCTCAGCCTCCCAAAGTGCTGGGATTACAGGTGTGAG
CTACCGTGCCGAGCCTAATTCTTTTCTGTAAGTAGCTTTGAGACAGGGTCCTTGCTGTGTTGCCCAGGT
TGGAGTAGTGGCATGATTACAGCTCACTGCAGCCTCAACCTCCTGGGCTCAAGCAATCCTCCCACCTCAG
CCTCCTGCGTAGCTGGAATCACAGGTGTGCGCCACTATACCTGGCTAATTTTCTATTTTTGTAGAGAT
GGGGTCTCGCTACGTTGCCCAGGACTAACATGCTTCTTCATCACAGGCACTCAGCAGCACAAAGACTCTC
GTCCTGAATCATTTCCCTTCCCTAAATGAAACCTTGCTTCTTACCTCGTGACTGTAAGAGGCGGGGTTT
CCGAGACGAATGTTTGAAGTGGGACTGGGTGGCCTCGTGATGAAGGTCAAAGCTCGAGGACTCCTGAACT
GGATCCAGAGGCACCATCCCCCTTGCGAGCATCTCAGGTCCCATGAACTTGACCTGGGACCTGAAGACAGA
CAGGTTGGGCTTGTGGGTAAATCACTTTGTAAATGGGAATTAAAATATTTAAAACAGACCATGAGTATG
CCAGTGGATGCAGGAAGAAAGCCAGAACATTTTAAGACAGAGTAACCACCTAATAACCTAAAGCCTGCC
```

FIGURE 211 cont'd

```
AATACTTCTCCTGGCTCCAGTTTCAACGTCTGTGCCCTGCTCACACATAATAGGTTTCACCTCTTTTTAC
CTGTTGTCCTGATAAATCAAGCTCCAAGTCTTCTAGAAGGGTCACGGCCTCCTCTCCACTATCGGGCGG
TATTCCTGCAGCCAGACCTGGAGCTCCTTGGGCAGGATGGAAAGAAACTGCTCTAGCACCAGAAGCTCCA
GGATCTGTTCCTTGGTGTTTATTTCTGGCCGCAGCCACTGATGACAAAGTTCCTTCAGCCGACTGAGAGC
CTCTCGGGGCCCAAAAGTGTTCTGGTAACAGAAGCGCCTGAAGCGTTGGCGGAATATCTCTGGGTCTGGA
GGAGGCGTGTCCTGTAGGGTGGAATCCTGCCCCCACATGTGGTCTTCCTCATCTTCCTCTTCCACCTTCA
CTATTACGATACCATCCTTCTCCTGTGCAGCCTGTGGGACAGACCCGTGGCTTCCCGTGATTCAGCAGT
CATCATTCAGGCTCCAGGAACTGACTTGATCCAAACAGGGTCTGTGCTCACCTTTATGTCCTGGGAGGTT
TTATGATGTGTTTCTTTACTATTCCTGAAGTATAAAAAAAAAGTCATTAGTACGTACCTTTACAAAAGT
GATCTGTGCTGCTAACACTTTATAGGAGGCAGCACATCGAGGCACTATCAGAACGCTCCTGAGGCCGGGG
GTGGTGGCTCACGCCTGTAATCTCAGCACTTTGGGAGGCCGAGGCAGGCCAATCGCCTGCGGTCAGGAGT
TCAAGACCAGCCTGGCCAACATGGTGAAACCCGTCTCTACTAAAAATACAAAAGTCAGCAGGGCATGGT
GGCAGGCGCCTGTAATCCCAGCTACTCGGAAAGCTGAGGCAGGAGAAACGCTTGAACCCAGGAGGTGGAG
GTTGTAGTGAGCCGAGATTACGCCACTGCACTTCCTACCTGGGAGACAAGAAGTTAAACTCCGTCAAAAA
AAAAAAAATCCTGACAAATCGAGGAAAAAACTGTACAATCTCCACTGTCACTTCATATATCAAGATTTGC
AAACAGAAACCTCAAACAGGCCGACTCCACCCTCAGGGTGTTTGCTTGGAGTCAGAGTGATTTACCTGCA
GGTTGACAGCAGGTTACGAAATGGAGCATTAACAGTGCCCAGCCCAGAGAGCTGAATGTTAGCAGAGTGC
CAGGTGCCAGGCTTAAAGCAGTACACGCACCATCTTCTTTTGTCCCTACAACAGCCCTAGCAGGTCGGCC
AAACTGTTAAGTGCTGTTTTACAAATGACATAACTGAGGGTTAGGTTTTGCTCAGTAGTAGGTGGCTGCCT
ACTGGAGTCAATATTCAACCAAATTTGAAGCCCTGGGACCTACTTTTGTACCATCCAGCTACTTTTGCTA
TTTTTATGAGTGACTTGGGCAGTTAAATTGTGGTTTCCAAAGTACAAGATGATCCGCAAAGGATACAGAA
AGAAAATAATTGGAATGTCTGTATCTTAAAAGAGAGAGAAATTAAGCTATAAATTGACACTAATACACTT
ACTTAGTCTGTGCTGACCTGTCACAGGTGTTGTTCATTTTAGACATTGTGATGTAGACTGGTTTATCTGA
GACCAGTTATGTGAAATAATGGATTTCTAAATCTAGCTTTGGCTGGGCGCAGTGGCTCATGCCTATAATC
CCAAAACTTTGGGAGGCCAAGGCGTGCGGATCACGAGGTCAGGAGATCGGGACCATCCTGGTCAACATGG
TGAAACCCTGTCTCTACTAAAAATAGAAAAATTAGCTGGGCGCGGTGGCGGGCACCTGTAGTCCCAGCTA
CTTGGGAGGCTGAGGAAGGAGAATCACTTGAACCCAGGAGGCGGAGGTTGCAGTGAGCCGAGATCGCGCC
ACTGCACTCCATCCTGGCCACAGAGCGAGACTCTGTCATAAAAGAGACAAGCAGCTTTAAAGATTCTTGT
GGCCAGATATGGTAGCTCATGCCTATAATTCCAGCCCTTTGGGAGGATGAGGCAGGAGGATGCTTGAAGC
CAGAAGTTTGAGACCAGCCTGGGCAACATAGCAAGACCCTGTCCCTATGAAAAGAAAAAAATTAGCTGG
GCATGGGGACTGTGTCTGCAGTCACAGCTACTCAGGAGGCTAAGGTGGGAGGATTGCATGAAACCAGAAG
TTTGAGGCTGCAGTCAGCTACGATCACGCCACTGCATTCCAGCCTGGGTGACAGAGCAAAGCCCTATCAG
GAAAAGGAAAAAAAAAAAAAAAAAGATTCTTATAGAGAAACTGCAATTACAGGACACACTAATAATATAA
ACAGATGTGAACAAGAAGAAAATGGCACAGATGAAGCTTCTATCTAGAGTAAGGTTTTAGCCACATTAGG
AGGTAAAAACCAATGTCAGTCTAAATCAAAGAAAAAGTCACCAATGAGTAATCAGCTTCTTTAAAGAAAG
TGTGAAGAAAGGGCAATTACAGGAACAGCTGTATGAAATGGTTCCATTGTTATGTAATTTAACTGCCAAA
AATGATGTCAAGTATCCAGGAAAAACCCATCTATGTTCACATTTTAGAAACTTGGGGCTGGGTGAGGTGG
CTCATGCCTGTAATACCAGCACTTTGGGAGGCTGAGGCAGGGAGCAGGGGGCCACCTGCGGTCAGGAGTT
CAAGACCAGCCTGGCCATCATCGTGAAACCCCGTCTCTACTAAAAATACAAAAATTAGCTGGGCATGGT
AGCAGGCGCCTGTAATCCCAGCTATTTGGGAGACTGAGGCAGGAGAATCGCTTGAACCCAGGAGGCTGAG
GTTGCAGTGAACTGAGATCACGCCATTGCACTCCAGCCTGGGTAACAAAGTGAGACTCCATCTCAAAAAA
AAAAAAAAAAAAAAAGGAAAAAAAAAAGAAACTTGGAAATATTTTCTAACCTGTTTAAAAATCTTTCAA
ATGAAGAATTTCAGGTGGGTCTTAAGCCTATTTGTTAAAAATATAAAATGCCACCACCTGATTAGTTTGT
AAGACTATACCCTGCATTTCAACAACAAAAATTCAGCATGGTTGATAGGTTGGATCAATCACAAGTTACT
AAGCAGAACTGACACTGTGATTCTTCCATCTGAAGCTACAAATCTTTCTGAATTTATTCTTTTCACCTCT
ACAGCCATCAAAACTAAGCATCAAATTGAAGTTTTAGAAACAGACCATTAAACTGCTTTATCATGATGGG
TTAAACCGAGTTTTAAACTAGCAAAGCATTTTTAGTTTTATGGCTCTCACTAAACATATTCTTAATTTT
GGTGAAAAAGGGATCATGTACATATAACAGCACAAAAATTATATATACATATATATTGAAACGGAGTCTT
GCTCTATCGCCCAGGCTGGAGTGCAATGGCATGATCTCAGCTCACTGCAACATCCGCCTCTCGGGTTCAA
GTAATTCTCCTGCCTCAGCCTCCTGAGTAGCTGGGATTACAGGCCATACTTATTTTTTTAATCTAGTTC
CATGAAGTCCAGCTTCCTTTCTTTGGTTCCCTGCCTTCATTTTCTCCCTTCTCTCCCACAATCCACCTTT
CAGATTATTCTTTCTAAAACTCTACAGCCTTGCAGTTAATACTTTCCAGTGCCTGGTCCCAATTTTCCCT
CAAGCTTCTTTTCCCATCAATCCCCCCATAAACCTTCCCTATGCAACAAAAGCCCTCTCATCAGTATTTC
CTATATATGCCTTGTATTTTGACTGCCATCCTTTCCTCACATCACACTCCATGCCTGGGACTTCCCCCCG
CAGTCCTCTCTGCCTTTTCAAATCCTACTTAACCTTTAAAGCTAGCTAAAACGCGACTTGCCTCTTATCA
CTGTTCAAGAACCCTCTCATAACTATAACAGTAAGAGCCAATGTTTACTGAGTGCTTTCTAGGTACCGGG
TATTTAAGCATTTTCACTTGACCACATAACAATCTTAGCAGGTAGCTACACTTATCATCTCACTGTATAA
AGAACTGAGAGGCTGAGCGCAGCGGCTCATGCCTGTCATCCCAGCACTTTGGGAGGCCAAGGCAGATAGA
TAACCTGAGGTCAGGAGTTCGAGACCAGCCTGGATAACATGGCAAAACCCCATCTCTACTAAAAATACAA
AAATTAGCCAGGTGTGGTGGTGCAATGCCTGTAGTCCCAGCTACTCGGGAGGCTGAGGCAGGAGAGTTGC
TTCAACCTGGGAGGCGGAGGCTGCAGTGAGCTGAGATTACACCACTGCACTCCAGTCTGGGCAACAGAGT
```

FIGURE 211 cont'd

```
GAGACTCCATCTCAAAAAAAAACAAAAGAAGAACTGAGATATACTGCCATTAAATAACTTACTCAAGGTC
ACACAGCAAGTATATGGTAGAGGCAGAATTTGAAATAAAAGTGATTCCCCAATGTAAACTCTTTAACCAT
TATACAAAATTTATCTTGTACCTGACATGTGGGGTATACAGATCCTAAAATGAAGGCCTATGAACGTGAC
AATGAAGAATCAATCAGGGCCAGGCACGGTAGCTCACGCCTGTAATCCCAGCACTTTGGGATGCCAAGGA
GGGTCGATCACCTGAGCTGAGGAGCTCGGGACCAGCCTGGCCAACATGACGAAACCCCGTCTCTACTAAA
AATACAAAAATTAGCTGGATGTGTGGCACATACCTGTAATCTCAGCTACTCGGGAGGCTGAGGCAGGAGA
ATCACTTGAACCTGGGAGGTGGAGGGTGCAGTGAGCTGAGAACGCGCCACTGCACTCCAGCCTGGGTGAC
AGAGAGAGACTCCTTCTCAAAGAGAAAAAAAAATCACTCAGGAACGGGCCTTATCTACCACCCAGTTTTC
ACTGGAGGGTCACTATGTGACTGAAGCCCTTCCTGGGAAAGGGAGGAGACACAGCAGAAGATTCAAGTGG
GGACTGTCTACAACATAACCAGGTGGGATCTTCAAACATGGTAACTGAGCAGAACTAGTGTGATAGCGAG
CCCAGCCACCAGAAATCCCTACTTTTGTGAAAGTTTTATCCTGCCTTAGCTATTGAGCAGGACACTTCTT
GGGTCAGTGCGAAGATGCGACTCTAAGGAGGAAATGAGTCCAGGGGGAAATAGACACAGACATGGGCACA
TTCCCTCTGCCCACAACTGGGACAGATCCTCCTCCTCACCTTCAGTATCTCTCTGCCTACTCTGGGGT
GCAGGGAAAAGCCATCACAGCAGTGGAAAGGCTGGGTTTTATTTGAGGTTTCCCAGATGATCTGAGCACA
TACTCTTCTGTCTCTAAAGGCCCTAATACTCTTCACCAAACATTTGCTAGGTAATTTCTCATGATGCGCC
GGGCGCAGTGGCTCATGCCTGTAATCCTAGCACTTTGGGAGGCTGAGGTGGGCGGATCACGAGGTGAGGA
GATCGAGACCATCCTGGTAACACGATGAAACCCCGTCTCTACTAAAAATATAAAAATTAGCTGGGTGTG
GTGGCGGGCGCCTGTAGTCCCAGCTACTTGGGAGGCTGAGGCAGGAGAATGGCGTGAACCCGGGAGGCTG
CGATTGCGCCACTGCACTCCAGCCTGGGTGACAGAGCGAGACTCTGTCTCAAAAAAAAAAAAAAATTTC
TCATGATGTTTCTTTCTCTGTAATTTTTCTTGCCTTCTTCCTCAACTAGATTATTAAGAGCAGTCCTCTT
TGTACTCCTTAGACCACTTAGCATGATTCCTTGCAAGCCTCAGTTTCAAAAATACACTTGACTGAATTGA
CAACGTTACTATTTTTTAAAAGCCCGATCATTCTACATTCAATGTTGCACTCAAATTTGTTCCATGGACT
AGTTGGATGAGTTTCAGGTTAGCATTAAAGCTGCTCCACCCCTTACTAGTTGACGGCCTTAGGCAAGTCA
ACAAGTTAACCTCTCTATGCGTCAGTTTCCTCATCTGTATAATGGGAATAAAAATCAGCATTTGTCCCAT
AGAGTTGCCGTGAGGATTAAATGAGGTAATAGATATAAAGCACTTAAAATAGTGCCTGGCATTTAGTAGG
CACTACAGAAATGTCTTAATTTTTTTCAATAAGCTTAAAAGATGTAACTGTACATTCCAATTTTCAGCCT
GCTTAGAAGATTAAGCAATGGACAACTCCTGTAATAGTGAAAGCTGCACAGGCAATAACTGAATTCTAG
TCTCCCACAAGTAAGTGGCACATCCCTGAGAGAGGTATTTAACTTCTCTGGCATTTTGTATCTTTATCAG
TCAAATGGGGGTAGGGTGGGGGTTCCAGATAGTAGGAAACTACCTCTGGGTGAATATGGGCTGAAAAACA
TACTGACATACCATCCACTTTAAATAAAATTACCTCCAGCAGCTAAGGATACCTCAGTTCTCACCTAGGA
TAAACAGAAATGATTTTCTTAAACAACGGCTTGAAGTTACAAGCTCAAAGGCTGTGTTCCAAACAGCCCA
GTATTTTTCCAGGGCATAGTCTTGAAAATGTAAACAAAGGCTGGGCACACAGTGGCTCACGCCCGTAATC
CCAGCACTTTGGGAGGCTGAGGTTGGCGGACTGCCTGAGATCAGGCGTTCGAGACCAGCCTGGCCAACAT
GGCGAAACTCTGTCTCTACTAAAAATACAAAAATCAGCCAAGCCTTGGGACACATGCCTGTAGTCCCAGC
TATTCGGGAGGCGGAGGCAGGAGGATCGCTTGAACTCGGGAGGCAGAGGTTGCAGTAAGCCGAGATCGCA
CCACTGCACTCCAGCCTGGGCGACAGAGCAAGACTCTGTCTCAAAAAAAAAAAAATTTTTTTTTAAATAA
ATTGCCCTTTGCCCTTTACACTCATTTTTTAAAGAGCAATCAAATGTTTTAATATGAAAAGCTACCTT
AAAAGACAGCTAGCTATTCAAAGAATATTGATACTCCCACAGAATGAAAATGTTAGATTTAATATGCTAT
TCATCTGTATTTTAAATGCTTTTAAATCGAGAATGAGCAAAAGACTAAGTAGCTAGCTTCCTCGTTTGTA
TTTTAAGAGTGGTGAAAACTGCCTGAAATAATAAACAAGAATCTTATATGTTAATTCAGAGAAGATACAA
ACCTGGATACACATTCTGGGGCAAATCACCATGGTTTCCTATGTAAAACAGCGATTTCTCCACATTTGTT
CAGCATATATACTAACAGTGCTTTGCTGATGTGGTTACAATGAATTCTCCACAATTCAATTCAACAAGTA
TTTATTGACCGCCTCCAATCCGCCTAGCACTGGCCCGTACAATAAATGCTTTCTTTGGTCCCAGGCCATG
GAACAGCCACTCTCTATAATGAAAGTATCTTACTGTGTACAGGGGGCACTGCAGGAAAGGGAGGGGAGGG
ATGGAGGAGTGTCAAGCTAAACTGTAGTTAATTCTTCAATTACATTGACCAAATCATTTCGAAGTCGGAA
GGGCCTTTTGAGAAAATCCAGTTAGTTTTTATTGATGACGAAATTAAGACTTGGTGAGTGTCTCGTCTTA
TCCAAGGTCACTCAGCTAATCAGTCTCCTAGTGACACAGTGCAATTTCCACAAATTCCCTTCACTTCTCA
CCCCACTCCATGTCAAACAGAGCAACTATCCAGAATTGAAAATCCACCTAACGTCCCGGACAGCTCTTT
TCCAAAGCCTTCAAAGCATTCCATCAAGCTGAAAGAGTGGGGTGTATATAATCTCTACTAGATCCCAATC
ACCTATTTATCCACTATGACTAGGCTTCAAATACTCTTTAATCACCGCTCAGTGATGAGGGTGGGAGAAG
GAAAGGCAGGTCTGGAAACGTATGCGGCACCTCAAAATGTGTCCATCTCTCATCCTTCCGCTCATTTCAC
CTCGAGGTCCCGAAGGAACCGGGGGGGAAAAAGACACCTCACCGGAATCAAAGCAAATGGCGACTAAGG
GAGAGCAGAAAAATCAAGACCGGGGTCGGTTCGCTCGCGACCCCGTTTGCAGAAACGTCAAAGGGCGATG
ACGACACTGCGGGAGAGGGCCCACAGACGGCTTCTCCCCGGGTCTCCGGGCACCCTCAGCCACTGAAAC
CCTCGCCCCTCCCCGCCTGATCCTGGGGGTGGGCGGGACGTCTCCCAGGAAGAACGGCGCTTTCTAC
GGCCGGGCCCGGCCAGGAGGCAGGGCATGGACTCTCTTCGCACAACAGCGGGGCCGCCTGGAGGGGTC
CCAGGGCCGCAGCTGCGGAGCCCACCCTCGCGCACACACCCTTGCGGCCCCGCCCTCCCACCCCAGAGGC
CGGCCCCAAGTCTCACCGTGAGCCCCGGGAGCGGCCTGGGGCGCTGGGCGAGAAAGGGGAGCTGACTCT
GGGGCTCAGGCCGGCCGAAGGGCACCGCACACGGACTTAGGCCCTCCCGACGCCTCGACACAGACACAAT
GAGTCACAAAGGCCGGAAGCGTGTCACCACCTCGTCTTCCGGGACCGCGCCGCGCTTCCGGGTCCTCTCT
AGGAGCGCGGGAGGACTTTGCATCTCGGTTTCCGAATCGCTGGACCAGGCGCCTGCCCTTGAGTTTTCAA
```

FIGURE 211 cont'd

```
GCCTCCAGCTTGGAGGATCAGGTCCCAGTCCGCCCCTAGTTAATGCAGGGACTAACGGGAGCAGGTGGTG
GGGGGTTTCAGGCTTTCCCCTACTCAAACTCAAACAGACTCTCCAGCTCAGACACCAGTCCATGTGAAAG
TTCGATTTCACCTGTCTTTTTCATCTCAGGCAGTCCTTGTAGTAATTATAGTTATTATCAAGCAATATAG
TACTTGGTAATTGTATGTCTGTGGCAAAGGAACTGAAACAAGGATGTAGACTGAGGAAGATCAAAGTGAA
GCCAAGGGTGGCTGGTTTCCCAAAGCTGCCACGGTAGCTTCTCTCAGGGCCCTGGAGCTATATGGAGTGG
TATTTTCAAATACTTGGCCCGTGGACAAGGGATGTCTTTCCACAAGCAAGCATAGTTATAAGGTTCTGTG
CTTTGCTCATGTGGCATATGCTATTATAGCCGTTTAAAAGGAGTTTTCAGAGTAACAACAGACACTTTTA
CCTTCAAAGTGCTTTCACAACCTACCACAGTTACAGCCTTCATCTTTGCCTTGCAGGGTAAGGCACGCAT
AAGAGGGGGCCACGTTGTGCAAGGGTGGGGGGACTACAGGCTTTAATGGTTGTGACTTTCCACTATGTT
CCGAGACAAGTTCATGGGAGAAACTCAGTAGCTTGGTTGCATGACTCTTACTGCTTGGAGAGATTTACTT
TTTTTTTTTAGATGGAGTCTCGCTCTGTCACCCAGCCTGCAGTGCAGTGGCACCATCTTGGCTCACTGCA
ACCTCCACCTCCCAGGTTCAAGCGATTCTCCTGCCTTAGCCTCCTGAGTACCTGGGACTACAGGCGCACA
CCACCATGCCTGGTTAATTTTTGTATTTTTGGTAGAGAACAGGGTTTCACCATATTGGCCAGGATGGTCT
CGATCTACTGACCTTGTGATCCACCCGCCTCAGCCTCCCAAAGTGCTGGAATTACAGGCGTGAGCCACCG
TGCCCGGCCAGATTTACTTTTTAAAAAATGTTTGAAAACTAAAAAGCAATGACAGGGCCAGACACGATGA
CTCAAGCCTGTAATCTTAGCACTTCGGGAGGCTGGACGGGAGGATTCTTGAGCCCAAGAGTTGGAGACC
AGCCTAAGCAACGTAATGAGACCCTCTCTACAAAAAATACTAAAATTAGCTGGGTGCAGGGTAGTGTG
TGCCAGTGGTCCCAGCTGCTTGGGAGGCTGAGGTAGAAGGATAGATTGAGCCCAGGAGGTTGAGGCTGCA
GTGAGCTATGATTGTGCCATTGCACCCCAGTCTGGGCCACAGAGCAAGATCCCATCTCAAAAAAGAAAAA
AAGGGCCGGGCACGGTGGCTCATGCCTGTAATCCCAGCAGTTTGGGAGGCCAAGGTGGGTGGATCACGAA
GTCAAGAGATTGAGATCATCCTGGCCCATATGGTGAAACCCCGTCTCTACTAAAAATACAAAAATTAGCT
GGGCGTGGTGGCACACGCCTATAGTCCCAGCTACTTGGGAGGCTGAGGCAGGAGAATCGCTTGAACTCCA
GAGGCGGAGGCTGCAGTGAGCCGAGATCGTGCCACTGCTCTCCAGCCTGGGGACAGAGCTAGACTCTGTA
TCCAAAAAGAAGCAACAACAGTATCATTAAAGGAAATTTGCAAAATGGAGAAAATAATTACCGGTAAT
CTCTCCACCCTAACACAATCCCCATGGCTTTAGTTTACCTTTTTCCTGTTTTCATATACAAATAAATATT
TATTGATATTATTTTAAACACTGTTCAAAACCATAGTTGCAGTTGTATTGAAGAGGAGGCTGGTATCCTG
GAAGTATCTGCTACATTCATATCATGTGAACACTGTTTTTAAGGAAGAGAAAATATATTTACTATTCAG
TAAGTGGAAATAGATCATCATCAAGGTCTTCATACTCATCGTCTTCACACTGAGTAAGCTGAGGAGGAAG
AGGAAGGGTTGCTCTTGCTGTCTCAGGGGTGGCAGAGGCAGGAAGTGATCCACCAGCCTCGGCCTCCCAA
AGTGCTAGGATTACAGGTGTGAGTCACTGCACCTGGCCTCTTTTCTTTCTTTTTTTTTGAGAGAGTTTCC
CTCAGTTGCCATGTTGGAGTGCAATGGCGTGATCTCAGCTCACTGCAACCTCCGCCTCCTGGGCTCAAGT
GATTCTCATGCCTCAGCCTCCCAAGTAGCTAGGATTACAGGTGTGCACTCACCATGCCTGGCTAATTTGT
GTATTTTTAGTAGAGATGGGGTTTTACCATGTTGGCCATGCTGGTCTCGAACTCCTGGCCTCAAGTGATC
CACCCACCTCAGCCTCTCAAAGTGCTGGGATTACAAGTGTGAGCCACCGCGCCTGGCCTCGACATCTTTG
ATTACTTCCTAAGGATGGATTCCAAGAAATGAGATTACTGGTCCCACAGATAGTCAGAGGGAATATAGGC
AATAACGTTTGTAACCCCAGGGTTCTAGACCTGTCAGCAAACAAGCTCAGCTGACAAGATCAGGTGGTAT
CCACCCAAGAGTTTTGAAAGGACTCTAAGATGAAAGTGTTGAAAGAATCATGAAACTAATGATTTATGAT
TACAAAGAGACATTGTGCTTAAAAATTGGCTGGCTGCCCTGAACAAATAAAAGTTCCTGAAGGGCACCCT
AGAAACTGTGGTTGCCTAAGTTTGACTTCTGTGTTGTGAAAGCTGGTGGAGTCAATGCTGAAGGGGAGCC
CGGGTTTGCGGCTGTGACTGGGTGGCTGCAGCTACTCCTGGGAGGGAGGGTCTCCTGTCCCTCCAACTTG
GAAGGAGTGGGGGCTTCCATGTGTTCCCAGCTCCCTCCAGCTCTGTGGAGTGCTGCGATCCCAGCTATGC
CTCACTCACTGCAGCCAGCATCATGGCAGTGGCCACTCCAGATGGGGTGCTGCTGCCAAGGCGGGCAGAT
CACCTGAGGTCAGGAGCTCGGGACCAGCCTGACCAACACGGAGAAACCCCGCCTCTACTAAAATACAAA
ATTAGCTGGGCATGGTGGTGCATGCCTGTAATCCCAGCTACTCAGTAGGCTGAGGTAGGAGAATCGCTTG
AACCCAGGAGGCAGAGGTTGCGGTGAGCCGAGATTGAACCATTGCACTCCAGCCTGGGCAATAAGAGCGA
AACTCTGTCTTAAAAAAAACAAAACAAAACAAAAAAACAAACCCAAGTCTTATATCTGATTCCAAAGGT
CCCATTTTACTGAGTCTTCTTCTTTCTTCTTGACGGAGTTTTGCTTTTGTCACCGAGGCTGGGATCACT
GCAACCTCCGCCTCCCAGGTTCAAGCGATTCTCCTGCCTCAGCCTCCCACGTAGCTGGGATTAAAGGCGT
GTGCCACCTGCCTGACTAGTTTTGTATTTGTAGTAGAGATGGGATTTTGCCATGTTGGCCAGGCTGGTG
TCGAACTCCTGACCTCCAGCGATCCGCCCACCTCGGCCTCCCAAAGTGTTGGGATTATAGGCGTGAGCCA
CCGTGCCCAGCCTGAGTTTTCTTTACTGTCGGCTAGGGCTGTGGCTGGGGAACCTGCTGTGGGAAGGGTA
CTTTCATCTATGCTTTTCCTCCTCCCCTTCCCTCTCCCTGGGGTGGCAGGAGTGAGTGATCTGACTGTTG
GAGACACCTTCCCTCTCTATTTTCCTATTGGAAGCTGTGGCTTCTCTGTTGTGTTGAGCAAAGTGGACGG
ATAGGGAGAGGGTCAAAAATCTCTTACTTAACTGACTATTCTCTCCTGTTGGTTGTTGCTCTTCCCTCGG
TAACACAGTGTTCCAGCTACTTAAGCAGCAAAACAAATTATTCAACAATTTCGTGGGTGAAAGCAATGAC
AACATTGTTTATTTTGCTCCTAAATCTTCCATTTGGTGGAGGGATCCACATGGATGGCTCATCTATGCTC
CACCTGGCTCCTCTGGGGGCCTCAAAGGTTGGACCATCTGAAGGCTCGCCAGCTCCTAAGATTGGTGAT
TGGTCTGGCTGTCAGCGGAGATCTTAGCTGGGGCAGTGGATCTGAACATGTGCAGGTGGTCTCTTCATGT
GCTCTGGGCTTCCTCACAGGATGGTGGCTGGGTCCAAGGACAAGTATCCAGAGAGAGAGAGAGGAGGAA
GGAAGGAAGGAAGGAAGGGAAGGGAAGGGAAGGAAGGAAGGAAGGAAGGAAGGAAGAGCAGGTGA
GCGGGCAGGCAGGTAGGGAGGGAGGGAGGAAAGGAAGGAAGGAAGGCAGGGAGGGAGGGAGGGAAAGAAG
```

FIGURE 211 cont'd

```
GAAAGGGGAGGGAGGGAAAGAAGGAAAGAAAGGGAGGGAGGGAGGGAGTGAAGGAAGGAAGGAAAGGAAA
GGGAAGGGAATGGAAGGGAGGGAAGGAAGGAGGTACGGGAAGGAAGGAAGTGGAGTGGGTGACAGAGAGA
CAGAGGGGACAGGTGAATGAAGGCCACATGTCCTTTATAACCTAATCTTAGAAGCACTCAGCATCCCTTT
CACTGCATTCAATGCCTTGAGGCAGTCATAAAGTCACACCTAGTTTCAGGGGAAGGGAAAATATGTTCCC
CCCTCTTTTCTTCTTTTTTTATGACACGGGGTCTCACTCTTGTCACCCAGGCTGGAGTACAATCATGAC
TCGCTGCAGCCTCGACCTCCTGGGCTCAAGTGATCCTCCACCCTCATCTTCCCGTGTAGCTGGGACTACA
GGCATGAGCAACTATGCCCGGCTAATGTTTAAATTTTTTTGTAGAGATGGGGGTTTCACTATGTTGCCC
AGGCTGGTCTCAAACTCCTGGGTTCAAGCAATCCTTCCACCTCAGCCTCTTGAGTAGCTGGGAGTACAGG
TGCACGCCACCACACCCAGCTAATTTTATTTTATTTTTTGTTAGAGATGGGGTCTCACTATGTTGCCTAA
GCTGGTCTTAAACTCCTGGGCTAAAGGGATACTCCTGCCTTGGCCTCCCAAAGTGCTGGTTTTACAGGCA
CCATGCCTGGCGATGCCACCTTTTTTTTTTTTTGAGACTAAGTCTCACTTTTGTCGCCCAGGCTAGAG
CGCAGTAACGCGATCTTGGCTCACTGCAACCTCCACCTCCCGGGTTCAAGCAATCCTCCTGCCTCAGCCT
CCTGAGTAGCTGGGATTACAGGTGCCTGCCACTGTGCCCGGCTAATTTTTGTATTTTTAGTAGAGACGGC
CATGTTGGCCAGGCTGGTCTTGAACTCCTGACCTCAGGTGATCTGCCCACCTTGGCCTCCTAAAGGGCTG
GGATTACAGGCGTGAGCCATGGCACCCAGCCAGATGCCACCTTTTGATGGGAAGTGATGTGGTTCTGGAA
TTGCATGTGGGACCAAAAACGCTGCCAAGGTCACTTTTGGAAAACACAGTCTACCGCTACTGTCGTCAG
CCACACAAACGTTGGCTTGTGGTGTTCAGGGATGAAATCCTCAGGGGGCCTTGGGGGCCTGCTTACTACT
CAGTCCCCTGTCCCAGTCGATCTGCCTTCTGCCCCTAGCAGGGCACTGCACAACCTCCTTTTGAGGAGAT
TCTTGGGTGGGGGCACCAGTTGGACAACTCAAGTCCAGCTACCTGCTCCTGGGTCCATTTGATCTGTGAC
AAACTCAGGCACCCTTGGCCACTCAAATGGCTGGAACGTGGACCTCCTGCGGTGCTCCTGCCCCTCCCTG
GCCACCTTCCCCTCTTAGTGAATGGAACGTGGACCTCCTGTGGTGCTCCTGCCCCTCCCTGGCCACCTTC
CCCTCTTAGTGGCTTTGTTGAATCACCCGCCACCTGCCTAGGCACGAGAGTCTCCTATTTAAATAATGC
TCAACTAGAGGTTGAGGGTTTTTTTGTTTTTGTTTTTGTTTTTGAGTCTTGCCCTGTCGCCAGGCTGGAG
TGCAGTGGCGTGATCTCGGCTCACTGCAATTTCCGCCTCCTGGGTTCAAGTGATTCTCCTGCCTCAGCCT
CCTGAGTAGCTGGGACTACAGGCCTGTGCTTCCACACCTAGCTAATTTTTGTATTTTTAGTAGAGATGGG
GTTTCACCATGTTGGCCAGGATGGTCTTGATCTCCTGACCTTGTGATCTGCCTGCCTCGGCCTCCCAAAG
TGCTGGGATTACAGGTGTGAGCCACTGTGCCTGGCCGAGGATGAGGTTTTTTGTAGATATGGAGTCTCCC
TGGTGACTGGGATTCCTGCCCGCCCTGCCCCCTGCTCTTTTTTTTTTTTTTTGAGATGGAGTCTCCCT
CTGTTGTGCAGGCTGGAGTGCAGAGTGCAGTGGTGCAATCTCAGCTCACTCCAACCTCTGCTTCCCGGTT
CAAGTGATTCTCCTGCCTCAGCCTCCCCAGTAGCTGGGGTTACAGGTGCATGCCACTACGCCCAGCTAAT
TTTTTGTATTTTCAGTAGATATGAGACTTCTCCATGTTGGCCAGGCTGGTCTTGAACTCCTGGCCTCAAG
TGATCTGCCCACCTCAGCCTCCCAAAGTGCTGGGATCACAGGTGAGAGACACCGCACCCAGCCTCTGTCC
CCAGGTTTTGAAGACATTCTCACTTGTCTTCATGGTGAGGGGCAAGGGAACCAGTCATGGAGGAGGAGA
GGGAAGCCCCCACCAATAGGCAGAAGGCAAAGTCCTTTCTCTTTGGCTTCTACCAAGTCCTTTCTCTCTT
TCTTGCTGCTTTCGTCCAGACTTGAGGAGCAGAAAAACTGGCTGAGCAAGCAAAGCTCGCGAGCGTTTCT
GCCTGTCACGTAGGTGGCATCTGGGATCTTTGATGTGCCGTGCTGTGGGAGTGTCCTCCTGAAGT
TTTTCCTTCTTTGTTCTCAGCTATGGACTCCAGCCACGGACAACAGAGTCCTAGCCCACGTCCAGTCACA
TGACTGCAAAAGCACCTGCGTCTGGATACGGATGTTTATGAGAACATTGGTGCCTAATCAAATCAAATCA
AAACAAACCAAACAGCCCCTAGCCTTGTGGCCTCATTCCCAAGTCAGCCCAAGCCATATCCTTCCTAGCT
ATGGTGTATAGTAGAGGGGCGCAGGACTCAGATGGTCTTGGTTCTCATCTTGTCTGTACCATGTACTCTT
GGTCTAGTTACTTGAACTTTTGGAGCCTCAGTTTCTCTAAGTGTAAAATGAGGATTCAAACAGCACCTAC
CTCATTGGGATGTCATGAGGCTTGCATGATGGAGTTGATTCATGTAAATCAGCAGTTGCAGGGTCTGGCA
TTGGACACAGATGAATTTAGGGCTGTGGCTGTTGACTGACCCTTGGGCTTGAGTGACATGTGTGGCTCC
ATCCTGAAGCTCTTTTCTAGCAGTGCTGAGGTGGGAGGAGGGACTTGACTCTGCAGGTGGGGCTTGGACA
GTGGACCAAATTGAGGATTAGCTAAAATGGGGCCAGGGCAGAAGCAGCTTTCCATAAGACATGCCCACCA
GAGTGCCATGTCAGTTTACCGTTGCCATGGCAACACCCGGGAGTTACCACCCCTTTCCATGGCAATGAGC
TGACAACCTAGAAGTTACTACCTCTTCCCTAGTAATTTCTGCACTAACTGCCCCTTAATCTACACGTAAT
TAAAAGTAGGTAGGCCAGGTGTGGTGGCTCACACTCACACCTGTAATTCCAGCACTTTGGGAGGCCGAGA
TAGGTGGATCACTTGAGGTCAGGAGTTCGAGACCAGCCTGGCCAACATGGTGAAACCCCATTTCTACTAA
AAATACAAAAATCAGCCGGGTGTGGTGGTGCACGCCTGCATTCCCAGCCACTCCGGAGGCTGAGGAATGA
GAATCGGTTAAGCCCAGGAGGCAGACGTTGCAGTGAGCCAATATCGCGCCACTGTACACTGTACTCCGGC
CTGGGCAACAGAGGGAGACTCTGTCTCAAACAAAACAAAACAAAACAAAACCCCAAAAAACAAAAATAA
TCTATGGTGGTGCTGAATGTAGACAGAGAAGAGCCAGTGTGGTTGTTCACGTCTGTAATCCCAGCTACTC
GGGAGGCTGAGGTGGGAGGAGGGCTTGAGCCCAGGAGTTTAAGACCAGCTTGGGCAACACAGTGAGACTC
CATCTCAAAAAAAAAACAAACAAACGAAACAAAAACAAAAACAAAAACCAGTGACTGTAGAGAGAGAAT
AAAGTGGTTGGGGGAAAAGAAGTCAGGGCTTCAAAGTAGAAAGAGTACTGAAAACTTATAAATAGCACTT
TATCAGGAAGGTAATGAAAGACCTGAATGTAGGTTGGTTAAAAGCATGATAGCAGGAAGAATCCAGGCAC
ATTGAAGATGAAGACAGAAAAAAACAAACAAGCCACATTTAGCAATTTCAGCAGGAAATGAACACAGATC
CTACGGGGAGGCGAAGTTAACTTGTAAATGAGACTCTGTATGAAGGTACCTCTATATACATTTGCGTAAA
ACTAGTTTAAAAGCTGCAAAACACAGTCACACAGTTGTTACAGAAACGTGATCACTAAAGAATAAATTGG
GGTTGGGGCAGGGCATGGTGGCTAACGCCTGTGATCCCAGCATTTTGAGAGGCTGAGGCAGGTGGATCGC
```

FIGURE 211 cont'd

TTGAGGTCAGGAGTTCGAGACCAGCCTGGCCAACATGGCGAAACCCTGTCTCTACTAAAATACAAAATAA
TTAGCCACGCGTGGTGGCACATGCCTGTAATTTCAGCTACTTGGGAGGCTGAGGAACAAGAATCACTTGA
ACCCCGGAGGAGGAGAGATTGTGCCACTGCGCTTTAGCCTGGGCAACAGAGTGAGACTCTGTCTCAAAAT
AAATAAAATACAGGCTGGGCGCAGTGGCCCATGCCTGTAATTGCAGCACTTTGGGAGGCCAAGGTGGGTG
GATCACTTGAGGTCAGGAGTTCGAGACCAGGTTGGTTAACATGGTGAAACCCTCTCTCTACTAAAAATAT
TTTAAAAATTAGCCAGGTGTGGTGGTGCGCACCTGTAATCCCAGTTACTCAGGAGGCTGAGGCAGAAGGA
TCACTTGAACCTGGGAGGTGGAGGTTGCAATGAGCCGAGATTGCGCCACTGCACTCCAGCCTGGGGAACA
AGAGCAAAACTCTGTCTAAAAAAAAAAAAAAAAAAAAAGGGCCAGGCATGGTGGCTCATGCCTGTAATC
TCAGCACTTCGAGAGGCTGAGGTGGGCGGGCGGATCATGAGGTCAAGCGATTGAGATCATCCTGGCCAAC
ATGATGAAACCCAGTCTCTACTAAAAATACAAAAATTAGCTGGGTGTGGTGGCGGGCGCCTGTAGTCCCA
GCTACTTGGGAGGCTGAGGCAGGAGAATCGCTTGAATCTGGGGGGTAGAGGTTGCAGTGAGCCAAGATCA
TGCCACTGCACTCCAGCCTGGCGACAGAGCGAGACTCCATCTCAAAAAAAAATATATATATGTGTGTGTG
TGTGTGTGTGTGTGTGTGTGTGTGTGTGTGTAAACAATAAATACATAAATTGAGGAGAAGGCAGGG
GAACCAGGATTTGACAGTGACAAGAAAGAAAAGCCCAGGAGGACCTGGTGGCTGAGCCAGATGCTGGGGC
TGGACTAAGGGTGATGGGAGCAGAGCTGGGACCTTTGGGTGGCAGAGAAGTTCTAATCAGTGAAACTGGG
CAAAGCTATTTGGATGGAGCAGTAGAGTTGGGGTTAAGAGACAGAGACAGGCCGGGCCTGGTGGCTCACA
CCTGTAATCCCAACAGTTTGGGAGGCCAATGTGGGAGGATCATTGAGACCAGGAGTTTGAGACCAGCCTG
GGTAACATACTGAGGCCTTGTCTCTACAAAAAATTTAAAAAATTAGCCAGGTGTGGTGGTGCGTGCCTGT
GGTCCTAGCTACTCAGGAGGCTGAGGTGGGAGGATCGCTCGAGCTCAGTAGACTGAGGCTGCAGTGAGAC
TAGATCGTGCCACTGTACTCCAGCCTGGGCCACAGAGTGAGACCCTGTCTCAAAACAAAACAAAACAAAC
AAACAAACAACAAAAAAAGAGGCAGAGAGACAAAGGCGGCGAAGAAGATGGAATGATGATGCCTTTCGG
GTAGGTTTGGTGTTTTGGGTTGTAAAAGGGAGGATAAAGAAGTAGGAGAAAGTAGAAAGAACACTAATTG
GGACTCAGGTAATGGCTTCAGGTAGATTGTACAGGTTTGAATGCGGGGAGACAAAGCCCACGAGGAGACA
AGAGGAAACAAACTTGGAGGAAAGTTTCTGTGATTCTAAACACGTTCCCTCTCTTATCTCCATGATTTCA
GCTAGTGGTGGGATGCTCTGTGTATGTTTCATGCAGTTTCACATAGTTGGGGCTCAGTCTCTCCACATA
AGGCATTTTATTTCTTTTCTCTTTTTTTCTTTTTTGAGACGGAGTTTCATTCTTGTTGCCCAGGCTGG
TGCGCAATGGGGCAATCTCAGCTCACTGCAACCTCCGCCTCCCAGGTTCAAGTGATTCTCCTGCTCAGCC
TCCCAAGTAGCTGGGATTACAGGTGCCTGCCACCACACCCAGCTAATTTTTATATTTTAATAGAGACAG
GGTTTCGCCATGTTGGCCAGGCTGGTCTCGAACTCCTGACCTCGGTGATCCACCCGCCTCAGCCTCCCTA
AAGTGCTGGGATTACAGGTCTGCGCCACTGCGCCTGGCCTCTCCACGTAAGGCTTTGAGTGGCGTACTGG
GAACGCCCCGCTGGTGGTGTCCTTGGGTGGACTGCAGGGCCCTCTAAGTGCCCCTTGAGGCTGACCACTT
CGGCTTCCAGCATGTCTGAGATGAGATGTGACACTCTCTCCTGGGAGCCACCTGCAAGGTGATTATGTAT
TGGAACAAGCTCTCTTCTTGCCTTATTTTACAGCCCAATGGAGAGGAAGTAGGGGTCAGAGTAGTAGGGG
TGTAAAATTTGGAGTCACTCTTGTTGGGCGTGTGGTTTGTGCAAGTGACCCGACCTCTCTAAGTCTTGAC
TCCCTCATCTGTAAAATAGGGATGGTTTTGGCAAATAGCTACCCCACTTAGCTACTCTGAGGACGGTATGA
CATTGTGGAGGTGGCAATGCTTTGTAAACTGCAGAGGACTTTTAGGTGCCAGCCATCGCCATGTTTTAAA
TGCGGAGAACTGCATTTCTCACCACCTCGCAAAATAAAACTTCACAGTTTATTTGGGTTGGGTATAATTA
CCGGGCGAAAAATGTAAAAATAACAATGTTTTAGAAATTTCCCCAAAGAAGAAACAGTATTGGCTGGGGC
TGCCTTCCCAGGGGCCCTGGAATCCTGAGGGTGCCTGACCTGCAAATGCCCAGCGCTTAGCAGGAGAACA
GCCAGATGGCCCTGCTAGTTCCCTCTCTGTGCAAACATCTCTCACCCAGCCGAGTCAACAACCCTCCCTG
GGTCAAGAGGCTCCTCCATGCTGCTTCTGTGTGGTGTAGCCTAGAAACTGGGCGGCTGGGGCACAGGGCT
CTGGACTTTGGTTATGTGTTTAATCTAGGTCCCTGAGCTACAGGGTCATCTGTTTTGGCTCCTTCTCTGC
TTATGTAAACAGGGCTGGTGGGCCCATCAGTACAGCCAGGCCCCGCTCTCACCCCCTCCTCCTGTAAACA
CATTACAAAGAATCTTTGTAACTGCCCAGGAAGAGCAGCTCTGCTCAGGGGAAGAGAGCCTGCATCCGGA
GGGGGTGAGACTCGGGGTGGAGATGGATGGGGAAGAGTAGGCAGGAGGGGCAAAGGTGGGGCAGGAGTG
GTGCTTGCCAATACCTCCTGTACTATGTGGTACAGAAAAGCCAGCTTTGCTCAAAGTCTGGCCGTGATAG
GAGGGGGCCTGTTGTCTGCAGCAGAAACCAAGGTGGTAGGAAGGGTGGTGTTAGAAAAGGGGAGAACTGG
GGTGGGGCATGGTGGCTCACACCTGTAATCCCAGCAATTTGTGAGGCTGAGGCGGGAGGATTGCTTGAGG
CCAGGAGTTTGAGATCAGCCTGAGCAACATGGGAAGATTCTGTGTCTACAAAAAATACAAAAATTAGCTG
AGCGTGGTGGCATGTGCCTATAGTCCTAGCTACTTGGGAGACCGAGGCAGGAGGATCGCTTGAGGCCAAG
AGTTGGAGGCTATAATGAGGTACGATCACACCACTGCACTCCATCCTGGGTGTCAGAGCGAGATCCTGTC
TCTAAAAAAGAAAGAAAGAAAAGGGGAGAATCTTTATTTCCTAACATCCTGCAGCCCTGACACTTTTCT
TACCTTAGCAATTCAAACATGGTTAAAAAAAAAAAAAAGGAGGGGGTGCCAAGTGCGGTACTTCACACCT
GCAATCCCAGCACTTTGGGATGCTGAGGCGGGTGGATCACCTGAGGTCAGGAGTTTGAGACAAGCCTGAC
CTACATGGTGAAACCCTGTCTCTACTAAAAAATACAAAAATTAACCGGGCCTGGTGGTGGGCACCTGT
AATCCCAGCTACTCTGGAGGCTGAGGCGGGAGAATCGCTTGAGCTGGGAGGCGGAGGTTGCAGTGAGTCG
AGATGGTGCCATTGCACTCCAGTCTGGGCAATAAGAGAGAAACTCTTTCTCAAAAAAAAAAAAAAAAAAA
AGAACTAGGCCAGGTGTGGTGGCTCACGCCTGTAATCCCAGCACTTTGGGAGGCTGAGGTAGGTGGATCA
CCCGAGGTCAGGCGAGACCAGCCTGGCCAACATGGTGAGACCTTGTCTCTGCTAAAAATACAAAATTAG
CCAGGCATGATGGTATGCGCCTGTAATCCCAGCTACTTGGGAGGCTGAGGCAGGAGAATTGCTTGAACCC
TGGAGGTGGAGGTTGCAGTGAGGTGACAGGGCGCCATTGCACTCTAGCCTGTGCGACAAGAGCAAAACTC

FIGURE 211 cont'd

```
CATCTCAAAATAAATAAATAAATACATACATACATACATACATAAATAAATACAATAAAAGAACT
AAAGCCTCCTTTTCAAGTAGTACAGGTTAGAAGCAAGAATATTAGCTGGAGAGTCAAGAAAACAAATTGT
ATTCCTGCTCCTACCCCTAATGAGCTGTGTGCCCTTTGGATGATGCCTTAACATCTTGGAGTTTCCTTGT
CTAGATAAATCAGAATGATAATATTTGCCATTTTTTGAACACCCTTGATATGACAGGGATTTTTACCTGC
TATTTTATTAATCTACACAAATACCCAATGAGGTAGGGTGGGTTATCCCCATTTTAGAGATAAAGACATT
AAGACTTAGCTAGGAGAACTGACTTGCTTAAAAATATGTATGTGTAAGTAGCAGGAACAGCTCTTTTGTA
TTCCAAACCCCCATTCTGCCCCTGCAACTAAGAAAGGTGGGGCGGGGTGGTGGCTCAAACCTGTAATCC
CAGCATTTTGGGAGGCCGAGGCAGGAGGATCACTTGAGCCAGGAGTTCAAGACCAGCCTGGGCAACGAAG
CAAGACCCTGGTTTTTTTTTTTTTTTTTTTTGAGACAAAGTTTTGCTTTTGTTGCTCAGGCTATAGTG
CAATCGCATAATCTTGGCTCACTGCAGCCTCTACCTCCTGGGTTCAAGTGATTCTCTTGCCTCAGCCTCC
TAAGTAGCTGGGATTGCAGGCATGTACCACCACGCCTGGCTAATTTTTGTATTTTTAGTAGAGATGGGGT
TTCACCATGTTGGTCAGGCTGGTCTTGAACTCCTGACCTCAGGTGATCCACCCGCCTCAGCCACCCAAAG
TGCTGGGATTACAGGCATGAGCCACTGCGCCCAGCCAGCAAGATCCTGTTTCTACAAAATATAAAAAATT
AGCCAGGTGTGGTGGCATGCACCTGTAGTCCCAGCTACTTGGGAGACTGAGGCAGGAGGATCACTTGAAC
CCAAAGGCAAAAAAAAAAAAAAAAAAAAAAAAGAAGAAAAGAAAAAAAAAACTATTTTTATTGCTTAGG
GACAAAGTTTCTGACTTCCATAAACTCAAGATCAGCTGGCACGGTGGCTCATGCCTGTAATCCCAGCACT
TTGGAAGGCCGAGGCGGGCGGATCACTTGGGGTCAAGAGTTTGATACCAGCCTAACCAACATAGTAAAAC
CCTGTCTCTACTAAAAATACAAAAATTAGCCAGGGGTGATGGTGGTCGCCTGTAATCCCAGCTACTTGTG
AGGCTGAGGCAGGAGAATCGCTTGAACCGGGGAGGCAGAGGTTGTAGTGAGCCAAGATTGCAACACTGTA
CTCCAGCCTGGGCAACAGAGTGAGACTCTGTCTCAAAAAAAAAAAAAAAAAAAAAAAAAAGCTCAAGGTC
TGGAGTCAAAGCCTCTACCTCTCCCAGATATCTCCTCCCACTGTATTTATACCTTGGTTAAAATCCAGG
GAAGGGAACAATCAGCAACTTGTTCCACTCGGGGTAGAACTTGGCAGGAACTCTCGAAGTTGCTGTTACT
ACCTTTCCATTGCAAGGCAATTCATAAATGTCTAAATTTCCATAGTACATCTTGGAGGCTGCATGAGGGA
GAAAGAGCCAGCAACCCTTATGCCTACAGACAAAAATTAGTTTTTTTTTTTTTTGCTATGGGGTCTCA
CTCTGTCACCCAGGGTTGAGGGCAGTGGCACGATCTTGGCTTACTGTAACCTCTGCTTCCTGGGTTCAAG
CGATCCTCCCACCTCCTACAGGTGTGAGCCACTGTGCCCTGCCTATCTGGCCCTTTATAGAAAAATGTTT
GCCATCTCCTGTTCTAGATAAAAGTAGCCATCTGAGCAGGGATGAGGGAGGGTCTCACCATTCGGGAGGT
AAATATCTATTTAATCCTCTTGTTTTCTCTGTAGCGTCCACACCCTCAACTGTGCCCGGTATTCCTCAGG
CCAGCGGGGTCTGATTGCTGGCCTGAGGGGTGTGGGATCTCAGACCCACCATGGATGGGCAGCCCTAAAC
TTCCTTCTCCCACCTTCAATGGTTAAGTCTTTACTTCTGTTTGGTATAGAGTGGTGGCTGGGCTTGGACTT
TTCAGGAAGGAGACTGGAAGGTGTTCCTCTGGAGAAACTGACCCAGGGCTAAGAGCTACAGATACTGGCC
GGGCATGGTGGCTCACGCCTGACATCCCAGGACTTTGGGAGGCCGAGGCAGGTAGATCACCTGAGGTCAG
GAGTTCGAGGTCAGCCTGGCCATCATGGTGAAACGCCGTTTCTAATAAAAATAGAAAACTTAGCCGAGTG
TGGCGGCAGGCGCCTGTAATCCCAGCTCCTCGGGAGGCTGAGACAGGAGAATCGCTTGAATCTGGGAGGC
AAAGGTTGCAGTGAGCCGAGATCGTGCCACTGCACTCCAGCCGGGTAACAGAGTGAGACTCTGTCTCAAA
AAAAAAAAAAAGGTCACTTTATACCACACTTTGCTCTTGTTAATCAGACTCTGCAAATAGCAAGTGACT
GAACCCTGCGATTCAGTTACAACAAAGACATTTGAATGGACAGAGAAGATGTTTGAGGAAAGCTCCTACC
TTTTTTTTTTCTTTTTTTTTGACTGAGTCTTCCTCCATCACCCAGACTGGAGTGCAGTGATGTGATCACG
CTCACTGCAGCCTCAAACTCCTGGGCTCAGGCAATCCTCCCATCTCAGCCTCCTGAGTAGCTGGGACTAC
AGGCGTGTGCCACTATACCCAGGGAATTTTGTATATTTTCTTGGTAAGGACGAGGTTTTGCCATGTTGC
CCAGGGTGGTCTGGAACTCCCGGGCTCAAGCCATCCTCCTGCACTGGTCTACCAAAGTGCTAAGACTACA
GGCGTGAGCCACCACACCTGGCCAGTGCTAACCTCTTTAATGAGGATTGTTATTGCTTTTTCTTGAAGTT
TTGATTGCAAATATATATAGTTTTCAGTAGTTTGCCCAACTCTATTAATTTTGGTCTTGTTTTGCGTGCC
AGACAGGGGCTTTCAAACAGAACAATACAGTTCATAAGGAACACAGGTTTAATAATTGCTCAGAGGAAAA
AAGACCTACCTGGTACCCTCTCCACAAAGACAAATCCAAAGACACAAAAGAAAGGGAGGGCCGGGCATGG
TGGCTCATACCTGTAATCCCAGCACTTTGGGAGGCCAAGGCTTGAGCCCAGGAGGTCGAGGCTGCTGTCA
GCCGAGACCATCACGCCACTGCACTCCATTCTGGGCAAAACAGCCAGACCCTGTCTCAAAAAAAAAAAA
AGTGATTTACAAAGTATATTTATTTTTTAAAAGATACATTATCATGCTTGCTTTCACTCAGATAAAAATG
CTACAAGATATTTTATGGTATAGTAAGAGACAGTATGCCCTATTCAAATTTTGTGAAAATTGAATA
GGTTGCTATCATTTCTACATACATCTTTCTTAACACTTTCTGGAATTTACTCCTCTTCCTCTTTCCACAT
TGCTTACTGTACAGAGAAGGAGGCTCCATAATGGGAAGGGATACTATCACATTTTTAATGATTATTAACA
GTAAAAACAATGATAAACCTCCGACGTATTAATACTACCTGCCACACACTGTGGTGGATGCTTTCTAC
AAATTAACCTAATCCATTCCTCCCTATTACAAGATATTATTGCTATGCCCCTAGAAACAAGGGATTTGAA
AGTCAGAAAGGTTAAATAAATTGGCCAATAAGTGGCAGTCAGTTCTCCTGCTATACTATTTCTAGAAAAC
AAACCTTTATTTTTAAGGGGCTTGGCTATTTTGAGCAGAAGTGATCTGTGGTCACACAGATCTTAATCA
CCACTCCCCGACAGAGAATAAACATTTATCAGGATGGGGCCGGGAAGGTGGCTCACGCCTGTAATCCCA
GCAATTTGGGAGGCCGAAGTGGGAGGATCACTGAGGTCAGGAGTTCGAGACCAGCCTGGCCAACATAGCG
AAACCCTGTCTCTATTAAAATACAAAAATTAGCTGGGCTTGGTGGCAGGCGCCTGTAATTCTAGCTACT
GGGGAGGCTGAGGCAGGAGAATCGCTTGAACCCGGGAGACGGAGGTTGCAGTGAGCCGAGATCGTGCCAC
TGCACTCCAGCCTGGGCAACAGAGCAAGACCCTGTCCCCATCCCAAAAACCAAAACAACCATTTATC
TGGATGGTGTCGAAATATTTACCACTTCCCCTGCACTTCTGACTTTTCGAACTTTGTGCTTTTGCCTGAG
```

FIGURE 211 cont'd

```
TTCCATCTGGAATGTTCTTCTTGGATGGTGGAGCATGTCGTCCACCTAACCAATTCCTACCTCTCCTTTG
AATACACACCACTTAGTGGAAGTCTTCCCTGATCCCTGCCGACAAGCTTTTCAACTGCATCTCTCTCTTA
AGCTAACCCAAGTCAGTACCGGCACCCTTGCTGGAATGTCCCATTTTGGGAAAGGCAGTATTTCTTGTAT
GAATCTTCATTTGCTCTCTACTGGGGGTAAGTGCACGTTAGAGAATAATGAAAACTTCAAGTCAAGGGAT
GCAGAGTGCGTTTACCAGTTCAACAACCTGGACTTTCTACCAGGCCATTTTCAAACTGAGCTGCCACGGA
CAGCAGCATGGACTTTGGTGCTAGCGGGGTCGGCCTGAAATCTGCAGCCTGCATGCTCCAAGGATGCCTG
AAAAGAAGGGTCGAACCATGGGCCGCTCCCAGGACCCACCCTTTTAGTCTTCCCAGCTGGCTCAGGAAAC
AAAGGGGGGCCGGAGAGAGGCGGCGCCCAGGGCGCAACAGCCGGAGACTGGCGCTGCGTGCCTGGGGACA
GAGGCCTCGTGCTAGGAGCCCCAAGCAACTACACACCTAGCCGCTGGCAAGAACAAACAGCAGTGACAGC
AACAAACAGAACCGACAGCCGCAGACCGCCGTCGCTGCGGCCCACAAAGGCCGGAAGTGTGGCGGGTGCC
GGCGGCCGAGGCGCCCTCTCTAGGACTTCGGAGGGCCCGCATCTCGGTGGTTCCCTATACTGGAAGACCC
CCGATTCCCAGGGCGTGTACCCTACGACGGGGCCTCAAAATGAGTCAAAAGGGAGAAAAGCCTGGGCGC
AGTGACTCGTACCTGTAATCCCAGTCCTTTGGGAGGCCGAGGTGGGAGGATCGCTTGAGGCCAGGAGTTC
GAGACTGGCCTGGGCAACAGAGAGAGACCTGGTCTCTACCAAGAATTAATAAAATGAGCGGGTGTGGTG
GGGCACACCTGTAGCCCCAGCTATTCGGGAGGCTTAAGTGGAAGGATCACTTGAGCCCTGGAGTCAGAGG
CTGCAGTGAGCTTTGCTTGCACCATTGCACTCCAGCCTGGGAAACACAGTGAGACCCCATCTCAAAAGG
AAAAAAAGGAAAGAAGAGAGGGAAGGAGAGAGGGAGGAAGGACAGAGGGAGGGAGGAGGGAGAGAGGGA
AGGAAGGAAGAGAGGAAGGAAGAAAGGAAGGAAGGAAAGAAGGAAGGAAGGAAGGAAGAAGGAATCGAAT
TCAGCGGCTCACCTGTGGAAGAGGAAATCCATTTACAATGCATCCAGGCCTGAGTTTCAGCTGAGGGGTT
GGAGCATGGCTGATTATCATCCTGGCTTCCCCAGAGACCAAGGAAACTGAGGCCTGGAGCAAGTTCTTG
CTTGCTCAGGGTCTCACAGTGATCCGGGTCAGAAGCCAGGACTTGTGGGACCACGATTTGTGCCCTTTGC
ACTGCCTGGACTGCCTCTCATCATAAATGAATACGGATAAAATTCGTTATGCTTTCAAAGTGGTAGGAAA
CACATGACAGATCAAAGCAGACAAAATAGTGTGCAAGACTTTTGAGAAGACGCCTCACACTCGTCGGGAT
GGCTACAGTTTAAATATCCCTTATCTGAAATGCTTGGGACCGGAAATGTTTCAGATTTCAGAATTTTTTT
TTGACTTTGGAATATTTGCTTTACTGGTTGAGCAGCCCTAATCCCAAAATCCTAAGTCTGAAATGCTCTA
ATGAGCATTTTCTCTAAGTGCCATGATGGCCCTCAAGTTCTGGTTTTGTAACTTTTGGAGCTCAGATATT
TGGATTAGGGATACTCTCCCTGTACTAAAAACAAACAAACAAACACAAAAAACCACCACCACCACC
AACAAAACAAAACAAAATAGCAGGTGTTTGGTGAGGATGTGGACAAATTGGAATCTTTGTGCATTGCTGG
TGGGAACATAACATGGTGCAGCCCCGTGAGAAATAGTACAGCGCTTCTTCAATAAAATTAAAAATAGAA
TTGGCTGGTGTGGTGGCTCCCGCCTGTAATCCCAGCACTTTGGGAGGTGAAGGCAGGCGGATCATTTGAG
ATCAGGAGTTCCAGACCAGCCTGACCAACATGGCAAAACCCTGTCTCTACTAAAAATACAAAAAAAAATC
AGCTGGGCGTGGTGGCTCACGCCTGTAATCCCAGCTACTCGGGAGGCTGAGGCAGGACAGTTGCTTGAAC
CTGTGAGGGGAGGTTGCAGTGAGCAAAGATGGTGCCACTGCACTCCAGCCTGGGCGACAGAGCTAGATT
CTGTCAAAATGAAATGAAATGAAATGAAATAAAATAAAATAAAATAATCTCTGAAGGCTAAAGAGAGAAA
TTGGGTCAGCTGAAGAGTTTACAGATTTGCAGAGAATAGAGGCAAGGAAGCTTTGTGAACTACTTTTAGG
TTGTGAAACTTGGTCTTGATTCAGCCCCCACATGGTCTTCATATACAAAGCTTCTTTGCAGAGGAAGCTC
TTTGGAGAAAGATAACTGGTGAGATAGAAAGCACAGCCAAGAGATAACAAGGGAGACTTCTCTGGAGAAT
TTTGTGGATGAAGAGGAAAAACAAATCCATAAGGTCATGGGGATAATGAGTTATTTGAAATCAGAAAGAG
TGATTAACATGGAGGCGGGGCGCAGTGGCTCATGCCTGTAATCCCAGCGCTTTGGGAGGCTGAGGCAGGC
GGATTGCCTGAGGTCAGAAGTTCGAGACCAGTCTGGCCAACATGGTGAAACCCCATCTCTACTAAAAATA
CAAAAAATTAGCCGGGCGTGGTGGTGTGCACCTGTAATCTCAGCTACTCGGGAGGCTGAGACAGGGGAA
TTGCTTGAACCAGGGAGGTGGAGGTTGCAGTGAGCCGAGATTTCGCCACTACACTCCAGCCTGGGCAACA
GGGCGAGACTCCATCTCAAAAAAAAAAAAAAAAAAAAAAAAAAAGCAAACCAAACCAAAGCACACAAACA
AATAAACAAACAAAAAACATAAGGCAATTCTCTACAGGTGTTTTACTGCTAGAAGATCATGCTCCTCATT
TCCTAAAGACTCACAGAGAACAGAAGACTGGTTGCATGAGAAGTGAATAACAAGAGGTTATAGTGCTTAT
TTGGGTTGGGGGCAAACATGACATTTCAATATTAACTTGTTTATTTATTTATTTTTCGGTTATACATCAT
TGCTGGTATATGTACTTTATTTATTTTTAGAGATGGGGGGTCTCGCTATGTTGACCAGGCTGGTCTCG
AACTCCTGGCATCAAGCCATCCACCCATCTTGGCCTCCCAAAGTGTTGGTATTACAGGTGTGAGCCGCTG
TGCCCAGGCTAACTCGTTTTTTTTCTTTGGTCCAGCAAGGCTTGTAATGTGTCTGGGAACGACGTAAAA
TCTGGCTTGAAAAAAAAACTCTCAACTCAAAGCTCCAAGACAGAGCTGAGATGCTTTTGAAGGAGACAGC
CTCATTGGTCTCCTTGTCGGAGAGGCCCCAACTTATCAGTAAATATTGGTTAACATCTATCATCTGGTGG
GACTAAGCATGGAACCAATTGCCCTTGCACAGAAGGCCACGTATTGTAGTATTCAACATAGATGGAATGA
CCAGGAAAGGCAAAACCACAGATATAAAAAGTAGATTAAGGCCAGGCGCGGTGGCTCACCCCTGTAATCC
TAGCACGTTGGGAGGCCAAGATGGGCGGATCACCCACCAGCCTGGTCTATATGGTGAAACCCCGTCTCTA
CTAAAAATACAAAAATTAGCCGGGCATGTTGGTGCGCGCCTGTAATCCCAGCTACTCGGCAGACTGAGGC
AGGAGAATCGCTTGAACCCAGGAGGCGGGAGGCGGAGGTTACAGTGAGCCGAGATGGCACCACTGCACTC
CAGCCTGGCGACGGAGCAAGAAAAAAAAATAAATAAAAAATTGCTAAGATTGTTATTAAATCCGCTGGG
AGAGTCTTTCATCATGTTAGCAGGATCATTGTGTCCTCTGGTGGCAATAACACGCGACTGCAACTGACTT
GCCTGTGCAGAAAAATCTTTCCTGAATCCTGAAAGCTGCATTCTGTTCTATTAGCTTAAGAAGGAAATCT
GACACTGATCCGCACGGTGTGTTTTATGATCCTGCACATAAAGATTAGGTGCTCAAGGATGCAGAGGAGC
CCACTGCTCCCAGAGCAGGTGCCTGAGCCTAGGAGGCATCTGACCAGAGTCTCTGTCGCCCAAGCTGGAG
```

FIGURE 211 cont'd

TGCAGTGGTGCGATCTCGGCTCACTGCAACCTCTGCCTCCAGGGTTCAAGCGATTCTCCTGTCTCAGCCT
CCCAAGTAGTTGGGATTATAGGCACGCACCACCATGCATGCCTGTAATTTTTTGTATTTTTAGTAGAGAC
GGGGTTTCACCATGTTGGCCAGACTGGTCTCAGACACTTGACCTCAGGTGATCTGCCCGCCTCGACCCCC
AGAGGGCTGATATTACAGCGTGAGCCACCGTGCCTGGCCGAACGACAGGATTTCAAGCCTGAACTCGAGA
GGTAGCCCAGACTGGGGATCTGCACTGGGAAGTCATCCGCAAGGACGTGGTGGCTGGAGCTATAGACAAA
GGGAAAGTTATCCAGGGAGAGTGAGGGTGTGGAATGGGGAGAGAGAGGGCCCGCAACACAGTCCTAAGGA
ACACCAGCACTTTTTTTTTTTTTTTTTTTTTTGAGACGGAGTCACCCAGGCTGGAGTGCAGTGGCATGA
TCTCGGCTCTTTGCAACCTCCACCTCCCAGGTTCAAGCAATTCTCCTGCCTCAGCCTCTCAAGTAGCTGG
GATTACAGACGCCCACCACCATGCCCAGAATTTTTGTAGTTTTAGTAGACACGGGTTTCACCATGTTGGC
CTGGCTGGTCTTGAACTCCTGACCTCAAGTGATCCACCTGCCTAGGCCTCCCAAAATGCTGGGATTACAG
GCATGAGCCACCGTGTCTGGCCCAGTTATCGCTTTCTGAGAGAGGAGTTTCTCCAAAGTTTTCAGTTTGA
CATAATCAATATAACCATCCTGCGTATTAGGGGATGGCTGGTTCTTCACTCCTTCAGCATCTTTGGTTAA
CCGGTACCTCGACTTGGCCATATCCACAGGTGGGGAGGTCAGGAGATGTCACCCCTAGTCACTGGGGCT
GTGGGGAACATGGTCTCTGAAATGGAACAAGGCTGACCAGGCCGATGGATGGCTCACAGTGTCTGCTGGA
GGTTCCTTTTGCTGCTCAGGGCCAGGGCGTGGCTGGAGGAAGAGGCCCCACCCAGGAAGTTCCGCAGGGG
CTTACACAGTCTTCCCAGACCCAGAAGCACAATCTCCAAAAGAGTGAACAAGAGACGGAACCCACTGACC
CCAAACATGGCTTTTAGAAAGATGATCTTCTCCGAGGGGTGGGAAAAGGTGCAAGTTAATCTATACGGGC
AAGGCTCTTGGCCACATGCAAAGGAGCTGGGCATCTGGAACCCATACAGGTGGTACTGCAACCCCGGCGC
TGTCCCCTCCAGGACCAGCTGAGCTCCCAGCTGAGCCACATAAGCTCAGAGCAGCCTGAGGCTTCCAGCC
CCTGGGGTATCTCTGCTGCTCTCCCCTCCCTGGATCAGGGTGTCCTCTTCCTCCGTCCCCTTTCATGATT
CTTCCCAGTGCCAGATCACGTGATACAGAGTGAAACCCATGTAGAGGACGCTAGGTACAGCCACCAAGAT
GACCTGGAAGACCCAGAAACGCAGCGGGGAGAGCGGGTGGAAGGCATCGAAGCAGGCAGCCTTGCAGCCC
GGCTGCTGGGTGTGACACACGAATTCACTCTGCTCATCGCCATAGACTCCAGGCCCACTGGCAGCCAGCA
GCACAAGGCGGAATCCCAGGAGCACGGGAAACAGGAGGCGCCCCACGGGGGTGGAGTGCCAGCTCTCCTC
CGCCAGCAGCCACCACCTCAGGAACCTGCCACACATCCTGTTAGGGAGTTTTAAAAAAAGATTATTACAC
GTTATTGATTTTTTGTTTTTAAAGACCTCTGTTGCCCAGGCTGGAGTACAATGGTGTGATCATAGCTCAC
TGCAGCTTCCAACTGTTGGGCTCAAGCAATCGTCCTGCCTCGGCTTCCTGAGTAGCTGGGACTACAGGTG
CATGACACCACGCCCAGCTAAGTTTTAATGTTTTATAGATATGGGGTCTTGCTATGTTTCCCAGTCTGG
TCTCAAACTCCTGACTTCAAGCAATCCTCCTGCCTCGGCCTCCCAAAGTGCTGGGATTACAGGTGTGAAC
CATTGCACCAGGTTATGAGTGATTTATTTTTATTTTTTGAGACAGAGTCTTGCTCTGTCGCCTAGGGTG
TAGTGTAGTGTCGCGATCTCTGCTCACTGCAACCTCTGCCTCCCGGCTTCAAGAGATTTTCCTGCCTCAG
CCTTCTGAGTAGCTGGGATTATAGGCGTGCACCACCACAGCTGGCTAATTTTGTGTATTTTTAGTAGAGA
TGGGGTTTCACCATGTTGGCCAGGCTGGTCTTGAACTCCTGACCTCAGGTGATCCACCTGCCTTGGCCTC
CCAAAGTGTTGGAATTACAGGCGTGAGCCACTGTGCCGGGCCATGTATTGATTTATGACTTTGCCTGTAA
CTTCTGCTTCTCTGCCTCTAAAAACCCTTACCTACAAGCCATTGGGGAATTTAGGTCTTACACTTGAGCT
GGCTGATTCTCCTTGCTTGGCACCCTGCAATAAATGCCTCAGTTTCTCTCACTGGAATCCACATGTCAGT
GTTTGCAGCACCCGGTGGTTGGACCCAAGTTCGATGAGGTAACAGACGTCCACTGGGTGTGCTGTAATCC
CGCGGAGGTTTTCCTCCATAATAAAAGGCAGGAATTGGCTGGGCGCCGTGGTTCATGCCTGTAATCCCAG
CACTTTGGGAGGTCGAGGCGAGTGGATCATCTGAGGTCAGGAGTTGGAGACCAGCCTGGCCAACATGATG
AAACCCCGTCTCTACTAAAAATACAAAAAATTAGCTGGGTGTGGTGGCGGGCGCCTGTAATCTCAGCTAC
ATGGGAGGCTGAAGCAGGAGAATCGCTTGAACCCAGGAGTTGGAAGTTGCAGTGAGCCGAGATCGCGCCA
CTGCACTCCAGCCTGGGCAACAAGAGTGAAATTCCCTCTTAAAAAAAAAAAGACGGCGAGAATTGTGTG
AGTTGTGCGAGGAAGACCGGATGACCGTTATCTCATGGCCTTTGCATCCAGGCTTTGAGCCAAATTCTCA
AGGACTGGATCCTAACACTTGGCTGCAACTATTTCCTTGACCACTAGGGGCAGGCAAAAGCCATAGCGA
ATCCGGCCTAGCGCTGATTGGAACCTGCTTGAGAAAAAGACCTCTTTGTTTAAGCCGGCGGTCCCCAATC
TCTTTGGCACTAGGGACCGGCTCCGTAGAAGACAGTTTTTCCACGGACTGGGGAGGGGAATGGTTTTGGG
ATGATTCCAGTGCATCCCGTTTATTGTGCACTTTATTTCTATTATTATTACATCGTAATATATAATGAAA
TAATTCTACAACTCGCCACGGTGTAGAATCAGTGGGAGCCCTGAGCTTGTTTCTTGCAACTAGATGGTC
CCATCTGGGGTTGATGGGAGACAGTGACAGATCATCAGGCGTTAGATCTCATAAGGAGCGGGCAGCCTAC
ATACCTTTCTTGCACAGTTCACAATAGGGTTCGTGCTTCTGTGAGAGTCTAATGCTGCTGCCGATCTGAC
AGGAGGTGAGCTCAGGCGGTAATTGGAGCAATGGTCGGGGGTGGGGAGCAGCTGTAAATACAGATGAA
GCTTCGACCCTGCAGCTCACCTTCTGCTGCGTGGTTCGGCTCCTAACTGGCTATGAACGGGTACCGGGAG
TTGGGGACCCCTGCCTTAGACTATCTTGTCTCTCTGGTGGACTCTCCTGGGGATAGTTCCCAGGTAGG
CTGGAGGAATGATGCACACTGAATCAGGCAAAAGACATCAATCAGATATAGCAAGGTATACATATGTTAA
GGTCCTCTTCAATTTCTCTGAGCTTTGCTTTTTCAAACTTCTTTCCCAGTAGAATTCACTGTCCCAGCCA
AAAGGTTCTTCGTGGTCGTCAGAAATATTTAGTGCTTTCTATTGCCTTTGCTTACGTATTTATTGATTCA
TCCAGAAATTATGTATTAATTACCTATTGTATTAATATGTGTATTTATTTATTTTTGAGACACGGT
CTTGCTCTGTTGCTCAGGCTGGAGTGCAATAGTACAATCATAGCTCACAGCAGCCTTGACCTCCCATGCT
CAAGTGATCTTCCTGCCTCAGCCTCCCAAGTAGCTGGGACTACAAGTGTGTGCCACCATGCCCAGATAAT
TTTTTATTTTTTTAAATGTAGAGACAGGGTCTTGCTATGTTGCCCAGACTGATCTGGAACTCCTGGCTCA
AGCAATCCTCCCACTTTGGCATCCCAAAGAGCTGAGATTACAGGCATGAGCCACTGTGCCCGGACCTATT

FIGURE 211 cont'd

```
GTATATTTGATTCTCTGGTAGGCACTGGAGACTCAAAAGAACAGGGAATGTAAAATCCCATTCTGCATGG
AAATCTTTTGACCTCGACTTGGCAAGCTGTCTTAGGCCTCCACATCTCTCTGAAATCCGAATTGCTCCAG
GAAGTTTTCCCTGAGTATCTCAGTAGCCCTGTGTCCCTCTCCTCCTGCCCCACACCTGCCCAGGACTTGA
ATCCTGTGGCTTCTCTCTCCTCCTTTATCATCATCCATGTCTCCTGTTATAGATGAGGTCACATCTCCTA
TTCCAATTTTCCTTAGCCCTGGTCTGATCATGTGGATTTTGTTTCTTCGTTGATCTTAAATGTTTAACT
TTCACCTTTTATTTGCTCCAAGTGTCCTCATATTCACATTTCACATGCTATATTTTTCCTCTTGATTAT
TTGCATTTTCTTTTTTTGAGACAGAGTCTTGCACTGTCGCCCAGGCTGGAGTGCAGTGGCGAGATCTCAG
CTCACTGCAACCCCTGCCTCCTGGGTTCACGTGATCCTCCTGCCTCAGCCTCCCCGTAGCTGGGATTAC
AGGCACACATCACCAAACCCAGCTATTCTCCTGCCTCAGCCTCCCAAGTAGCTGAAATTATAGGCACACA
CCACCACACCCGGCTAATTTTTTGTGTTTTCAGTGAAGACGGGGTTTCACTATGTTGGCCAGGCTGGTCT
TGATCCTTGACCTCGTGATCCGCCCGCCTGGGCCTCCCAAAGTGCTGAGATTATAGGCGTGAGCCACCGC
GCCTGGCGACTATTTGCATTTTCTTTCCTGAACTTGGCTACTGTTCATATAGGATGTTTTGCCCTGGAA
GGGAGAAAGGTGGATTTCATGTAGACTTTAAAAAAAAAGTAATTTCTCAGCTTTGATTTTCAAATTGGA
GTCGAAGAGTTAAAACAAAAAATTGTAGCCTTCAAATTTAGGCTTTCATGAAAGATAAGATGATTAACTC
AGAATTCCAAAGACTGGGAATGATTCTTCTATGGAACCCAGCTTGGAGGATGGATTTTGGAATAATCCAG
AGTGGGAGGCTGAGTATAGGATGTAAAGAAAGTTCTTGTCGCTAGACACAGTGGCTCACGCCTGTAATGC
CAGCATTTTGGGAGGCCGAGGCAGGCAGATCACCTGAGGTCAGGAGTTCGAGACGAGCCTTGCCAACATG
GTGAAACCCTGTCTCTACTAAAAATAGAAAAATTAGCCGGGCGTAGTGGCTGATGCCTGTAATCCCAGCT
ACTTGGGAGGCTGAGGCAGGAGAATCGTTGGAACCCGGGAGGCGGAGTTTGCAGTAAGCCAAGATTGCAA
CACTGCAATCCAGGCTGGGCAACAGAGCAAGACTCCATCTCAAAAAAAAAAAAAAAAAAAAAAAAAGAA
AAAGGAAGAAAAAAGGAAAGTTCTTTTCCCACAGGAAGGAAAAGCACAGACACAGGCAGGTGAGGCTTC
ATGAGAAGGTCAAGGTGAGAGCTCTGCTGTGTGTTTGGGGTTGATACCTGTGCATGGCAGTTGGCGACTC
ATTTGAGGAAACTCACTCTCAGGGACTCAGAGGGAGTCTGAGAACCTCAGGGCCAATTCCCGCTTCATTG
AGCTGTACCCTGGAGAGCTGAGAGCTCTCAAATAAGCTTTGGCTGGTGGGCCAAGGCGAACATGGTGTGG
AGATGTGGAGCAGCTGGAGTGGAGGGCTGGGTCTCCCAGGAAGCCAAGAAGTGTGGGGAAACTGAGGCAC
AGAAGAGGCTTGGCTGTGTGAAAGAGCTTGCAGGGTTCTAGCACCTCACAGCCAGAGTGGCCATGGCCAC
GCCTGTGGATGTCAGCAGGGGACACCTGAACAATCCCTAAGGGACAGCGGGTCCGGGCCATGCTTGGGAT
TGCCCAAGTCAGGGTGCCCAGGAACCATGGCCTCCAAGGGAAACCAAGAGTTTCAGATGAATTCAGTGCT
TGGGAGCAGGACCAATGAGAAAATCACATCACATTTCTATAGCATTTTACAGTTAATACTGTTCTCTGTC
GTGCTTGACAAAGAGAGATGATTATTTATTAGTTTCCACAGATTAGACAATGGCGGGGGGTGGTTCAAGG
TGAGATGGTTTTTGGGTCCGAGTCAGCTCAGGACAGGCATCCCAGTCTTCGGTCTCCAAATCCACCTCCT
GTCTGTCCCCCACACTGCTCCTTGGGCCTTGAGGATCCATTGACCGTGATTTCGGTGGTTCAGCTCCCA
CATCAGGCAGGAAGGGCAGCTACTGGGGCTGAGATCCCACATTGCCTCCAGCCCTTGCTTCCTACCTGGC
CTCCCCGGGCACCACGAGGGGCTGGGCCAGGCTGCTGTGCTGCACGTGGCAGGAGTAGGGGCTGTGTCC
TGCGGGGCACATGCACCAACAACCAGGTCAGGTAAGTGCCGTTTCCACCGTGAAGAACATCTCCCCGTA
ACTCAGGCTCCTGCACCTCGCCGGCCCGAGTCCAGTGCACATCAATTTTCCCTGGGTAGAAGTCGTAGGC
CAGGCACTTCAGTTTCTTCTTTTCTCCTGGGGCCTGGTGGCTGGTGACCACCAGAGGGGAGGATCTGTG
GAGGGATAGAGTGTGACACTGCAGGTTTGAGGTCGACTTCTCCCGGCCCAGGTCTCTTCTCACCCCTACC
CCTGGATGTCAGCAATCAGCAGAGCTCTAAGCTCTGTATCTGCCCGCCCCACTGCCCCCTGCCCTGGGAC
ACTTTCCAGAAGATCAGGGAAGGCTGAGGCTTTCCCTGATCCTTCTCTGTTGGATCATGGAATGTCCTGG
CTCCCCTCTCGCCCATTCTCCACCCCACCCATGTATTGACTCTGATAAGTTGTGAATGCTCTGTGCACTT
TCCCATGTTTTCCCACATCTGAGTGGGCTTTGGAGTTCTGTCCCCCAATCTCAGTCCAGCTGCTTGGTTC
AGCCCATGCCTCTATCCAGCAACCGCTTCCCTGCAGCACTGCACAATCCTGAGTCTCACTATGTCTGCAA
TCCAAGTCTCAGCTTGCAGCCATCGATTCCATTCACACTGGCTCGCTGTTGTCTTTCTGGGCTGACATT
TTACACACCTCCCTTCTCTCCACCACCCAGATGGGAGGCATCATTGTAGAGAGAAACAACGATGGCATTT
GGAATCTGAAATCTGGAATTCAAGTCCTAGCTCTTCCTTTTTTTTTTCTTTTTTTTTTTTTGAGACTG
AGTCTCACACTATTGCCCAGGCTAAAGTGCAGTGGCGCGATCTTGGCTCATTGCAATCTAGTCCTCCTGG
GTTCAAGCAATTTTCATGCCTCAGCCTCCCGAGTAGCTGGGATTACAGGCGCCTGCCACCACGCCAGGCT
AATTTCTGTATTTTGGTAGAGACGAGGTTTCATCATGTTGGCCAGGCTGGTCTCGAACTCCTAACCTCA
AGTGATCCACCCACCTTGGACTCACTCCCAAAGTGTTGGGATTACAGGCGTGAGCCAGCATGCCTGGCTG
CAGCTCTGCCTCTTACACAGTGTTACCCTCACCTCTGTCACCTCCAGCTCCTCATCTCTCAATGGGTG
ATATTTAGGGAAGCCTACCAGTGAATCAGTGGCTTTCCTGGCCCATTCTGCCTGAAATTTTGATGTCCTC
CTAGGAAAGGAATGAATCCTGGAAGTTGAAAACTGGGGTTCTACGTGACTTACATGGATAGAGGAGATTG
GCCTAAGATGCTCTCTGAGCTCCCAGCCTGAGATCACCTTGGTTTTTCCCAGCTTAGCACTGGATAGCAG
GAAGCAGTGAGTACCTTGCCGGTCCAGGATATTTTCGCTGTATTTCAGGTATTTCCGCAGAGTTGCAGGG
CACTCCTCCTCCAGGTAAGCCTTGGCCCGCTGCAGCGTAGACTGGTTCTGCCTCCTACTTCTGCTTGGTGT
TCTGGGCTTCCGGGACCAAGGGGACTCAGGCTGGGATTTCTTTGTTGAATTCAATGTAGTCCTTTCCATC
ATAGGCATTCTTCCAGAATGCTCCAGTGCTTCTGTTATTCTGGATCTCACAACCAAACCTTTCCTGCAAG
GCATGAGACCCTGAAACCTCCCCTGACCCCACAGGAAGCCAGTCAGCCTAGTGCCAACTGAATAACTCTT
AGTCCTGCACTCTTCACAACTCAATAGGAGGAAAGGCTTTTGCAATCTAAGCATGCAGTTCCGTAATCAT
GGCATATGATTTTATCTGGACGTACAGTTGACACAGAGTGGCAAAGGCTATATGGATTGGCATTTCGGGC
```

FIGURE 211 cont'd

```
CAATTTGAGATGAAATATGCATTCCTCCCAGCCAGGGAAGTTAAGAGAGCTACAGGCCGTGGGCAGATTT
CTGTCTCTTCTGTAGCATCTCTTTTTATTTGTTTGAACTTACGGGGAGTATTTAGGAACCTGTCACAACC
ACACCAAAGTACATTTCCGAATTTGATAGAAATTATTTGTGATTCCATATGAGGAAAGGAAGGCTCTCCT
TTTCTCTCAGTTCTAGGTGGAGTTCATATCATCACCTAAATCAACCTAATCTGTCTGACTATTTCTTTGT
TTCTTTTTTTTGAGACAGAGTCTTACTCTGCTGCCCAGGCTGGAGTGCAGTGTCATGATCTTGGCTCACT
GCAACCTCCATCTCCCGGGTTCAAGCAATTCTCCTGCCTCAGTCTGCTGAGTAGCTGGAATTCCAGGTGC
GCAACACCACACGAGGCTAATTTTTGTATATTTAGTATAGATGGGGTTTCGCCATGTTGGCCAGGCTGGT
CTTGAACTCCTGACCTCAGGTGATCTGACTGCCTTGGTGTCCCAAAGTGCTGGGATTACAGATGCGAGCC
ACTGCGCCTGGCCTGATCACTTCTTTCTTCCTTTCTGGTGTTTGATATCTTTATCCCAAATCTCTAAAGT
CCCAACCTTCTTGCCCATTAGCAACAACTCTCAGAAATGGACCTCATAGGGCAGAGGACACAGCCTCTTC
ATTCTGATTATAAAAACAGGTGTTTACCTAGCACAGGTTGGTGCTGTTGGCATAGACTCTCACAGCTCTC
AAGCTGTCTGGGCTCAAGTCCCAGGTCTCTTCCCGCCCCAACCTGGTGTGTTGTGTGAACTGGAGCCAGT
CACCTCCTTGTGCCTTTATTTCCTCACCCCTGAAACAGCAGTGCCAAAAGCACGGTTTCAGGGGGTTATT
CTGAGCATTATATATGCTCATAAATGGGCCTGGCACAAAGTAAGTGCTCAGTAAATGTCAGCTACTCTTA
TTTTCTAATACCCTGTGTTCATCTCTTCATCCTCCTTCCTCGTAATTATCCACTTTGCCATTTCTATTCC
TGTCCATCAATGCTTCCCCCAGTGTCTTTTCTGATCACCTGTGCCCCTCCTCTCCTATGGCTAACACAC
AGCCTGGGTCATTTTCCTTACCAAGACCTCCCATCCCTCATCCTTCAAACGTCTGCTTATCTCTTGCCTC
CTTTGGGAAACCTTCAGATCCCATGTAGCACCTTGGGCATTTTGTACTTAGAAGCCCATCTTTTGATAC
CCACTCCATGATAATTTAACACCAGCAGTTCACCAGGCCTGGGGTTGGCTGCCTTGGGGCTGGCAGTGTG
GTTTGGGAGAAAGAACGCTGGGCCGGGGCAGGGGACCGTCTCTGCACGGGCTCTGCCACCAGCTCCTC
CGACCACAGTGCAGGTGGCCCTTCCTGGGTCTGCATCTTATGGTGAGGAGGAACTTTAGGGCTGCAGGGA
TCTCTAACAGCCTGTGGTTTTGAATGCAGCACTTCCTGAGCCCCCAGCATGGGCTACGGTGTGTGCTGGG
TGCTTTTCTCTGTTGATTCCACAAATTTCAATTGAGCCAATATTGGCTGTACCCTGTGCTAGGTGATGGA
GCTGCAAGGGAGATCAGGACAGACTGTGACATCCTTCATAGAACAGACATAGTTAAATATTACAGACTTG
TTTGGAGATAGGTCTCAGTGCTCCAATGTTTGCAGATTTCGACCAGATATTTTGGGAACATTTCACTGTC
AACAGGTAGGACTGGCAGAGCCACCAGGTGAGCCCAGGTCTGAGTGACTTTGAGAGTGGCTCATTCTCCA
GGCAACCTCCCTGGACAGGGGTGAGTCTGATGCCTTCTCATGGGGAGATCAGCCTCTGATGGGTGGGGAG
TGGAGGTGAGAGGTCAGAGGTGCCTAGATAGGAAGTGACTCTGCCATCACTTCCTGTGTGACCTGAGACC
TGGGATGAGGATCGGGCAATCGATGGGGAAGGGACAACACTGTGCTGTGGGGGGGTGGGATGCGGACA
TGTCTGTGTTTCTGCTGTGTCTCCTGTTCCTCCCCTGGGATTGGGACTATTTCCATCCTGCTGACCCCTT
GCCACTCACACCTGGGGGGCTGCCTCTTGGGTTAGACCTTCCACCCCCGCGGTCTGTTGTTCACTGACCG
TTACCGTCGTTGTAATACTCCATGATGTTGTTCAGGGTCTCCATAAAGATGTCCTCCCTGGCCTTCTGAA
CTTGGCTCTGCTTCTCCCAGTCCTCTACTCCTTCCGCATGTCTCCATGGTCCCAGGGGCTCAGCCTTCCT
GTCTTCACTGTTGTAGTGGAAGAAGGCATGGCCATTGAGGAAGACAGTGCCCTGCAGCCTGTGGGTGCCT
TTGCCAGACCTGGACAGCCCAGTGTAGAGATAGGTCAGAGAGTAATGACCTGCAAAGAAAAGACTCTGA
GGGCTGGGGTCCATGCAAGGGTGTCCCATTGTGGGGCTGCAGAGGGCCAGGAGGGGAGGCCTGGCCACTG
GCCTCTTCCTCCCCAGCTCTCTCCTCTGCCATCAGCTTCACACCATTGGAGCCTCACTCAAGGAAACAGG
CTCTACTTTCATGCTGGGGATGATATTTCAGAGACCATTCTGTTTCTTCACTACAGAGTTTAATCTGCTT
GGCACAGAAGAAGTTAACATTTCTCAGCCTCCTTATAGATAGATTGGAACCATGTGACTGAGTTTTGTCA
AACAAGAATGTGAGTGGAAGTGACTGATGTCTTTCTTCTGGTCCAAGGCTCTACCATCTGGCTTGCCCCT
ACGGTCTCTTATCCCTTTCGTTGACTGTGGAGGCCACAGGATGAAACAGAAGAGTCCCAAGATGCAAACA
GCCTGGATCCCTGAGTCACCCTGTGGAGGAGAGGAACCTTGCCCAATCTGCATTGAACTTGACATGAGAA
ATAAACATTTCTAGTCTAACCGGACAAATACATATAGTTAGAAAGTGTAGGAAGGTGAATTTACTAGAAA
ACTCAAGAAGTGACCCAGAATGGATCAGCATAGGGTAAGGCTAGGATACCTCTCAGAATTCCTGGCATTG
TATCTTGCAGTTTGGTACAAGATGGAAGCTGAGAGAGTGGGACATTTCCACAATTAGTTCCATAGTTAAT
TTAGAATATAATTTACATGAGTGTTAGTAATGTTGGAAGTCATATGGCAGATTTCTAATTTAAGTACTGA
AGTCATTCTTGCTCATGAGTTTCTGAATGTGATTAGCCTTTAAATCAGACCTTGAGTAAAACAGATTACC
CTCTACAGTGTGGATGGGCCTCATCCAATCAGTGGAAGGCATCAAGAGAAAAGGCTGAGGTCCCCAGAG
AAGAAAGAATTCTGCCTCTAGACTACCCTTGGACTCAGGACCGCAACACCAACTCTTTGCTTGGTCTCTA
GCCTGCTGGCTTGCTTTGCTGGTTTAGGACTTTTAGCCCTCAGAATTGTGTGAGCCACAAGAAATATTAA
ATAAAACTCCTCCCTTTCTCTGTTTTGTATATACATACACGTATATATGTATATTATACATATACACATA
TATTTAGTGTACATATGAATATACAATGTATATTCATATATACATACGTGAGTGTTTATACAATGTATAT
TAGTTTTGTTTCTCTGGAGAACCCCGAATAATTCATATTTGGGTGCAGAATGGGATTAATATTATAAATG
TGATTATTATAAAACTAACGTGAAACACCTATTTTGACAATTTGTAAATGTCATGAATTTTATTTTATTT
TATTTATTTATTTATTTTTTTGAGACAGAGTCTCGCTCTGTTGCCCAGGCTGGAGTGCAGTGGCGCGATC
TCTGCTCACTGCAAGCTCCATCTCTCGGGTTCACACCATTCTCCTGCCTCAGCATCCCGAGTAGCTGAGA
CTACAGGCCCCCGCCATTACGCCCGGCTAATTTTTTGTATATTTAGTAGACGGGGTTTCACCGTGTTA
GCCAGGATGGTCTCGATCTCCTGACCTCGTGATCCACCCACCTCGGCCTCCCAAAGTGCTGGGATTACAG
GCGTGAGCCACCGCGCCCGGCATGAATTTTAAACTCACACAACTGAGAAGCCATTCACTTCCATGTCTTT
ATCCTGCACATTCTCATGCCACAAACAGCCTCCTTCCCCTCTCCTATAAATGAATCTTGATCTCCCCAAG
CTCCCACTGTCTTCTCTTCCGGCCACTCGCTTTCCAGACCCACTGCAGTGGTGTCTGAGTGTGGGGTGAG
```

FIGURE 211 cont'd

```
GGCACGGGTTTCCTTCTAGCACCATCCCTCCAGCCAACCTGCCTTCCCACTTTCCCCTTGGGGGCTGTTC
TCTCTTTTCCTCAGCGTCAGGCAGGTGTACCCAGCCATCGGAAGGAGGGAAGGAACAGGAGCAGAAGCAG
CTCCAGGCCTGTGGTTCCTGCTCCGTCCTGGCTCTCCACCCCAAGCAGGTCGCTTGGTCTTTGGAGTCTT
TGTTTTCACTGTAAACTAAGGGGTTTTAGATTCAGATTCCTGAAGGTCTTATTTTGGGTGAGGGCAGAGG
CTCCCTGAATGCTCCTGGAAGTGTGTGAGCTGAGGGAGTTGACAGCCTTGGACACCTGTTCCTGCCATAT
GCCAGGGAATCCCAGCTGCATCCAGCCCTTCTCCCAGCCACATGTCCTGTTCCTCACCTCCTTCCAGTCC
TCTCCAGCACCCATCCCTTGCTTTCCCCACTCACCATCTCGGGTCTCCTGGAGGACAGCAGGACCCAGAA
GCAGCAGCAGAGACAGCAGGACAGACACCATTCTTACCATTGTGTCTGCTTGGAAGGTTCTGGGCAGGAG
GCACAGGTATTATCCTGGGTCCTGGGGCCATGCCCAGGGGAGGTGAATCTACAGGCCAATGGGAGTACCA
GGCCGGGCTCCTCCCCTGACAGTAAGAAAGAAGTATGCACAAGCCAGGCTGGGCAGAGGTTGTGATCAGT
GAGTCTACACACAGGATATGCAAATTTAGAGCTGAGACAGTTGATCTCTGGACTGAGGATTTGTGTGTGC
CTGGGGCGGAAGGATGCCAGTGTGTGGGAGGTGTGTGTGATGGGTGGCAGGTGCCTGGGATGTGTCGCCC
TTCCAGTCTATTATGACACCCTCTGGGGTCACTTGGGTGTTGTCAGACCACACTTCATCTCTGCCTTCTG
GAAAAACTCTCAACATGTCCAAGACACGGACATGGGTAGACCCCGCTGGGGTGGGACCCTCACTCTCCC
ACATCCGATCCTGCCAGAGCTGTCTGGAGGACATTCCCATTCCCATCTCTCCCTCTTTCCTTTAGGTGCC
TGTGGAATCCCAGCCTTCCATGATGGAAGCAGAAATAGCCGCATCCTCCTTTTGCAGCCTCCCTGGCAAT
AGAACGAGCAGGTGTGCACAGGGTTTATGCTCAGCAAGTCGAAGCTACTGCCTTGGATATCAGGTCAAGT
GTTAGGGAAACAAAGAGGAGGGCACAGTGGACAATGTTTTCTGGTGGTCTTGGCAGGGGTTGCAACTGCC
AGCTCCCGGGGCAGTGGGGCTGCAGTAGCTGCGGGGGCGTCTTGAGCTTCAGTCCCCGGGATGTTGTA
GATCCCGTGCTGTGGCCTCTGCTGCCCCCTGCTGGCAGCTTCTGTATATTTACTGGGCCGGTTGCAGGTG
TGATTTTGACTGTTGGGCTCCTCTGGAATTCTGAGCCTGGGTTCTCCATCCTTTCTGTGGATTCTGAGAG
CTAACCAATAAATACGTTTATTTTCTGCTTAAGGTCAGAACTGCATTACGTTTCCAATAACAAATACTCC
TGGCGGATACAGAGATTGGTACAAGGATTGTTTCCAGGCAGTATTTACTCAGGGAAATGGAGGGCTGGGA
AGCTGAGGTTGGTTACTGGGCCAGATTGGGCTGCGCAGTGAAAACACAAGAGTCTTGGGGGATTCTGGC
AGGCCTGGTGTGCAGTGATAACTTCAACAGTTGGCTGAGGTATCTGTTATGGTAGATTGGTGTAGGGACC
AGCCCCACAGGGTCGGAGGGTTTTTCTCCCGTGTGCAGAGACGAGAGAGTGTAGAAATAAAGACACAAG
ACAAAGAGATAAAAGAAAAGACAGCTGGGCCCGGGGACCACTACCACCAAGACGTGGAGACCGGTAGTG
GCCCCGAATGTCTGGCTGCGCTGTTATTTATTGGATACAAAGCAAAGGGGCAGGGTAAAGAGTGTGAGT
CATCTCCAATGATAGGTAAGGTCACGTGGGTCATGTGTCCACTGGACAGGGGCCCTTCCCTGCCTGGCA
GCCAAGGCAGAGAGAAAGAGGAAGAGAGAGAGACAGCTTATGCCATTATTTCTGCTTATCAGAGACTTAG
TACTTTCACTAATTTGCTATTGTTATCTAAAAGGCAGAGCCAGGTGTACAGGATGGAACATGAAGGCGGA
CTAGGAGCGTGACCACTGAAGCACAGCATCACAGGGAGACGGTTAGGCCTCTGGATAACTGCGGGCGGGC
CTGACTGATGTCAGGCCCTCCACAAGAGGTGGAGGAGTAGAGTCTTTCTCTAAACTCCCCCAAGGAAAGGG
AGACTCCCTTTCCCGGTCAGCTAAGTAGCGGGTGTTTTCCTTGACACTGAGGCTACCGCTAGACCACCGT
CCGCTCGGCAAGGGGCGTCTTCCCAGACACTGGCGTTACTGCTAGACCAAGGAGCCCTTCTGGTGGCCCT
GTCTGGGCATAACAGAAGGCTCGCACTCTTGTCTTCTGGTCACTTCTCACTATGTCCCCTCAGCTCCTAT
CTCTGTATGGCCTGGTTTTCTTAGGTTATGATTATGCAGCGAAGATTATTATAATATTGGAATAAATTA
TAATATTGGAGGATTATTATAATATTATAATATTGGAATAATAAATTTGGAAAAAACTAATGATTAATGA
TATTGATATATAATCATATCTATGATCTAGATCTAGTATAACTCTTGTTGTTTTATATATTTTATTATAC
TGGAACAACTCATGCCCTCGGTCTCTTGGCTTGGCACCTGGATGGCTTGCCGCCCACATCTCCCCCCTTT
TTATTAACTAGGATCGCCATCGCCATCATTGCTTGTCGTTGACTTCGGATTTGTTTTCGGACTCCTTGGA
GGCATCTGCAGGCTAAAAGGAGACAACGTAAGCATACCAATATTAATAATGCCAGTGACAACAATGATCC
TCCAAGGGGTTTGATCTATTTAAAGGGATTAAGATCAGATAATTGTTTAGTTATGCCTTCAAAAATGTCT
GAGCCAGGAACAGTGGATAAATGAGCTTGTGAATCCTCGAAAATTTGCTCTTTAAGTTTTGAAATATCCA
AGGTTAAGTTATCATCCCAGGCTTTTAAATGTCTTGAGACATTTTCCCAGCTATGTTGATATTTATTATA
AGCATAAGGCATTATGCAATAATCAGAAGTATTCCAATCACTCTGTAATTGCATACGGTGTTCCAAATTC
ATATCTCCCAGCCAGATTACACTTTGGCGGAGATCATTAATTTGATTAGCTAATTTTTGATCAATTTGAG
CCTGAGAATTCCAAAGTCTGGAGGAGTTTTTCTGCCATGCTTCAATTCAACATATTGAACGGTTTGAACA
GAATTGTGGATGGCAACTCCAGCAGTTGCTGCTGTTGCAGTAACCGCAATTAGTCCTGCAATGATGGCAA
TAAGAGTAAAAATAAATCTCTTTGTTCTTTTGCGGATACCTTTAAGAACTTCATTGACTATGTGAATAGA
GGGGGAAGACTCCCATGGACGATGTAAAGAAACTGGTATCCATACCCCCTCCCTAGCCCTTACCAAGAGA
GTACTTGTAGTGGGATTAAAAGTAGCATCAATGCACGTGAACAGCTTACAGTTATCACATTCTATAGTTT
GTGTATTGGGAATGATAATTATATTTCCAACCAACAGCATGTAAGGGGGTTTGACATAGCTCCTGATGGG
TATCACCCGTTCAGATATGAGGGTGATGTTGAATGTGGGTGTTTTGGTATTAGTGTGAAGGAGTTGATAG
GTAGTGTTCCATATCCTTATTCCTGTCATAGCTGCAGCTAATTTTCATAGTTGAGGATGTTCTGGGGTAA
CAAAGGGATGAATCATTTTTGGTCTAGGAGGAGTAATGCCTGCATCCATCCATTTAAATAGGTAAGGGGA
CACCCATTGTCTCAGCCTGTATGACTGCCATCCATCCTCTACATAATCTAACAAATAATTAAACTCTGAG
CATGAGGTATTTTTGCTGGAGCAATCTTGCCAATAATGCCCTTTTGGAGCCCAATCAATAACAATACCTG
CGGCTAGACTTTGGAGCACAACGGCCTTAGGAGCATTACAATTATTCCATAAAATTGAAGTCACTATAAA
AGGTCCCTTTGTAGGTTTCTTTAACCAAAAGAGAGGCTGGGCACAGTTGCTCACACTAGTAAACCCAGCA
CTTTGGGAGACCGAGGCGGGCAGATCACGAGGTCAGGAGTTCAAAACCAGCTTGGCCAACATGGTGAAAC
```

FIGURE 211 cont'd

CCCTGCCTCAGCTTCCTGAGTGCTGGGATTATAGGCATGTGCCACCACGCGCAGCTAATTCTTGTATTTT
TTCAGTAGAGACGAGGTTTCATCATGTTGCCCAGGCTGGTCTCGAGTACCTGACCTCAACCTGAGGTGAT
CCAACCACCTCAGCCTCCCAAAGTGCTGGGATTACAAGCATGAGTCACCGCACCCGGGCCCCAGTCACTT
TAGAATAGCATGTTGCTTTGTATTCGGAGGGTCTCTCTGCAAATAGCCCATCAACACTGAGCGTGCCTGG
AAAGACCTGGTTTTCAAATAACTGGCTTCGTCTGTGTAAAACGAGTCTTGTTGTATGCATTAAAAATTAT
CTTGGCTGGGCGTGGTGGCTCACGCCTTTAATCCCAGCATTTTGGGAGGCTCGTTCTGTTGCCAGGGAGG
CTGCAAAAGGAGGATGCGGCTATTTCTGCTTCCATCATGGAAGGCTGGGATTCCACAGGCACAGAAGGA
AGGAGGGAGAGATGGGAATGTGACTGTCCTCCAGACACAGCCTCTGGCAGGATCGGATGTGGGAGAGTGA
GGGTCCCACCCCAGCTGGGGTCTACCCAGGTCCATGTCTTGGACATGTTGAGAGTTTTTCTGGAAGGCAG
GGATACAGTGTGGTCCAAAAACACACAAATGCCCCTACTGGCCAGGGGTTGTCACAATAGACTGGAAGG
GTGACACATCCCAGGCGCTTGCCACCCATCACACGCACCTCCTACCCACTGGCATCCTTCCACCCCAGGC
ACACACAAAGCCTCAGTCCAGAGATCAACTCTGGACTCAGCTCTGAATTTGCATATCCTGTGTGTAGATT
CATTCTTCATAACCTCTGCCCAGCCTAGCTTGTGTATCATTTTTTTTTCTCTATTAGGGGAGGAGCCCGT
CCTGGCACTCCCATTGGCCTGTAGATTCACCTCCCCTGGGCAGGGCCCCAGGACCCAGGATAATATCTGT
GCCTCCTGCCCAGAACCCTCCAAGCAGACACAATGGTAAGAATGGTGCCTGTCCTGCTGTCTCTGCTGCT
GCTTCTGGGTCCTGCTGTCCCCCAGGAGAACCAAGATGGTGAGTGGGGAAAGCAAGGGATGGGTGCTGGA
GAGGACTGGAAGGAGGTGAGGAACAGGACATGTGGCTGGGAGACAGGCTGGATGCAGCTGGGATACCCTG
GCATACGGCAGGAATGGGTGCCCAAGGCTGTCAACTCCCTCAGCTCACACACTTCCAGGAGCATTCAGGG
AGCCTCTGCGCTGGCCCGAAATAAGACCTTCAGGAATCTGAATCTAAAACCCCTAGTTTACAGTGAAAAC
AAAGACTCCAAAGACCAAGCGACCTGCTTGGGGTAGACAGTCAGGACGGAGTAGGAACCATATGCCTGGA
GCTGCTTCTGCTCCTGTTCCTTCCCTCCTTCCGATGGCTGGGTACACCTGCCTGACGCTGAGGGAAAGAG
AGAGCAGCCCCAAGGGGAAAGTGGGAAGGCAGGTTGGCTGGAGGGATGGTGCTAGAAGGAAACCCGTGCC
CAAATCCCACACTCAGACACCACTGCAGTGGGTCTGGAAGGCGAGTGGCTGGAAGAGAAGAGAGTGGGAG
CTCCGGGAGATCAAGAGTCACTCCTAGGATAAGGGAAGGAGGCTGTTTGTGGCATGAGAATGTGCAGGAT
AAAGACATGGAAGCGAATGGCTTCTCAGTTGTGTGAGTTTAAAATTCATGACATTTACAAATTGTCAGAA
AAGGTGTTATATGTTTGTTATATAACAATCACTTTGGAATGTTAATCTGATTCTGTGCCAAAATCTGAAT
TACTCAGGGTTCTCCAGAGAAACAGAACTAATAGGTGGTACACATATACATATATATGTACGTACACATA
CATACATACACTGTATACACATGGATACACACACACATAGGAAGAGATTTACATATATGTATACAAAGA
GAGAGAGAGTAGAGATTTATTTTAAGAAATTGACTCACACTATTGGGAGGAGTAACAAGTCCTAAATCTT
CAGAGCCGGCCAGCAGGCTGGAGACCCAGGGAAGAGTTGATGTCTTAGTCTTGATTCCAAGGGCAGACTG
TAGGCAGAATTCTTTCCTCTTTAGGGGACATCTGAGGCTTTTTCTCTTAAGGCCTTCAACTGATTGGATG
AAGCCCACCACTATGGAGAGTAATCCACTTTACTCAAGGTCTACTGATTTTTTGTAAATTAAAAAAAAA
ACTGTGGGTGCATAGTATGTGTATATATTTATGGGGTACATGAGAGGTTTTGATTCAGGCATGCAATGTG
AAATAATCACATCATCAAAAATGAGGTATCCATCCCTTCAAGCTTTTATCGTTTGTGTTACAGACAATCC
AATTATACTTTTTGGTTATTTTAGTTTTTAAAAGTATTTGATTATTTATTTATTTATTTTTGAGA
CAGAGTCTCACTCTGTCACCCAGGCAGGAGTGCAGTGGCATGATCTCGGCTCACTGCAACCTCCGCCTCC
CAGGTTCAAGCAATTTTCCTGCCTCAGTCTCCTGAGTAGCTAGGACTACAGGCACCTGCCACCACACCTGG
GCTAATTTTTTTGTATTTTTAGTAGAGACGGGTTTCATCATGTTGGCCAGGCTAGTCTTGATATCCTGAC
CTCGTGATCTGCCCGCCTTGGTCTCCCAAAGTGCCGGGATTACAGGTGTCAGCAACTGCGCCTGGCCTCT
CTTTTGGTTATTTAAAAGTGTACAATTAAATTATGATTATTATTATTATTTTTGAGATGGATTCTTGTTC
TGTCACCCAGGCTGGAGTGCAGTGGCGTGATCTTGGCTTACTGCAAACCTCCGCCTGTTGGGTTCAAGCA
ATTATCTTGCCTCGGGTGTACACTGCCACACACGGCTAACTTATGTATTTTTAATAGAGATAGGGTTTCA
CCATGTTGGCTAGACTGGTCTTGACCTCTTGACCTCAAGTGATCCACTCACTTCAGCCTCCCAGAGTGCT
GGAATTACAGGCACGAGCCACCACACCTGGCCCCAGTTAAATTATTATTGACTATAGTCACCCTGTTGTG
CTATCAAATAGTAGGTCTTATTCATTCTTCTTTTTTTTTTTTTTGTGACAGAGTTGCCCAGGCTGGA
ATGCAGTGGTGCAATCTTGGCTCACTGCAACCTCTGCCTCCCGGGCTTAAGCGATTCTCCTGCCTCAGCC
TTCTGAGTCGCTGGGACTACAGGTGTGTGCCACCACGCCCGGCTAATTTATGTATTTTTAGTAGAGATGG
GGTTTCACCATGTTGGCCAGGCTGGTTTCGAACTCCTGACCTCAAGTGACCCACCTGCCTCAGCTTCCCA
AAGTGTTGGAATTACAGGCATGAGCCACCACACCTGGCCCCAGTTAAATTATTATTCACTGGAGTCACTT
TGTTGTGCTATCAAATAGTTTTCTAACTATTTTTTTGTACCCATTAACCACCCTCCCAATTTCCCCCCA
ACCCTGCCACTACCCTTCCCAGCCTTTGGTAACCATCCTTCTACTCTCTATGTCCATGAATTCAATTGTA
GGGTCTACTGATTTAAAGGCTAATCACATTTAGACACTCAGGAGCAAGAATAATTTTAGTAATTGAACTA
GGATTCTGCCATATGACCTCCAACATCATTAGCACCTGTGTAAATTGTATCATAAAATAATTATGGAACT
ATTATGGAAATGTCCCTCTCTCCCAGATCCCACCTTGTACCAAAATGCAAGGTACAACCCCGGGAATTCT
GAGCTCCATCCTAGTCTTACCCTGTGCTAATTCAGTCTGGGTCATTTCTTGAATTTTCTGGTAAATTCTC
CTTTCTACCCTTTCTAACTATATGTATTTGTCAGGTTAAGCTAGAAGTGTTAATTTTTTTTTTTGAGA
TGGAGCCTTGCTTTGTCACCTAGGCTGAAGTGCAGTGGCATGATCTCAGCTCACTGCAAGCTCCGCCTCC
CGGGTTCATGCCATTCTTAGTAGAGACGGGGTTTCACCATGGTTAGCCAGGATGGTCTCGATCTCCTGAC
CTCGTGATCCACCCGCCTCGGCCCCCTAAAGTGCTGGGATTACAGGCGTGAGCCACTGAGCCCGGACGAA
ATGTTAATTTGTTTTTTTTGAGACGGAGTCTCACTCTGTCATCCAAGCTGGAGTGCAGTGGCATGATCTT

FIGURE 211 cont'd

```
GGCTTGTTGCAACCTCTGCCTCTCTGGTTCAAGTGATTTTCCTGCCTCAGCCTCCAGCATGACTGGGATT
ACAGGCCCGCACCACCATGCCCAGCTAATTTTGTATTTTTAATAGAGATGGGGTTTCACCATGTTGGC
CAGGCTGGTCTTCAACTCCTGATCTCAAGTAATCTGCCTGCCTTGGCCTCCCAAAGTCCTGGGATTACAG
GCATGAGCCACGGAGCCCAGCCTAGAAATGTTAATTTCTAACGCATGTCAGATTCCATGCACACTGGGCA
AGGTTCCATTCCTCCATGGGGTGACTCAGGGATCCAGGCCAATTGCATATTGAGACTCTTTCATATTATC
CTGTGGCCTTCAAAGTCGTCACCTCTAGGGATGAGAAACAAAGGGACAAGCCAGCTGGTAGGGTCTTGG
ACAAGAAGAAAGACATCACTTCTGCTCACATTCTCTTTTGACAAAACTCAGTCACATGGTCCCAATATAT
CTTCGAGGTGGCTGAGTAATGTTATCTTCCTATGTGTCAAGCAGAGGAAATAATGTAGTGAAGACACAGG
ATGGTCTCTGAAATATCATCTCAGGCATGAAAGTAGAGCATATTCACTTGAGTGAGCCTCCAGTGGTGTG
AAGTTGATGGCAGGAGAAAGAGCTGGGGAAGAAAAGGCCAGTGGCAGGTCTCCCCTCCTAGCCCTATGCA
GCCCCACAGTGGGACCCTTGCATGGACCTCAACCATCAGAATCTTTTCTTTTGCAGGTCGTTACTCTCTG
ACCTATATCTACACTGGGCTGTCCAAGCATGTTGAAGACGTCCCCGCGTTTCAGGCCCTTGGCTCACTCA
ATGACCTCCAGTTCTTTAGATACAACAGTAAAGACAGGAAGTCTCAGCCCATGGGACTCTGGAGACAGGT
GGAAGGAATGGAGGATTGGAAGCAGGACAGCCAACTTCAGAAGGCCAGGGAGGACATCTTTATGGAGACC
CTGAAAGACATCGTGGAGTATTACAACGACAGTAACGGTCAGTGAATAACAGACCACAGGGGTGGAAGGT
CTAACCCAAGAGGCAGCCCCCCAGTGTGAGTGGCAAGGGATCAGCAGGATGGAAATAGTCCCAATCCCA
GGGGAAGAACAGGAGACACAGCAGAAACACAGACATGTCCACATCCCACCCACCCCACAGCACAGGTGCT
CCCCGCTTCCCCATCAATTGCCCCATCCTCATCCCAGGCCTCAGGTCACACAGGAAGTGATGGCAGAGTC
ACTTCCTATCCAGGCACCTATGACCTCTCACCTCCACACCCCACCCATCGGAGGCTGATACCCCGTGAG
AAGGCATCAGACTCACCCCTGTCCAGGGAGGTTGCCTGGAGAGTGAGCCACTCTCAAAGTCACTCAGACC
TGGGCTCACCTGGTGGTTCTGCCAGTCCTAGCTGTTGACAGTGAAACGTTCCCAAAATATCTGGTTGAAA
TCTGCAAACATTGGAGCACTGAGACCTACCTCCAAACAAGTCTGTAATATTTAACTATGTCTGTTCTATG
AAGGATGTCACAGTCTGTCCTGATCTCCCTTGCAGCTCCATCACCTAGCACAGGGTACAGCCAATATTGG
CTCAATTGAAATTTGTGGAATCAACAGAGAAAAGCACCCAGCACACACCGTAGCCCATGCTGGGGGCTCA
GGAAGTGCTGGATTCAAAACTGTGGGCTGTTAGAGTTCCTTGGAGCCCTAAAGTTCCTCCTTACCATACG
ATGCAGACCCAGGAAGGGCCACCTGCGCTATGGTCAGAGGAGCTGGTGGCAGAGCCCGTGCAGAGATGGT
CCCTGTGCCCCGGCCCAGTGCTCTTTCTCCTAAACCACACTGCCAGCCCCAAGGCAGCCAACCTCAGGT
CTGGTGAACTGCTGGTGTTAAATTATCATAGAGTGGGTGTCAAAGATGGGCTACTAAGTACAAAAATGC
CCAAGGTGCTACATGGGATCTGAAGATTTTCAAAAGGAGGCAAGAAAGAGATAGGCAGATGTTTCAAGGA
TGTGGGGTGGGGAGGTCTTGGTAAGGAAAATGGCCCAGGCTGTGTGTCAGCAATAGGAGAGGAGGGGC
ACAGGTGATCAGAAAAGACACTGGGGGAAGCATTGATGGACAGGAATAGAAATGGCAAAGTGGATAATTA
AGAGGAAGGAGGATGAGGAGATGAACACAGGGTATTAGAAAATAATAGAAGGCAGGGCTTGGTGGCTCAC
TCTTGTAATCCCAGCACTTTGGGAGGCTGAGGCAGGCAGATCACCTAAGGTCAGGAGTTCGAGACCAGCC
CGGCCAACATGGTGAAACCCTGTCTCTACTAATAATACAAAAATAGCCTGGCATGGTGGCACACGTCTGT
GGTCCCAGCTACTCAGGAGGCTGAGGCAGGAGAATTGCTTGAACCCAGGAGGCAGAGGTTACAGTGAGCC
AAAATCCTACCATTGCACTACAGCCTGGGTGACAAGAGTGAAACGTTGTCTAAAAACAAAAAACAAAAA
CAAAAAAGGAAATAATAGTAGCTGACATTTACTGAGCACTTACTTTGTGCCAGGCCCATCTATGAGCAT
ATATAATGCTCAGAATAGCCCCCTAAAACAGTGCTCTTGGCATTGCCATTTCAGAGGTGAGGAAATAGAG
GCACAGGGAGTTGAGTGGCTCCAGTTCAGGCAACACACCAGGTGGGGGTGGGGGCTGGGGAGAGACCTG
GGACGTGAGCCCAGACAGCTTGAGAGCTTTCAGAGTCTATGCAACAGCACCAACCAGTGCTGGGTAAAC
ACCTGCTTTTATCATCAGAACAAAGAGGCTGTGTCCCCTGCCCTATGAGGTCCATTTCTGAGAGTTGTGG
CTAATGGGCAAGAAGGTTGGGCTTTAGAGATTTGGGATAAAGATATCAAACACCAGAAAGGTAGAAAGA
AGTGATCAGATTAGGGTTACTTAGGTGATGATATGAACTCTTCCTAGAACTGAGAGAAAAAGAGAGCCTT
CCTTTACTCATATGAAATCACAAATAATTTCTATCCAATTTGGAAGTACACTTTGGTGTAGTTGTGACAG
CTTCCTCAGGACTCAGCATAAATTCAAACAAATAATTGTCCTTAGAAGAGATGCTATAGAAGAGATAGAA
ATATATTCATATTCTGTAGCTTTTTTTTTTGAGATGGAGTTTTGCTCTTGTCACCCAAGCTGGAGTGC
AGTGATGCAATCTCAGCTCACTGCAAACTTTGCCTCCTGGGTTCAAGGGATTCTCCTGCCTCAGCCTCCC
GATAACTGGGACTACAGGCACAGGCATGTGTCACTACTCCTGGTTAATTTTTTTTTTTTTTAAGACT
GAGTCTTGCTCTGTCTTTCAGGCTGATGTACAATGGCTCCATCTCGGCTCACTACAACTTCTGTCCCCCA
GGTTCAAGCGATTCTCCTGCCTCAGCCTCATGAGTAGCTGGGATTACAGGCATGTGCCAGCACACCCAGC
AAATTTTGTATTTTTAGTAGAGATGAGGTCTTACCATGTTGGCCAGGCTGGTCTCAAACTCCTGACCTC
AGGTGATCCTTTGGCCTCAGCCTCCCTAACTGCTGGGATTACAGGCATGAGCCACTGCGTCCAGCCTAAT
TTTATATTTTTGGTAGAGATGGGGTTTCACCATATTGGCCAGGCTGGTCTCGAACTCATGACCTAAGGTG
ATCCATCCTCCTCAGCCTCTCAAAGTGCTGGGATTACAAGTGTGAGCCACTGGGCCTGGTGCTTTTTTT
TTTTTTTTTTTTTTTTTGAGATAGGGTCTCACTCTGTCACCCAGGCTGAAATGCAGTAGTGTGATTT
TGGCTCATTGCAGCCTTGACTTCCAGGCTGAAGTGATCCTCCCACCTCAGCCTCCTGAGTAGCTGGGC
TACAGGCATGCACCACCATGCTGCGCTAATTTTTATATTTTTGTAGTGGTGGGATTTCGCCATATCACC
CTGGCTGGTCTGGAACCCTGGGCTCAAGCGATCCACTCGCTTCAGCTTCTCAAAGTGCTGGGATTACAG
GCATGAGCCACAGCGCCCAGGCTGTAGCTCTCTTAAGGAGGAACATATCTCATCTGAGACAAACCTGAAA
TGCCAAACCAAACTGAGTTAGCCCCTCTCTGTCTGTTGTATATATTGGAGTAATAACCTATTTGTCTTGA
TAAAGGGATTGCATGCTTGAATTGCAAAAACCTTTATTTCTTTTGGGTTGCCCAATGTGCAAGACTAAGA
```

FIGURE 211 cont'd

```
GTTATTTTGATAAATTTCTCACCAGGCTGACTGTCTCTCTGTGGGGTCGGGGGAGTTTTCAGGGTCTCAC
GTATTGCAGGGAAGGTTTGGTTGTGAGATCGAGAATAACAGAAGCAGCGGAGCATTCTGGAAATATTACT
ATGATGGAAAGGACTACATTGAATTCAACAAAGAAATCCCAGCCTGGGTCCCCTTCGACCCAGCAGCCCA
GATAACCAAGCAGAAGTGGGAGGCAGAACCAGTCTACGTGCAGCGGGCCAAGGCTTACCTGGAGGAGGAG
TGCCCTGCGACTCTGCGGAAATACCTGAAATACAGCAAAAATATCCTGGACCGGCAAGGTACTCACTGCT
TCCTGCTCCCCAGTACTGAGCCCAGAATAAAAGACGATCTCAGGCTAGGAGCTCAGGCAACATCTTAGTC
CGGTCTCATCTGTTCCTGGATGTCCCTCAGACCCCCAGCTTTCATCTTTTAGGATTTATTCCTTCCCTGG
GATAATATAATTTGTGGTCCAAAAAGAACATCATCAAAATTTCAGGCAGAATGGGCCAGGAAGGCCATTC
TTTCTTGATGAGTGTCCCCAAATCATCTCCAATTAACAGACAAGGAGCTTGAGGTTAGGGAGGTGAGGGT
AACACTGTCTGTAAGAGGCAGAGCTGGGACTCAAATTCAGATTTCAGATTCCAAATCCCATCGTTTTTT
ATCTCTACAATGATGCCTCCCATCTGGGTGGTGGAGAGAAGGGAGGCGTGTAAAATGTCAGCCCCAGAAG
GACAAGAGCAAGCCAGTGTGAGCGGAATTGATGGCTGCAAGCTGAGACTTGGATTGGAGACGTAGTGAGA
CTCAGGATTGTGCAGTGCTGCAGGGAAGTGGTTGCTGGATAGAGGCATGGGCTGAACCAAGCAGCTGGAC
TGAGACTGGGGACAGAACTCCAAAGCCCACTGAGATGTGGGAAAACATGGAGAAGCACACGGAGCATTC
ACAACTTATTGCCGTCAGAGTCAATACATGGGTGAGGTGGGGATTGGGCAAGAGGGAAAGCGTCAGCCTT
CCCTGATATTCTGGAAAGTCTCCCGGGGCTGGGGGTGGGCAGGTACAGAGCTTCGAGCTCTGCTGATCGC
TGACATCCAGGGGTGGGGGTAGGAAGAGACCTGGGCCGGGAGAAGTCCACCTCAAGCCTGCAGTGTCACA
CTCTATCCCTCCACAGATCCTCCCTCTGTGGTGGTCACCAGCCACCAGGCCCCAGGAGAAAAGAAGAAAC
TGAAGTGCCTGGCCTACGACTTCTACCCAGGGAAAATTGATGTGCACTGGACTCGGGCCGGCGAGGTGCA
GGAGCCTGAGTTACGGGAGATGTTCTTCACAATGGAAATGGCACTTACCAGTCCTGGGTGGTGGTGGCA
GTGCCCCCGCAGGACACAGCCCCTACTCCTGCCACGTGCAGCACAGCAGCCTGGCCCAGCCCCTCGTGG
TGCCCTGGGAGGCCAGCTAGGAAGCAAGGGTTGGAGGCAATGTGGGATCTCAGACCCAGTAGCTGCCCTT
CCTGCCTGATGTGGGAGCTGAACCACAGAAATCACAGTCAATGGATCCACAAGGCCTGAGGAGCAGTGTG
GGGGGACAGACAGGAGGTGGATTTGGAGACCGAAGACTGGGATGCCTGTCTTGAGTAGACTTGGACCCAA
AAAATCATCTCACCTTGAGCCCACCCCCACCCCATTGTCTAATCTGTAGAAGCTAATAAATAATCATCCC
TCCTTGCCTAGCATAACAGAGAATCCTTTTTTTAACGGTGATGCGCTGTAGAAATGTGACTAGATTTTCT
CATTGGTTCTGCCCTCAAGCACTGAATTCATCTGAAACTCTTGGTTTCCCTGGAGGCCATGGTTCCTGG
GCACCTTGACCTGGGCAATCCCAAGTGTGGCCTGAACCCCCTTTCCCTTGGGGATTGTTCAGGTGTCCCT
AGACGCCTTGTGGTATTGTACCTAATACCCATGAAGGGAGAGGATGATATTACTTGCCAGTGTACACCCC
CCTGTGATATTGTTCATAATGTCCAGAGTGAAGAAAGATGATATTACTCCCAATATCACAGAAGGTGTAC
ACCCCCCCTTGATATTGTTCCTAATACCCAGTTGGGGAGGGGAGAATATCTCTCCCAATATACAAGGGGT
GTTTAAACTCTCTGTGATATTGTTCCTAATATTCAGGGGGGACAAGGATGATATTACCCAAATATTGCAG
GGGTTGTACACCCCCCCTTTGATATTGTTCCTAATATCCAGGGGTGGAGAGGATATTACTCCCAATATTG
CAGGGGTCTACATCCTCCCCCCGTGACATTGTTCTTAATAACCAAAAGGTGAGAAGCTGACATTACTCCC
AATACCACAGGGGGTGTACACCCCCTATGAGATATTGTTCTTAATATCCAGGAGGGGAGAAAATGATATT
ACTCTCAATAGCGCAGGGAATTTACATCCCCCGTCGTAATCTTGTTCTTAATATTCAGGAAGGGAGAGGA
TGATACGACTCCCAGTATCGCAGGGGGTGTGCACCCCCCGTGATTTTTTGCTAATATCCAGGGTGGGA
GTGGATAATACGCAGGAAGTGTACAGGTCTCTGTGATATTTTTCCTAATATCCAGGGGGGAGAGGAAGAT
ATTACTTTTAATAGTGTACGGGGGTGTACACCCCTCTGTGATAGTGTTCCTAACATCTTGGGAGGGAGA
GGATGATATTACTCCCAATATCGCAGGGGGTGAAAACTTTTTTTTGATATTTTCCTAATATCCAGGGGT
GGAGACGATGAAATTACTCCCAATATCACAGAAGGTGTACACTCCTTTTGTCATATTGTTCCTGATATCC
AGGGTAGGAGAGGATGATATTACTTCTAATATCGCAGGAAGTGCATACGCCCTTGTGATATTGTTCCTAA
CATCCAAAGGAAGAGAGAATAGTATTACTTCCAATATCGCAGGGGGTGTACAGCCCCCCTTGTGATATTG
TTCCTAATATCCAAGATGGAGAAATTTCTATTATTCTCAATATCACAAAGGATGTACACCACCACCGTAA
TATTGTTTGTAATTTCCAGGGAGGGGAGAGGATAATATTACTCCCAATATCCCAAGGGTTGTACACCCCT
CTGTGATATTTTTCATAATATTTAGGGGTGAAGAGGATGATATAAATGCAAATATCACAGGGGGTGGTCA
CTGTCTTGTGATATTGTTCGAAATATCCAAGAGGGGAGAGGATGAAATTACTCCCAATATCTCAGCGGGG
GTACACCCCTCTGTGACATTCCTTGTAGTATTCAGGGGAAGAGAGGATAATATTACTCCCAATGTCGCTT
TGGGTATTCATTCCCCTGTGATATTGTTTGTAATATCCAGGAAAGGAGACGATGACATTACTTTTAAAAT
CTAAGGGGTGTACACACCTCTGTGATATGGTTCATAATATCCAGGGGAAGAGAGGATAATATTACTCCCA
ATATCACAGGGGGTGTACACCCGCCTGTAATATTGTTCGTAATATTCAGGGTGGAAGAGGATGAAATTAC
TCCCAATATCGCAGTGGGTGTGTACCCCACTGTGATATTGTTTGTAGTATCCAGTCAAGGGAGGATGAT
ATTACTCCCAATACCGCAGGAGATGTACACCACTCTGTGATATTGTTCGCAGTATCCAGAGGGGGAGTGG
GTAATATTATTCCCAATATCGCAGTAGGTGTACACTTCCCTGTGATATTGTCTGTAATATCCAGGGAAAA
AAGAATGATATTACTCCCAAAATTTCAGGGAATGTGTACACCCTCCTGTGATATTGTGCATAATATGCAAGG
GGGAAGAGGATGATATTACAGCAAATATCACAGGGGTGTACAAGCCCCTGTGTTATAGTTTGTAATATC
CAGAAGGGGAGAGGATAATATTACTTCCAAATCACAGGGGGTGTACACCCCCCTGTGATATTGTCCGTAA
TATCCAGGGGGGAGAGGATGATATTATTCCGAATATCGCAGGGGTGTACACTCTGCTGTGGTATTGTTCG
CAATATCCGGGGAGGAGGATGATATCAATCCCAAGATGGTAAACACCCTGTGTGTACACCACCCTGTGAT
ATTGTCCATAATATCCGGGGAAGGGGGGAGAAAATAATATTACTCCCAGTATCGCAGGGAATGTACACTC
CCTGTGATATTGTTTGTAATATGCGGGGGGGAGGGGAGAATATGATACTACTTCCAATATCGCAGGGGG
```

FIGURE 211 cont'd

```
TGTAAACCCCCCTGTAATATTGTTCGTAATATTCTGGGAGGGGAGAGGATGATATTACTCTCAATATTGC
AGGGGGTATACACCACCCTCTGTGATATTGTTCTTAATATCCAGAGGAGGAGAGGATGATATTATTCCCA
ATATCACAGGGAGTGTACTCTCCCTTTGGGATATTGTTCCTAATATCCATGGGAAGAGAGGATAATATTA
CTCCCAATATCGCAGGGAATGTATATCCCCCCCTTTGATATAGTTTCTAATATCCAATTTGGGAGAGGAT
ATTAATCCTAATATCGCATGGGGTGTACACGCTCCCTGTGATATTGTTCCTAATGTTCAGGTTGGGAGAG
GATGAGGTTGTACACCGCCTGAGATATTGGGAGTAGTGTCATCCTCTCTTCCCGTTGATATTAGGAAGAA
TTTCACAGGAGGGGTGTACATCTTCTGTGCTTTTGGGAGTAATATCATCTTCTCCTTCCCTGGGTATTAG
GAGCAATATCTCGGGGGGTGTACATACTCTGCAATATTGGGAGTCATATCGTGTTCTCTCACCCTGGAC
AGTAGGAACAATATCACAGGAGGGGTGTACACCCCCTGCGATATTAAGAGTAGTATCATTTTCAGGCCGG
GTGCGGTGGCTCACGTCTGTAATCCCTGCACTTTTGGAGGCAGAGGCGGGAGGATCACGAGGTCAGGAGA
TTGAGACCATTCTGGTAAACACGGTGAAACCCCGGCTCTACTAAAAATATAAAAAATTAGCTGGGCGAGG
GGGTGGGCGCCTGTAGTCCCAGCTACTCGGGAGGCTGAGGCAGGAAAATGGTGTGAACCAGGGGGCGGA
GCCTGCAGTGAGCCGAGATCGCACCACTGCACTCCAGCTGGGCGACAGCGAGACTCCGTCTCAAAAAAA
AAAAAAAAGTAGTATCATTTTCCCTTCCTGGATATTAGAAACAATATCACATTTGGGGTGTAAAACCCC
TGCTATATTGGAAGTAATATCATCCTCTCTTTTCATGGTTATTAGGAACAATATCACAGGGGTGTATACA
CCTTCTGCGATATTGGGAGTAATATCATCCTTTCCCCACCTGGATGTTAGGAAGAATATTGCAGGCGGAG
GGTACACCCCCTGCGATATTGCCAGTAATATCATCTTATTCCTTCCTGAATATTAAAAATAATATCTCTG
GGGGGGTGTACACCCCCTTCAATATTGGGGGTAATATCATTCTCTTTCCCCGGGATATTGGAAAGAATA
TCACGGGGTGGTGGTGTACACCCCCTGCGATATTGGTAGTAGTATCAACCTCTCACCCCTAAATATTAGG
AACAACATCACAAAGGGGGTGTACACCCCCTGAGTTATTGGGAGTAATGTCATTGTCTATCCCCTGGATA
TTAGGAAAATTAACACAGGAGGTGTGTACACCTCCTGCAATATTGGGAGTAATATCAACCTTTCCCCACC
AGGATATTAGGAACAATATCATGTGGGGGTGTACACCTCTTTCCATATTGAAAGTAATATCATCCTCTTT
TTTCCTGGATATTAGAAACAATATCACAGGAGGTTGTACACCTCCTGCGATATTGAGAGTAATATCATCC
TCTCTCCTTCTGGATATTAAAAACAATATCACAGGCAGGGTGTACACCCCCTGCAATATTGGGAGTAATA
TCATCCTCTCCACTTGGATATTAAGAACAATGTCACAGGGGGTATGTACCCCCCTGCGATATTGAAA
GTAATATCATCTTCTCTTTACCTAAATATTGGAACAATGTCACAGGGAGGGTGTATACCCCCTGCGATA
TTGACCATAATATCATGCTCTTTCTTCTTGGATATTAGGACCAATATCACAAGGGGGGTGTACACCCTCT
GCAATATTGGGAGTACTATTATCCTCTCCCCACCTGGATATTAGGAACAATATCACAGAGAAGGTGTACA
CCCTCTTCGATATTGGGTGTAATATCATCCTCTCCCTACTTGGAACAATATCACGGCATTGGGGGGAGGC
TGTACACTTTCTGCGGTATTGACAGTCACATCATCCTCTCACCCCCTGGATATTAGGAACAATGTCACAG
AAGGTGTGTACACGCCCTACGATATTGGTAGTAATATCCTCTCTCCACCTGGATATTAAAAACAATGTCA
CAGGGGGTATGTACACCCCCTGCGATATTGGGGGTAAAGCAACCTTTCCTTCTTTGGATATTACATAAAA
TATCACAGAAAGGGTGTACACCTCCCGCGATATTGGGAGTAATATCATCCTCTCCCCACTTGGATATTAG
AAACAACATGATGGGGGTTGTACACTTCCTCCGATATTGGGAATAATATAATCCTCTTTTGCCCTCGATA
TTAGGAAAAATATTACATTAAGGGTGTACACCCCCTTCGATATTGGGAGTAATATTATCCTCTACCCCCC
CGATATTAGGAACAATATTACCAGAGAAGTGTACACCCCCTGAGACATTGGGATAATATCCTCTCCCCGC
CTGGATTTTAGGAACAATATCACAGTGGGGGTGTATACCCCCTGCGATATTAAGAGTAATATTATCACAG
GGAGGTGTACACTTTTTGAGATATTGGGAGTAACATCATCCTCTCGCCCCGAATATTAGAAACAATATT
ACGGAGTGGGGATACACTCCCTGCGACATTGGGAGAAATATCATCCTCTTCCCTCTGAATATTAGGAACA
AAATCACAGAGGGTTGTATATTCCTTGCGATATTGGCAGTAATATCCTCTCTGCCCCTGGATATTAGGAA
CAATATCACAGAAGGGTGTATCCCCCTTCGACATTGGGAGTAATATCATCCTCTCTGCCGCTGGATATT
AAAAACAATATTAAAGGGGGGTGTAAAACCCCTGCGATATTAAGGTAATATCATCCTCTCCCCCCCCGGA
TATTAGGAACAATATCACAGGGGGAGTGTACACCCCCTGCTATATTGAGAGAAATATCATACTCTCCTCA
AATGGATATTAGGAGTAATATCACAGGGATGGGGTGTACACGTTCTGCTATATTGGGAGTAATATCATCC
TCTCCCTACCTGGATATTAAATACAATATCACAGGGGTGTTACCCCCCCTGCAATATTGGGAGTAATAT
CATCCTCTCCCATTCTGAATATTAGGAACAATATCACAGTGGGGGTTGTACACCCCCTGTGATATTGGCA
GTAATGTCATTCTCTCCCGCTTTGAATATTAGGAACAGCATCACGGAGGTTGCACACAACCTGCAATATT
GGGAGTAATGTCATTTTCTCTTCCACCTGGACATAAGAACAAATATTACAGGGAGGAATACACCTTCTGC
GATATTGGAGCAATATCATCCTCATTTCCCTGGATATTAGGAAAGATATTACAGTGGGGGTGGACACC
CCTGCGACATTGGGAGTAATATTATCCTCTGCCCGTTGGATATTAGAAAAAACATCACAAAGGAAGTGT
ACACCCCCTGCTATATTGGGAGTAATATCATCCTCTCCCCCTGGATATTAGAAACAATATCAAGGGGGA
GAGTACACCACCTTCGATATTGGGAGTAATATCATCCTTTGCCCTTCTCGATATTAGGAACAATATCGCA
GTGTGGTGTACACTGCCTGCGATATTGGAAGTAGTATCATACTCTTCCTCCCTCGATATTATGAACAACA
TCACAGGGTTGTGTACCCCCCTGCAATATTGGGTTTAATATTGTCCTCTCTTTCCCTAGATATTACTAAC
AATATTACCAGGGAGTGTACACACAGGGTGTTTAAAATATTAAACTTGATGTCATCCTCTCCCCCCCGGA
TATGGCAAGCAATATCACATGGAGGTGTACACCCCCTGTGATATTCGAAGTAATATAATCCTCTCCCTCC
CTGGATATTACAAAAAATATCACAGCGGAATGTACACCCCCTGCGATATGGGGAGTAATATCTTCCATTT
CCTCCATAAATATTATGGACAATATCACAGGGGCATGTGAACCACCCGTGATGTGGGAAATAATGTCATC
CTCTCCCCTTCTGAATATTACAAACAATATTACAGGGGGGTGTACACACCTTGTGATATAGGAAATAATA
TTATTTTCTCCCCCTCTGGATATTACAAACAATATCACGGAGAGGTAATATCATCCTCTCCCCACTGGA
TATTATGAACAATAGCACAAGGGGATGTACACCCCCTGTGATATGGGGAGTAATATCATGCCTTCCCCCC
```

FIGURE 211 cont'd

```
TGCATATTAGGAACAATATAATAGGGGGGTGTACATCTTCTGCGATATGGGGAGTAATATCTTCCTCTCC
CTCCCTAAGTATTACAAACAATATCACAGGGGGATGTCCACTCCCTGTGATATGGGAAGTAATGTCATCC
TCTCCCCTTCTAAATATTACAAACAATATTACAGGGGGGTGTACACACCTTGCGATATATGAAATAATAT
TATTTTCTCCCCCTCTGGATACTATGAACAATATGAAAGTGGGATGTATACCCCCTGCGATATGGGGAGT
AATATCATTCTCTCCCCTCCTGGATATTACGAACAATATTACAATCGGGTGTACACCCTCTACGATATGA
AGAGCAGTAATCTCCTCTCCCCTTGGATATTAGGAACAATATTACAGGGGATGTACACCCCCTGCGATA
TTGGGAGTAATATCATCCCCTCCCCTCCTGGATATTACGAACAATATCACAGACGGTGTACACACAGGGT
GTTTACCATATTGGGAGTAATATCATCTCCCTTCCAGGAGATTACGAACAAAATCACAACGGGGTGTTTA
CCCCCTGTGATATTGGGAGTAATATTATCCTCTTCCCTCCTGGATATTATGAACAATATTACAGAAGGGT
GTACACCCTCTGCGATATTGGGAGTAACATCACTCTCTCCCTTTCTGAATATAATGAACAATATCACAGG
GAAGTAACATCATCCTCTTCCCCCCTGGATGTTACGAACAATATCACAGGAAGGTGTACACTCCTTGCAA
TATGGGAGTAATATCATCCTCTTTCCCCTGGGTATTACCAACAATATCACAGGAGGGTTTACACCATCA
GCGATATAAGAAGTAATGTCACCCTCTCCCTCCAGGGATATTATGAACAATATCACGGGGGGGTGTGCCC
CCTCTGCCATATAAGGAGTAATGTTATCCTCTCATTCCCTGGATATTACAAACAATATCACAGGGGGATG
TACATACCCTGCGATATGGGGAGTAATATTATCCTCTCCCACTGAATATTATGAACATTATCACGGGGC
AGTGTACACCCTCTGCCATATGGGAAGTTACATCATCCTGACCCTCATTGGATATTTTGGAGAATATGAC
TTGTGGGTGTGACCATCCTGCAATATGGGCAGTAATATCATCCTCTCCCCTTCTGGATATTACAAACAAT
ATCACAGGAGGGTGTATACTGCCTGCGATATCGGGAGTAATATTATCCTCCCTCCTAGAATATCACAGAG
GAGTGTACACTCCCTGCGATATTGGGAGTAATATCACCCTCTCCCCTCCTGGATATTACGAACAATATCA
CAGATGGTGTACACACAGGGTGTTTACCATATTGGGAGTAATATCATCTCCCTTCCTGGATATTATGAAG
AATATTACAGGGGGGTGTACACCTCCCTGTTTATGGGAGTAATATCATTCTCTTCCCCTTGGATATTAGA
AACAATATCACAGGTGGGTGTACAACCCCTGCGATATGGGGAGTAATATTATATTCTTTCTCCCTGGATA
TTATGAACAATATCACAGAAGGGTGCACACCCCGGTGAAATGGGGAGTAATAGCATCCTCTCCCCTCCT
GGATATTACGAATAATATTATAGGAGGGTCTATATCCTCTGCCATATGGGGAGCAATATCATTTCTTCCC
CTCTGGATATTACAAACAATATTACAGGGGGTTGTACACACCCTGCGATATAAGGAGTAATATCATTCTC
TCCCCACCTGGATATTACGAACAATATCACAGAGGGGTGTACACCTTCTATGATATAAGGAGTAAAATCA
TCTTTTTTTCCCTGTGGATATTAGGAACAATGTCACAGACAGTGTACACACACAGTGCTTACGATATCGA
AAATAGTATCATCTCCCCCCTGAATATTACAAACAATGTCACGGGGGGGTCCATCCCCTGTGATATTGGG
AGTAATATCATCTTTTCCTCCCCTAAATATTAAAAACAATATCACAGGGGAATGTATACCTCCTGCGATA
TTGAAAGTAGTATCCTCCTCTCCCCCACTTGGTATTAGGAACAATATTACAGGAGAAGTATACACCCCCT
GCGATATTGGGAGTAATATCGTCCTCTTGCCCCTGGATATTAGGGACAATATCACAGGGGGGTATACATC
TCCTGCAATATTGGGAGCAATATCATCCTCTTCCTCCCTGGATATTACAAACAATATCACAGGGGGTGTA
CACACCCTGCGATATGTGGAATAATGTCATCCTCTCTATTCTGGATGCTACGGGCAATATCACAGGGGAT
TGTACCTCCCCTCTTCTAATATCATCCGCTCTTCTGTTGAATATTATGAACAATATAACATCGGTGTAC
AAAGTGACATGCTATTTTAAGGTGGCTGAGAAATTATTAAAGGAGATCATTTTCTCTCTGCCCCTGAAA
ATTATAAATGATATCACAGGGGAGTGTATGTTCCCTGAGATATTGGGAGTAATATTATCATCTCTGCCCC
TTAATATTACGAACAATATCAGCGGGCGTATTACGAACAATTTTATGAACAATATCACACCCCCTGTGAT
ATTGCTCATAATATTCACAGGAAGGGAGGATGATATTCCTCCAGTATTGCAGGGGGTGTACATTCCCCT
ATGATATTGCTTTTACTATTTAGGGGAGGAGAAGATGATATTACTCCCAATATCAGGGGATGAACCTC
CCCCCGTGATATTGTTTGTAATATTCAGGCGGGAGAGAATAATATTCTTTTTTTCCCTTAATATTATGAA
CAGTATCACAAGGGCGTGTACACCCCCTGCAATATTGGGAGTAATATCATTGTTTCTCCTCATGTATATT
TCAAAAAATATCATGGGGGGTGTACACTCCCGTGATATTTGGAGTAATATCACCCTCTTTCCCCTTGGAT
ATTATGAAAAATATCACAGGGGGGGCTGTACACCCCCTGGGATATTGGAAGTAGTATCATCCTCTTCCC
CTCTGGAGATTAGGAACAATATCATAGGGGAGTGTACACCTCCTGTGACATTGGGAGTAATATCATCCTC
TCTTCTGTTAAATGTTATGAACAGTATAACATGGGTGTACAAAGTGACATGCTATTCTAAGGTGACTGA
GAAATTATTAAAAGAGATCATTTTGGCAATGAGACTCTTTGGGTTGGGCCTCTTCAATTTGCACTTGG
ATTTGGTCCTACCTGTGGGAGAATCTAACAGTGGTCCTCCTTTGGGGGAGCAAGCAGTGACTGTCGAAGG
AACCACATTGGGTTCTCTGGACTCCTTTATCATCCCTGATGCCAGTCTATGCTCATGGCCCAGCCCTAC
CCCCAGGTCACCTCCCTTGTCAGGCTCCTGTGTCCCCCACACCCACTTGCTGTTTCATGCTGACCTGGTT
AGAAACACTCTTTTTTTTTTTTTTGAGATGGAGTCTTGCTCTCTCACCCAGGCTGGAGTGCAGTGGCG
TGATCTTGGCTTACTGGAACCTCCATCTTCTGGGTTCAAGTGATTCTCCTGCCTCAGCTTTGTGAGTAGC
TGGGATTACAGGTGTCTGCCACCATGCCAAGCTAATTTTGTATTTTAGTAGAGATGGGGTTTCACCAT
GTTGGCCAGGCTGGTCTCAAACTCCTGACCTCAGGTGATCCACCAGCCTCAGCCTACAAAAGTGCTGGGA
TTACAGTAGTGACCGACCTCCCCTGGCAGAAACATTCTTTTGACCGCCTCTTGGCAAGCTCTTAGGTCTT
CACATCTCTGATACATCATTCCCTACGGGGGTTTTTCTCTGGGTGACTCAGTGGCTCTGTGCCCCTCTCC
CCAACCCTGACACCTGTCCAGGACTTCAGTTTTCTGAGGTTTCCTCCCCCTTGTCCACCCCACTCCTCTT
TCCTGTTACAGATGAGGCCAGATCCCATTTTTAATGTTCTTTAGCCCTGACCTGCTCACACGAGCTTTTG
GTTTCCTTATTGACCTAAGCTGTTGATTCTTTATCCTTTTATTTGTTGAGGGTGTCATCCTTTTTGAATT
GAAAAATACAGTTGCTGTATTTTTCCCTCTTGATTGAGCTTTCTTCCCTGGGCTCTATATGTTCAGATA
GAACTTTTTGCCCCAGAAGAGGAAATGCGGATTTCATTAGTCTGAAGAAGTAATTTCTCAGCTTTGATTT
CCAAGTTGAACCCAAAGCATTAAGAAAAAAAAAAAAAGCGGGTGGTGGGAAGGATAACTTCAAATTTA
```

FIGURE 211 cont'd

```
GGCTTTCCAAAAAGATGAGATGTTTGACTTAGAATTCTGAAGGCTGGGAATGATTTCCTTAAGGAGCCCA
GCTTGGAGGATGGACTTTGGAATAATCCAGAGTGGGAGGCTGAGGACAGGATGTAAGGAAAGTTCTGTGC
CACGGGAAGGAAAAGCACAGACACAGGCAGGTGAGGTTTCATGAGAAGGTCAAGGTGAGAGCTCTGCTGT
GTCTTTTGCGGTTGAAACCTGTGCATGGCGGTTGGTGACTCATTTGAGGAAACTCACTCCCTGGGACTTG
GAGGGGATCTGACAACCCCAGGGCCAATTCCTGTATCCTTGAGCTGTGCCCTGGAGAGCTGAGGGTTCTC
AAACAAGCTCTGGATGTGTGAGCCAAGACCAACATGGTGTGGAGATGCGGAGCGGCTGGAGTGAAGGGCC
GGGTCTCCCAGGAAGCCAAGGAGTGTGGGAAACTGAGGCACAGAAGACGCTTGGGTTTGTGTAAAAGAG
TTTTCAGGCCGGGCGCTGTGGCTCACGCCTGTAATCCCAGCACTTTGGGAGGCTGAGGTGGGTGGATCAC
CTGAGGTCAGGCGTTCAAGACCAGCCTGGCCAACATGGTGAACTAAACACACTAAACACACAAAACACAC
TAAAACACACAAAAATTTCTACTAAACACACAAAAATCAGCCGGGTGTGGTGGCGGGCGCCTGTAATCTC
AGCTACTCAGGAGGCTGAGGCAGGAGAATTGCTTGAACCTGGGAGGCGGAGGTTGCAGTGAGCCGAGATT
GCACCACCGCACTCCAGCCTGGGTGACACAGCAAGACTCCATCTCAAAAATAAATAAATAAATAAATAAA
TAAATAAATAAATAAATAAATAGAGTTTGCAGAATTCTGAGTAGCTCTGTGCCCCATTGCTCCCCC
TCCACATCTGGCCAAGACTTGGATCTTCTGAGGTTTCCTCCCCTTCTTCTACCCCTACCCATCTCTCCTG
TCATGACGCCAGAGCTCACATTCAAATCTTCCTTTGCCCTGGCCTGCTCATGTTGCCCTTTGCTTTTTTT
AAAAAAATTGAAATGTTCCTCCTGTCATGTGCTATTCTTTATTTGCTCAAAGTATTCGACATTACTGTGA
AATGTCACTGGCTGGGCAATTTCCTCCTGAGCGCTTTGGCTTATCTTCTCTGACTAAATGGAATAAACCT
GTTCAAATCAGTATTTTTACATATTGCTCATCCAATATTGTACAGGAAAAATACTAATATGGGGCCAGGT
GTGGTGGCTCACGTCTGTAATCCTAGCACTTTGGGAGGCCAAGGCAGGCAGATTACGAGGTCAGGAGATC
AAGACCATCCTGGCTAACATGGTGAAACCCTGACTCTACTAAAAGTACAAAAAAAAAAAAAAGGGAAAAT
ACTAATATGGGGCTAGGCATGGTTGTTCATACCTGTAATGCCAGTGCTTTGGAAGGCTGAAGTGGGAGGA
TCACTTGAGTCCAGGAGTTCGAGACCAGCTGGGCAACATATTGAGACCCCTGTCTCTACGAAAACCAAAA
AAAAAAAAAAAAAAAAAATGAGCCAGGCATAGTGGTGCATGCCTGTAGTCCTTGCTACCGAGTAGGCTAA
GGAGGAAGGATTGCTTGAGCTCAGGAGTTCGAGGCTGCAGTGAGCTATGATTTCGCCACTGCACTCCAGC
CTGCAATGGCCTGAATTTCCTGTTCAGATCTTTTATGAACCAAATACTACACAACTGTAGTCATGATCTT
CTTGGCTGGAGAGAGGCTGGCTGTCACCCAGGGCCACAGGGTGATTAGGTAGAATGAAAAGAGAGTCACC
AACTCAAGACAGTAGCACAGTGTCCTTGTGGTTTTGGCTGGTGTAGTCTAAAATCTGAATTATGCAAAGT
GTATTTGATCTTGCATCACATCAGGAAAAGCCCAGTAATCTATTTCATCATGGGGTGTGGAGAAGTTGC
TGGAACCATTTCTAGACACAGATTTTGGTTCTCCAGAGGCCAGCAAGTTAGCTTCACTAAGCTTCGGGGC
CCACAGTGGGAAGAGATGTCCTGCTGAGGCTCAGCGTTGACTTCACTCTTGTGGAGCAAAGCTGTAGGAA
CTAAGGGCTTTATGCTAATTAAAAGATGAGGCCAGGTGCAGTGGCTCATACCTGTAATGGGGTCTTGCTA
TATTGCCCAGGCTGGTCTCGAACTCCTGGGTTCAAGCCATCCTCCCACCTCAGCCTCCTGAATCACTGGG
ATTAAAAGTGTGAGCCACTGTGCCCAGCCTCCCTTTTAATAGAACTGGTGCTTAATCCACAGCTCTCCTG
TCAGCCCACAGTTCTTGAATTTTGGCCTCTTTTATGTCCACATGAATGTAAATATACTTCAGAATTTCCA
CCCAGAATCTTTGGAATCTAATTTCTTCAATCATTTTACTTTAGAGTCATTTTTAGGGTAAGTGAATCTG
CCTGGTTTTCAACTTGACACCCTCTCTAAACGTGAATGAGTTCAAATCATATTCGTTCCTGAGGAATCAC
ACTCAAGCATAGTACAAATCTGTGGGATATGCCATTACAACTCTAGGAATCATGTTCTCAAGGTAAAAGC
CTTTAAGAAAAGCTGTCTTGACATATCATGTAAGCATGACAATGGAATACTAAACCAACATAGCTGAGAT
TTTCCTTATGTCCTATGCTTTTAAATGATCAACCCTACAGTCCTGGAACCAACCTTTATGGTTATCAATA
CCTCCATTATTTTAAACTATCTCAGGTATCATATTCCTTCTTTTTTTTTTTTTTGAGACGGAGCCTCT
CACTGTCACCCAGGCTGGAGTGCAGTGGCGCAATCTCGGCTCATTGCAAGCTCCACCTCCAATGGAATAC
TAAATCAACATAGCTGAGATTTTCCTTATGTCCTATGCTTTTAAATGATCAACCCTACAGTCCTGGAACC
AACCTTTATGGTTATCAATACCTCCATTATTTTAAACTATCTCAGGTATCATATTCCTTCTTTTTTTTT
TTTTTTTGAGACGGAGCCTCTCACTGTCACCCAGGCTGGAGTGCAGGGCGCAATCTCGGCTCATTGCAA
GCTCCACCTCCAATGGAATACTAAATCAACATAGCTGAGATTTTCCTTATGTCCTATGCTTTTAAATGAT
CAACCCTACAGTCCTGGAACCAACCTTTATGGTTATCAATACCTCCATTATTTTAAACTATCTCAGGTAT
CATATTCCTTCTTTTTTTTTTTTTTGAGACGGAGCCTCTCACTGTCACCCAGGCTGGAGTGCAGTGGC
GCAATCTCGGCTCATTGCAAGCTCCACCTCCTGGGTTCACGCCATTCTCCTGCCTCAGCCTCCCGAGTAG
CTGGGACTACAGGCACCCGCCACGACCCCGGCTAATTTTTTGTATTTTTAGTAGTGCCGGGGTTTCACC
ATGTTAACCAGGATGGTCTCGATCTCCTGACCTCGTGATCCACCCGCCTCGGCCTCCCAAAGTGCTAGGT
TTACAGGTGTGAGCCACCATGCCTAGCTTTCCTTCTTATATGTATCAAAACTCATACTGAAAATGAGTT
CTGGGTTACAAAAGAGGGTTTATTTTTGCACCTGCCTTTGAATCAGTCCTTAAGCTTAACCTTTAACTT
CCAAGGAACTACTTTTTTTTTTTTTTTTTTAGATAGAGTCTCGCTCTGTCACCCAGGCTGGAGTGCAA
TGATGCAATCTCGGCTCACTGCAACCTTCGTCTCTTGGGTTCAAGTGATTCTCCTGTCTCAGCCTCCTGA
GTAGCTGGGATTGCAGGCATGTGCCACCATGCCCTGCTAACTTTTGTATTTTTGTAGAGACAGGGTTTC
TCCATGCTGGTCAGGCTGGTCACGAACTCCTGACCTCAGGTGATCCACCTGCCTCAGCCTCCCAAAGTGC
TGGGATTACAGGCATGAGCCACCGTGCCAGGCCCCATCCCTGGTTATTCTTATTCAGTAAAATTTGCAAC
CTCCTAGGAAGAAAGGATTTTGAAAACAAAACTCTTTTTTAAAACTTTTATTTTAGGTTTGGGGGTACGT
GTGAAGATTTGTTACATAGGTAAACATGTGTCATCGTGGTTTGTTGTATATATTATTTCATCACCCAGGT
ATTAAGCCCAGTACCCAACAGTTGTCTTTTCTGCTCCTCTCCCTCCTCCCACCCTCAAGCAGACCCCAGT
GTCTGTTGTTTCCTTCTTTGTGTTCATAAGTTCTCATCATTTAGCTCCCACTTATAAGTGAGAACGTGTG
```

FIGURE 211 cont'd

```
GTATTTGGTGTTCTGTTGCTGCATTAGTTTGCTAAGGATTATAGACTCCAGCTTCATCCATATTCCCTCA
AAAGACATGATCTTGTTCTTTTTTATGGCTGCATAATATTTCATGGTGTATATGTACCACAGTTTCTTTA
GCCAATCTGTCACTGATGGGCATTTAAGTTGGTTCCATGTCTTCACTGTTGGGAGCAAGCCCCCCAAAAT
CTGGCCATAATCTGGCCCCAAGACTGGTCATAAACAAAATCTCTGCAGCACTGTAACATGTTCATAATGG
CCCTAACGCCCAAGCTGGAAGGTTGTGGGTTTACAGGAATGAAGGAATGAGGGCAAGGAACACTTGGCCT
GCCCAGGGCGGAAAACCGCTTAAACGCATTCTCAAGCTGCAAACAATAGCATGAGCGATCTGTGTCTTAA
GGACGTGTTCCTGCTGCAGTTAACTAGCCCAACCTATTCCTTTAATTTGGCCCATCCCTTTGTTTCTCAT
AATGGATACTTTTAGTTAATTTAATATCTACAGAAACAATGATAATAACTGGTTTGCTGTTACTAAATAT
GTGGGTAAATCTCTGTTTGGGGCTCTCAGTTCTGAAGGCTGTGAGACCCCTGATTTCCCACTTCACACCT
CTATATTTCTGTGTGTGCATCTTTAACTCCTCTAGCGCCGCTGGGTTAGGGTCTCCCCAACCGAGCTGGT
CTCGGCACTTCAGTATTGTAAATAGTGCTGCAATGAACACTCATGTGGATGTGTCTTTGTTTTTTTTTT
TTTGGAGACGGAGTCTAGCTCTGTCACCCGGGCTGGAGTACAGTGGTGCAATCTTGGCTCACTACAACCT
CTGCCACCTGGGTTTAAATGATTCTCCTGCCTGGGCCTCCTGAGTAGCTGGGATTACAGGTGTGAGCCAC
TGTGCCCAGCTAACTTTTGTATTTTTAGTAGAGCCCAGGGTTTCATCATGTTGGCCAGGCTGGTCTTGAA
CTCCTGACCTCAGGTGATCTGCCTGCCTTGGCATCCCAAAGTGCTGGGATTACAGGCATGAGCTACCACG
CCTGGCCCATGTGTCTTTATGGTAGAATGCTTTATGTTCCTCTGGGTATATACTCAGTAATGGGATTGCT
GGGTCGAATGGTAGTTCTGCTTTTAGCTCTTTGAGGAATCGCCATATTGCTTCCCACAATGATTGAACTA
ATTTACATTCCCAGCAACAATGTGAAAATGTTCCCTTTTCTCTGCAACCTTGCCAGCATCTGTCATTTTT
TGACTTTTTAATAATAGCCATTCTGACTGGTATGAGATGGTATCTCATTGTGGTTTTGATTTGCATTTCC
CTAATGACCAGTGATGTTGAGTTTTTTCATATGTCTGTTGGCCGCCTGTATGTCTTCTTTTGGGAACTGT
CTGTTCCTCTCCTTTGCCCACTTTTTCATGGGGTTGTTTGTTTTTCTCTCATAAATTTGTTTAAGTTCCT
TATAGATGCTAGCTATTAGACCTTTGTCAGATGCACAGTTTGCAAATAAAACAAAACTCTTAATGTCTTC
ACTTGCCAGATATTTGTGCTTAGGTTGGTGTTTGAGTCTTAGGAGTAATATCATGTTTTGCCACAAGAAG
GAGCCTATGAGTGGGCTGGAAGAGAAAAATCAGATTTGCAGCCGCTGAAGTCAGTAAACAGTTTCTTTGG
ATATATTGTAAATAGTAAGAGAACCAGACATGACATTCATAAGTATTCCAAAACCAAGTAAAATTATTTT
AAAGCTCTAACGTTTTGCAACTTTTCTTCCCGTCTTAAGAGTTCATCTGCCCAGTCTAATGATTGTAGAA
TTCTTACTTCTAGTCTTTTTTTTTTTTTGAGATGGAGTTTCACTCTTGCTGCCCAGGCTGGAGTGCA
ATGGTGCTATCTTGGCTCACTGCAACCTTCGCCTCCTGGGTTCAAGCCATTCTCCTGCCTCAGCTTCCG
AGCAGCCACAATTTCAGGGATGCGCCACCACACCCGGCTAATTTTGTATTTTTAGTAGAGTTGGGGTTTC
TCCATGTTGGTCAGGCTGGTCTCGAACTTCTGACCTCAGGTGATCTGCCCACCTTGGCCTCCTAAAGCGC
TGGGATTACAGGAGTGAGCCACTGTGCCTGGCCATCATTTATCTTACTTTTAGCATCCTCATCCCAAATT
CCTGGTGTCCCCATCCCTACCATCCATTTGTAATAATTCTCCATTGTTTTCCTCTCCTTGAATCCCACTT
TCTGAGATCAGTGCAACCTGGGCTTAGAGCTTCAACCTCCTCCATCTGATTTTTTAAAAGAGTAACTCCT
AATAAGGATTTTACCCAATATAGTGAGCATTATGATTAATGACCCTGACTCTACAAAAAATAATTTAAAA
AAATTAGTCAGGTGTGGTGGCGCATGCCTGTAGTCCCAGATACTCAGGGTGAGGTGGGAGGATTGCTTGA
GTCCAGGAGTTTGAGATCACGGTGAGCTGTACTGCATCATCACATTCCAGCCTGGGCAACAGAGTGAGAC
CCTGTTTCTAAAACAATTAAGGTAAAATAAAAGAAATAACATGCACCTGGTACACAGTACTTAATAAATC
CCGTCTACTGTAAATACCTAGTGCCCATCATCCCTGTAACTCATAACTTCTTCTTTCCCAGTTCCCCGTG
CTTTAATCACTCCTGCTTAGGAGACAGTCCAGGCTACCTTCTTATCTCTCTTCCTGGAGCCAGATTCTCA
GCATTTTGTTCTCTAATTCCACCCTTTACCCCTTATTGCATGCCTTGGTATCAGCACTTCACCTGGTCTG
AGGAACCAGCATCTAGTCTTGCCCTGTGTCTGGTAGTCCATATGGCCTGTATGTATCACTTAGTCTGAGT
CAGTTCCACGTGTGTCAGCTGGATTAGTAGCTCCTTAGGGTTCCGTGTAGTTCTCACAGTCTGTGGCAA
GGAAAACAACAATTTGTGAGTAGCTAGCATGGACTGCAAACTATGGGCTCTATTTACCAAGCAAGTTCTA
AATGCTGAACATTGTCTTTGGCAAAGGGGTTTCAGGGAAGATCAAGAGGCACATCTTCCCTGCCCTCAGG
AAACTCATATAGGCTGGTTTTGCTACACTGAATTCTCACAACTCATTGATGCAATGCAGCCTAGAATTAA
GTTACTTGCTCATTGTCAAGCAGGTAGTGACTAGCAGAGCCACCATCCTGATTCTTTCTTAGTTTCTTTT
TTTTTTTTTGAGTTAGGGTCTCGCTCTGTCACTCAGGCTGGAGTGCAGTGGTGCCATCATAGCTCACTG
CAGTCTCACTCCTGGGCTCAAGCGATCTTCCTGCCTCAGCCTCCTAAGCAGCAGGGACTGCAGGTGCACA
CCACCATGCCCAGCTAATTTTTAAATTTTTGTAGAGGTGGGAATCTTGCTCTTTTGCCCAGTCCGGTCTG
GAACTCCTGGCCTCAAGCATCCTCCTGCCTTGGCTTCTCAAAGCACTGGAATTACAAGCATGAGCCACCA
TGTCCAGCCCTAAGTCTGATACCTTCTAAGAGGGATCATCCTCAGATGAGTTGGGTGTGGAGGTGAGAGG
TCAGGGGTGCCTGGATAAGAAGTGACTCTGCTATCACTTCCTGTGTGAGCTGAGGCCTGGAGAGAAGATG
AGAGAATGATGGGGAAGGAGGAAGCAGATGTGTTGTGGGGTTGGGAAATGGGAAATGTCTGTGCATTTC
TACTTTTACCTTTGATCTCTCCTTCAGGGCTTTGATATTTTCTTCCTGCTAATCCTCCTTTTCACACCTG
CTTGGGGCTGCCCCATGAGCTTGTGAAAACAGCATGTTTCTACCTTCCAACCACAGTCCAGTGCATTG
GCCCTCTCTCTCCTTGGCAGAGTCTACGATGTTTTTCAAGGTTACCATGAAGATTTCTTTCTTTTTATT
TAATTTTAATTTTATTTTTTTTGAGATGGAGTTTCGCTCTTGTTGCTCAGGCTGGAGTGCAATGGCACG
ATCTCAGCTCACTGCAACCTCTGCCTCCCGGGTTCAAGCGATTCTCCTGCTTCAGCCTCCCAAGTAGCTG
GGATTACAGGCATGTGCCACCATACCTGGCTAATTTTGTGTTTTTAGTACAGACAAGGTTTTTCCATGTT
GGTCAGGCTGGTCTTGAACTCCTGACCTCAGGTAAGCCACCTGCCTTGGCCTCCAAAGTGCTGGGATTA
CAGGCAGGAGCCACTGTGCTTGGCTTTATTTTATTTTTTAAGTTCCTGGGTACAAGTGTAGGATGTACAG
```

FIGURE 211 cont'd

```
GTTTGTTACATAGGTAAACGTGTGCCATGGTGGTTTGCTGCACGTATCAACCCATCACCTAGGTGTTAAA
CCCTGCATGCATTAGCTCTTTTTCCTAATGCTCTCCCCTAACCTACATCCTCCCCTGACAGGACCCAGTG
TGTGTTGTTCCCCTCCCTGTGTCCATGTGTTCTCATTGTTCAGCTCCCAGTTATAAGTGAGAACATGCAG
TGTTTGGTTTTCTATTCCTGCGTTAGTTTGCTGGGGATAATGGTTTTCCAGCTTCATCCATGTCCCTGCA
AAGGACATGATCTCATTATTTTTTATGACTGCATAGTATTCCATGGTGTATATGTAGCATATTTTCTTTA
TTCAGTCTATCATCGATGAGCACTTGGGTTGATTCCATGTCTTTGCTATTGTGAATAGTGCTGCAATGAA
CATATATGTGCATGTATCTTTATAATAGAATTATTTATATTCCTTTGAGGTATATACCCAGTAATGGAAT
TGCTGGGTCAAATGGAATTTCTGGTTCTAAATCTTTGAGGAATCGCCACACTGTCTTCCACAATGGTTGA
ATTAATTCACATTCCCACAAGATTTCTTTCCTGACTTTCTGAACTTGGATCTTCTCCTATCCTCCATCCC
CACCCACCTGGCTCCAGGATCCCAGAGACTCAGCCTTCCTGCATTCAAAACCATAGTGGAAGAAGGCCTGA
TTGCTGGGGTGGGCAGTGGCCTGAAACCTGGGGAGGACTTCACTGGGCCTAAACATTCTGGTGTAGAGAA
AGTCACTAAGTAAGGACTTGTGAAAATGTAGAGGACTTTGCGGTGGGGGTGAACTGCAGAGTCCTACTGT
GGGGCAGCAAGAAGTCAAGAAGGAGGACCTGGCAACTGGGGTCAAGAGCTGCCCACATGCTCTTCATGTC
CAGCCTTTTTTCTCCTGTCAGCTTTCTAGTGTTGCATGCTCATATGGGCAGAAAGACTTGCCATTATATG
CTAGAAAGCACATGGTGGAGGCTGGGCGCGGTGGCTCACTCCTGTAATCCCAGCACTTCAGGAGGCTGAG
GTGGGTGGATCACCTGAGGTCAGGAGTTTGAGACCAGCCTGGCCAACATGGTGAAACCCCATCTCTACTA
AAATACAAAAAATTAGCTGGGCGTGGTGGCAGGCACCTGTAATCCCAGCTACTCGGGAGGCTGAGGCGGG
AGAATCACTTGAACCTGGGAGGCAGAGGTTGCAGTGAGCTGAGATGGCACCACTGCACTCCAGCCTGGGT
GACAGAGCTAGACTCTGTCTCCAAAATAAAAAAAAAAAAAAGAAAGAAAGAAAGTACAGGAAGGAGAATT
TATTAGAAAATTCAGGCAGCCTGGGCAACATAGTGAGACCACGGCGCTACAAAAGAATACAAAAAAAAAA
AAAAAAAAAAAGGCTGGGCGCAGTGGCTCAAGCCTGTAATCCCAGCACTGTGGGAGGCTGAGGAGGGTGG
ATCATGAGGTCAGGAGATCGAGACCATCCTGGCTAACACAGTGAAACCCCATCTCTACTAAAAATACAAA
AAAAAAATTAGCTAGGCATGGTGGTGGGCGCCTGTAGTCCTAGCTACTCGGGAGGCTGAGGCAGGAGAAT
GACGTCAACCTGGGAGCGGAGCTTGCAGTGAGCTGAGATCACGCCACTGGACTCCAGCCTGGGTGACAGA
GCTAGACTCCGTCTCAAAACAAACAAACAAACAAAAAAAAACCACACAAAAAAACAAAAAAAATTAGCCA
AGCATGGTGGTGTACACCTGTTGTCCCAGCTACTCAGGAGGCTGAGGTGGGAGGATCACTTGAGCCTGGA
GGTTGAGGTTGCAGTGACCTAAGATCGTGCTACTGCACTCCAGCCTGGATGATAAAGTGAGACCCTGTTT
CACAAAGAAAAAGAAAAAGAGTTAAAAAAATCCAGGCATGAACAGGAAGGGATGAGCATGGAATAAAACC
AGGATGCTGCCTCCGTACCACCAGTTCTTTGATTTCAACTTGTTGCTCAGTTGAATCATTGCCATACTGG
TGAGAAAGAAATGTATTTGCTGACTGTTGGTCAATATTACAGATTTAAAACCTGTGCACTCTTAAGACCT
CACCAGTTTATAGTTTTGTTTCTTCCAGATTTCTGCGGAAAGATGGGCCCAAGGCTGGCTTTGCTCCCTT
TTCTCTAGGTCACACAGTATCCTAGGCCCTGTGCTGTTATATTTGACTCTGTGGAAGATGCTTTGTTTTC
AGTTCTGAGCCTTTTCTTCTGCTGATTCCTTCTCAACCTTTGTTCCTTGTGTCGCTCACCCTCCCCCAAA
CCAGGTAGATGCACCCAGGTGTGGAAAAGAGGGAGGGAGAAGAAAGATCCCTTCTGTCATTGATACAGGA
GCTAGAAAAAAATTATTTAGGCAGATAGTGAGGGTAAGAGAGTCCGTGGTAAGATTTCCCTTTAATGAAA
AGCAGCCCCCAAATAATTTCTTTTCTAACAATAAGCAGCCTGAAAAATTAAGCTGCAAGCATAGATAAGC
AAGCTAAAAGCTTGCATAGGTAAATGCCAACAGCTGTGCCAATAGAAAAGGGACACCTGGAAGCCAGGTA
TATTCAACATGGAGGTGCCCTCTTCCCTTTCCTTTGTCAACACGCTTGCAGTAAAAAGCAGGCAACGTG
GTGATGGCCAAGTAGAGACCCCATCTGCATAATAAAAGGTTAAGGTGAGATGGCCAACTTGTTGGTGCGC
TATGCAAATGGCACACCTGGTCTGACTAATCTCTCGGGCCCTATGTAAATCAGACACTGCCTCCTCAAGC
TTGTCTATAAAACCCCCCCCCGTGCATTTCACCACAAAACCGGAAGACCCACTCGGAAGTCCCTCTCTC
TCTGCAGGAGAGAGAGCTTTTCTTTTTTCTCTTTCTTTTGCCTATTAAACCTCCAATCTTAAACTCCTCC
TTGTGCGTCTCCACCTTCTTGATTTCCTTGGCGTGAGGCAATGAATCTTGGGTATTACTCCAGACAAATG
ACGCCACTTCATCATCGTTCTTGGGGCACAGAGGTGCTGAGCTTCCACATTTCTCTTCGCTCCCTACTCT
TGGGTGAGCCCTTCACCCTGGGTACCCTGTTGCCCCAGGCCTTGGCACGTGTTGTCAACGTATGGCTGTG
GGAGGAGGCTGGTCTTGTCTGGTGGGAAGGAGAGAGACAAAGAGGGCATTGTTGATAGAAGAAGTGGAAT
GAGAGCTCCCTTTACCCTTGGGGGCTTCTTTTCTGGCATTAATCCTCAGAAAATAATTGTGAAAGAGAAG
TTTGTCTTTGTGCTTTAGGGTGCTGTCAGAAGCTTAGAAATAATTAGGCAGAATCCCCATCCCCCCAATC
CCCATCACCAACTTTAGTCTCCTCCCCCGATACCCACACTGACCCAGGGTTAGGGACATTTATAAATGGA
GCCATTGAGGACTCAGGAGAAACTCATGCAACTGAAAAATGTCCCCTATTTCCTGGGTCCTAGGCAGCTC
CCCACTTTCCACTCCCACTTCAGACATTTAGACAAGGACTTTGGTCACTCTGGCTAGACCATCTGTGTAA
CCCAGAATGGTGGGGTCACAACTCTTGGTTTCCAAGGATATAATCACATGTTGTGAGCAAAAATGTGCTG
AACACACCTGACTCTGTGGCTTCTTCTTGAAGTGATTTTGCAGAGCGGGGAAGGGTCGACTCTGGAAA
CGTTTCATTTGTCTATTGGCCATTTGGATTTCTTCTGTGAAGTGCCTTTTCATGACTATCATCTATATTC
TCTTAAGTTTGTCCTTGTTATTGATTTGTAGTTCTTTATATATCCCTGATAACAAGGCTTGCTTTTTCAT
GCTCTTTATATATTTTTAAAAGCAGCTTTAGCAAAGTGTAACATACAAAAATCTGCACATAAAATGTA
AAATGTGATGTTTTGACATATATATATATGCACTGAAACCATCCCTATTAATTCCATTGTGATCAAAGAC
ATATATTGTATCACTTAAATCCTTTTACATGTATCCAGGCTTATTTTATGGTGTAGAACATGATCTATCT
TGGTAGATGTTCTGTGTGCTCTTGACAAGAATGTATTGTTGCGTAGAATGTTCTATTGTCAATTTTGTTG
ATTAGGTCAATTTGGCTTATAGTATTGTTCAAGCCTTCTATTTGTTTACTGATTTTCTGTCTACTTGTCC
TATCAATTTTTGAGAGATGGGTGTTGGCTCCTTAACTATTTTGTGAATTTGTCTATTTCTCCATGTATTT
```

FIGURE 211 cont'd

CTATTAATTTTTGCTGTACGTATTTTGAAGCTCTGTTATTACGTGTGTAAACATTTAGGATTTGATAAAT
GGACTCATTTGTAACAATCAAATATCTTCTTTATCTCTGGTAATATTTTTTGCTCTGAAATCTACTTTGA
TATTAATATAGTCACTGTAGGTTACTTTTGATTAGTGTCAGCATGGTATATTTTCCATTATTTTACTTTT
AACCTTGTACCTTTATAATTAAAGTGAGTTATCTTTGGGCAGCATACTGTTAGGTCTTGCTTTGTAAGTT
AATATGTTAATCTCTGCCTATAAATTGGAATGGTTAGATCATTTATATTTAATGTGATGATTTGTATGGT
TAGGTTTAAACCTCTCATGTTGCTATTTGTTTTCTATTTGTGCCATTTGTTTGATCTGTTCCCCCTTTCC
TCTTTTTCTACCTTCTGTTGGATTGAGCATATATTTTATATATAATTTTATTTTTACCTCCATGTTTGTAT
TATTAACTATAACCCTTTTTGGGTTATTTTAGGCTTATGGTTTATATCTTCATGTTATTAGTCTACTTCA
ATTGATATTATAGCACTCTTCACACATTGTAAGAACCTTACAGTATACTCCCATTTCTTCCCTCCTGGCT
TTTATATAATTGTTACCATATATCTTACCTCAATATATGCTATAAACCCCATAATACATTGTTATCTTTT
CGCTTTAAGTGAAAGATTATCTTTGTCTTTATCTTTAGAGATAAAGTGGGGAAGGGTTGACTCTGGAAAC
GTTTCATTTGTCCATTGGCCATTTGGATTTCTTCTGTGAAGTGCCTTTTCACGACTATCATCTATATTCT
CTTAAGTTTGTCCTTGTTAATTATCTTTATCAATTATCTTTAAAACGATTTAAATAATAACAAAAATAAT
CTTTATATTTACCCTCATAGTTACCACTTCTGGTGTTCTTTATTCTCTAACGTAGATCCAGGTTTCTATC
TGGTTTCAAATTCTTCTAGCTCAAAGGACTTCCTTTACCATTTATCATGGTGCATATATGTTTTTTCATT
CACTCTGGAGATGAATTCTTCCAACTGTTATATATCTTAAAAAGTTTTAATTTTTGCCTCAGCTTTTGAA
AAAAAATATTTTTGAGATAGGGTCTCCCTCTGTCACCCAGGCTGGAGTGCAGTGATGTGATCATAGCTTA
CTGCAACCTCCACCTCCCAGGCTCAAGCTGTCCTCCCACCTCAGCCTCCCAAGTAGCTGGACTACAGGCG
TGTGCCACCACACCTGGATAATTTTTGTATTTTTTTGTTTGTAGAGACGGGGTTTCACCATGTTGCCCAG
GCTGGTCTTGAATTCCCAAGCTTAAGCAATCTGCCCACTTCAGCCTCCCAAAGTGCTAAGATTACAGGTG
TAAGCCACCGTACCTGGCCTGAAAAATATTTTTGCTGGGTATATAATTCTACATTGGCAATTTATTCCTT
TGATTACTTTAAACATGTTTTTCCACTGTCTTCTAGCTTATATTGTTTCCAACAAGAAAGCTACTGTCAT
TCTTATCTACTGTTGGTGCCCTGTCTAGATGTCCTTTTCTGGGCTGGCATGCCCACTCACAGGCTGTTGT
TAATGGTGGCTATTATTGGCTCATGAACTCTCTCCTTTTCTAAATAGATGGCTTGGCCGGGCATGGTGGC
TCACGCCTGTAATCGCAGCACTTTGGGAGGCCAAGGCAGGCGGATCACGAGGTCAGGAGATCGAGACCAT
CCTGACTAACACGGTGAAACTCTGTCTCTACTAAAAAGACAAACAACTAGCCGGGCATGGTGGCAGGCGC
CTGTAGTCCCAGCTACTCGGGAGGCTGAGGCAGGAGAATGGCGTGAACCCGGGAGGCGGAGCTTGCAGTG
AGCCGAGATCATGCCACTGCACTCCAGCCTAGGTGACAGAGTGAGACTCCATCTCAAACAAAAAAAATAA
AAATAAAAAAAGAGATGGCTTCACCCGGGATAATATGATTTCTTCCTCTCCCGATGGCATCCCAATGC
CAATGACTGAATGTTATTGGAGTACAAAAGAACAGCCCTTTTACCTCAAGTGGATAAAATCTGTGGTATG
ATTTATGCTTCAGGGTCCCCTGTGGACAAGATCAAGTTCAAACCTTACCTGAGATCACATTTGGCACAGT
TTTTTTTTTTTTACATTACCTTTTCTGCTTCCTCTATTTCCTTAGAGATTTTTACTGGTGAGTCCAACC
TAAAAAATCACATGTATTCAAGTCTCTTTTAAGTTCTGCTTCTAAGGAATCAAACCTAAGACAGTGGGTA
CCAGGAGCGGTTCCTAGGAAGCACAACATAAGAATGGGATTCTAGGGCTGGGTTACTTGTCAGCCCTCTGG
CAAGGGGGACAGCCATGTTGATGGCAGGCATAGTTTCTGACTTGCTTTAGCAGTGCAAGTGTTAAGACTT
TTACTCGGAATAACTAGGCTAGGACACAGGTGGAATTAGATTCACTGGCTGATGTAATGTGTCTGGCATT
TAAGAGATATAAGACAAATTGCAAGTATAAGGGCTATGGAGCCAGGTGTGGTGGCTCACGCCTGTAATCT
TAGCACTTTGGGAGGCTGAGGCAGGTGGATCATCTGAGGTCAGGAGTTCAAGACCAGCCTGGCCAACATG
GTGAAACCCCATCTCTACTAAAAAGTCAAAATTAGCCAGGCATGGTGGTGGGCACCTGGAATCCCAGCT
ACTCGGGAGGCTGGGCAGGAGAATCACTTGGCGGAGGTTGCAGTGAACTGAGATCACGCCATTGCACTC
CAGCCTGGGTGACAAGAGTGAGACTCTGTCTCAAAAATAAAATAAAACAAAACAAATAAAATAAAATAA
AGGACTATGGAATTAGGTGGCTATTACTGAGCTTCAGTGATGCCTTAAAGAGAAAAAAATGAAAGGCTCA
GGACAATAAGTAATCAATTTAAAGCAAAATATAAGAGTTACAATGCCTTCTTGGCAACATTTAAAGAGAC
CCTTATCTCTCGTTGCCTGAAGGCAGAGAGACCAGGCTGAATATTTAACTTTAAGAGTGGCATAACTACA
GAGAAGTTCAAATTTTTCAGCCTAGGGAAGTTTCTAGTACCAAAACCAGGACCTCAATAGGAAAGAATAA
GACCCTGAGACATGGGATGGTGATATTAGATAGATGCCCTTTGAGGTCCTTGGATCATCAGATTATTCTG
GACCATTTGGACCTGCAGAAGTGGCTCACACTTTTTATTGGAAGATAGAGGCCCACTCTTGCTTGAAAAC
CTTGCAAAAGTCTTACACTAGACAAATTCATTGTAAGGAAATGCTGGCTCCCCTCAGGATGTGTTGCACC
TCCCCCTTTGGCCACTAGACCCATAACAAAAATCAAATCTTAGCATGGCCCAACTGGGGAAGTACTTGAC
TTACTAAGGAGAGGGATGGATTAGATACTAAAGGAGCTTCAAGACTTGGACAACATGTGTCATCAGGAGC
AAGGAAAATAAATCAGAGAGAAGATTCTGAAGATCCTGGATCAAAGGGAGGGGACTAAAAATAGAAAGCT
GGATGTAGGAGTTTGTCAATATAGGGCATTCTTATGGGACACAGGATTTAACACCCTAGCAAGTTTATTC
TTAGGAGGTTGATATGAAATGATACTGGGGTGGCTTTTGGAAAGCTGGAAAACAACAAGAGCTTCTATTA
ATAAAGTTGAGATGTCAGAACTCATATGGAAATTGTGAGTAAAGGGTTCACAGTTCTCAGAGAAATGGA
TGTGGGAGAATAGATCTATAACAAAAGATTGGAAAATCCACCACCAGACTCTATTCCTTGGGAAGTCCTG
GATAATACTCATTTTCACCAAAGAAATAATGAATGTGCTGGTGATGAGGAGTTTAGAAGCTGTAAGAATC
TCAGTAGTGTTCATCCTCTGTAGACGGAGGCTGACAGCAGATGCCCTTATATACTGGATATACTGGTTCC
CTAATAGCAATAGGAATGATACGATTCTGAATCAGCAGAAGCTATTTGGCAGCACTTAATAATCAGAAGC
AAAGTAGTTATTATTATTATAATAATCAGGAAGGTTGAAATTATGGCCAAAGGGCCTTGACCTTCAGGGA
TCTGTGGAGATGGCTAATAGAAAATAGTGTTTCCATGGAGAAAATATACGGTTGCAAATGCATCACATTT
GCTATCAACAAACTCCAAGTAGGATAAACTCAAAGACATCCATACTTAGGTACATGATGATCAAACTGTC

FIGURE 211 cont'd

AAAAGTCAAAGACCAGATAAAACAACAACAACTTAAGAGAGAATCTTGAAAGTAGCAAGAGAAAAGCAAC
TCATTAAGGACAAAGGATCCTCAATAAGTTTAACAGCTGATATCTCCTCAAAACCATGGAGGCCAGAAGA
CACTGGAACGATATACTCAAAATGCAGAAAGAAAAGGGCTGTCAGTCAAGGATTCTACAACCAGCAAAAG
TATCCTTCAAAAATGAAGGAGGAATTGAGACAATTCTAGATAATAAAAACTGAGAGAATTTATTATTAGC
ATAACTGCCCTACAGAAAATACTAAGAGAAGTCCTACAGACTGAAATGAAAGAATGCTAGTAAGAGATCA
TATGAAGAAATAAAGAACAGTTGCAAAGGTAATGACATAGGTAAACATAAAAGACATATACAAAACTGAA
AGCTTTCCTCCTAGAAGAAGGAACAAGAGAAGGATGTGTGATCTTATCACACCTATTCAACAACACCTCT
AGCTAGTACTGGCGGTTCTATTTAGGGCAATTAGGCAAGAAAAAAGACATCTAGATTAGAAAGGAAGAA
ATAAAACTTTGTTTGAAAATGACATAATCTTGTGTAGAGAAAATCCTAAGGAACCCACAACAGCTTACTA
TAATTAATAAATTAGTTCAGCCACATCACAGTATACAAGATGAGTATATTAAAATCAATTCTATTTCTAT
ACACTAGCAATAAACAATACAAAAAGGAGAATGAGAAAACAATTCAATTTACAATAGCATAAAGAAGAAC
AAAATACTTAGAAATAAATGTAATCAAGGAAGTGCCAGGCTTCTACACAGAAAACTTCAAGACATTGTTG
AAAGAAATTAAAGAAAACATAAATAATATATATTCCATGCTTATGGATTAGAAGATTTAATGTTGTTAAC
ATGGTGGTGCTCTCAAATTGATAAAAAAATTCATTGCAATCCTTATAAAAATTCCAGTTTCCTTTTTTGA
AGAAATAGACAAACAGATCCTAAAATTCAAACAGAATTACAAAAGACCCAAAGTAGATAAAAAATATTGA
AAAAGAAGAACAATATACATAAACATAAATTCAATCAGTGGAATAGAATTGAAAGCTGGGAAGCAAATTC
TTAAATTTATGGCCAATTTATTTTTGATAAGAGTGTCAAGACAATTCAGTCGGGAAGAACAGTCATTTC
AACAAATTGTGCTGGGACAACTGGATATGCATATGCAAAGAATGAGATTACCTCACAACATACACAGAA
ATTAACTCAAGGCTGGGCATGGTGGCTCACACTTGTAATCCCAGCACTTTGGGAGGTCAAGGTGGGCAGA
TCGCTTGAGGCCAGGAGTTCTAGACAAGCCTGGGCAATGTGGAGAAACCCTGTCTCTACAAAAACTACAA
AACTTAGCTGGGCATGATGGTGCACACCTGTAGTCTCAGCTGTTTGGGGGGCTGAGGTGGGAGGATCACT
TGAGCCTGGGAAATTGAAGCTGCAGTGAGCCGTGTTCATACCACTGCTCTACAGCTGGGTGACAAAGTGA
GACCCTGTCTCAAAAAAAAAAAAAATCCATCATTTATTAAGCACTGAATAATGTTAGTCAAACAGGATGT
TAAACTGGAAATTTTGATTGGGATTTCGAGATGCAATGTTTGGGAAATACAACACATATCATATTCCAAA
GTGATTTGCTGGTCTGAGATGCAGCAATTCAAAGGAAAAGCAAATAAATAAATAAATAAATAAATAAATA
AATAAAGGTTAAGCTACTCTTAAAATCTACACCCACATCAAAGTTGTATAAAATGGCAGAGTTGTTGGAA
ATTACAGGGAGAGAGAATTAACTTTGGAGAGAAGATATCTTTGTTTTTTTTTTTAAATTTATTTTCTTT
TTTTAGGCTAGTTGAGTGAAGCAGTGGGAGTAGAGAAGGAACAAAGACATTTGTAACTGGTTGTGATAAA
TTGTTTGAAAACAGCACTGCACTTTGACCAGCCAAGAGAGAAGATCTTTTTGGAGAGAGGTGTGCTGTGA
GTTCTTCTCCCCAAGAGCAAGGGCTAAGGGTGCTGCCCTTGGAATCTTAAGACCATCAGCAGATGAATGG
AAGACGTTGGAATTGGCCTGCATGCCCAGGTTATAAAGTGTGATATGGCCGGGCGCAGTGGCTCAGCCTG
TAATCCCAGCAATTTGGGACGCTGAGGCGGGTAGGTCACTTGAGGCCAAGAGTTTGAGACCAGCCTGGCC
AACATGGTGAAACCCCATCTCTACTAAAAATATAAGAATTAGCCGGGCATGGTGGCATGTGCCTATAGTC
CCAGCTACTCGGGAGGCTGAGGCAGGAGAATCACTTGAACCTGGGAGGTGGAGGTTGCAGTGAGCTGAGA
TTGCGCCACTGCACTCCAGCTTGGGTGACAGAGTGAGATTCCATCTCAAAAAAAAAAAAAATAGTGTGAT
ATGATCACTTTACACAAAACTAGTCTGTGACAAGTGGATAAAAATAGTATTTCATCACTATTTTACTATT
TCTTTGATTCCTACCTGGACTAAACATTTACAGGCTTTGAATAACCTTTTCTATGAATGGTCTTTTCATG
TCTTTGCTAAGTTTACGTACCGGTGCACTTAGAATTATCTTATAATTTGTATAAGCTCTCAATATAATTT
TAGTAAGATGCTTTTTTGATATGCTATTTTGTGCTATTTTTTCCTTTGCTTTAGAGAGAGGTGCCAAGA
AAATTTCTCTTTGGACCTTAGTTTCTCTTAGGATGCTCTGCAGGCTGCTCCATTCTGGGAATCATAGGAA
GGTTGCAAGGCTTCCCAGAGGCACTTAGGATAGTCCCCTTTCAGTCAAGAAGCTTCACTGGCTGGAGAAT
GTTCTCAAGACCCCCTCCTTGAATCCATGGAGAGCACCAGAGAATTAGGACATCTTAGCTGCTGCAGGGA
CCACAGTCCTGCAGAGCCAATTGCTGGCAGCAGATATTTTGGACAAGAAGGTACTAGAGTCCTGGAGAGA
GTCTGAGGAAAGGAAGGCCATCTGGGAATAGGATTTTGGGTGGTGGACGTCTGTTTCAGTCCTGGGTTAT
GAGGATGTTTTGCACCCAGGAAGTGGTTGTTCTCATGAATAGAAAGGACTATTGTGACTGAGCCTCATGC
CTTAGTGAGGGGCAGTATCTGGAACCGAGGTGACATGGTTTGGCTGTGTCCCCACCCGAATCTCATCATG
AATTTCCACATGTTGTGGGAGGGACCTGGTAGGAAGTAATTGAATCATGGGGGCAGGTCTTTCCTGTGCT
GTTCTCGTGATAGTGAATAAGTCTCAGGAGATCTGATGTTTTCATAGGTTTTTTTTCTGCACAAGCTCT
CTCTTGGCCTGCTGCCATCCATGTGAGATATGACTTGCTCCTCCTTGCCTTCACCATGATTGTGAGGCTT
CCTCAGCCACGTGGAACTGTAAGTTCACTGAACATCTTTCTTTTGTAAATTGCCCAGTTTCAGGTATGTC
TTCATTAGCAGCGTGAAAATGGACTAATACATGAGGTTGCCTCTGGCATCTCCTCTGTGAAGAGTCCAGC
ATTGACCCTGAGCACTGTCACTTCGAACACAGGAGACCAGTCCCTCTCTGCACACTCCCTCAGCCCTGTG
AGTTACTCTCCTCACTTTGCTGCTTCCCATTCTTGGCGGTATCTCTGGAGAGACTCCTGGCTCTAGCAGT
GGGGCTAGGAATGGCCATGGGACAGGCGTCACAGTTCTCCCTGGGCCTGACGGAGAGGGTCTGGGTTC
TCTGGATTCCTGAAGGGACGTGGAGCAGATTCCCATCATGCTGTGGCGGGAGTCTGTGCTATTCTCCCA
GCCAAGAGGAGAGGACATCCCGAAATCACCACAAATTCTGGGATGAAGGCTGTCTGAGGAAATGAAGCAA
ACACACACAAACACACAAAGACATACAAATACACACTCACACTTATACATACGTGCACACACACATTCTT
CTGTGGGTAAGCTTGTGCTTCAGCTACTTTGGGCAGGAGAGCAGGGGGGTTTTATTCTACCTGTCATTGC
CTTCATGCCCCAGTGCTGGAAACACACTGAAGCGCATTGCTCCCCCTTCAGATGATCTGAAAATCCCTGTT
TCAGTTCACTTTGAAAACACCCCTCACTCTCAACAACAGAGGGTTGGTTATTCTGCAGAACTCATTCTTT
AACAGCAGGCCTGCTGCTGCTCCAGCTGCAATTCTTTTCCCCTTCATGAAGGCTGCCAGGAATGAAAAGG

FIGURE 211 cont'd

GGAGGGAAAAGAAGTAGGTGGTGGCAGGAGGCTGGGCCAGGGAAGTGTGGGACCCCACAGGCTCCAGCCT
GAGGACTCCTCTCTCGGCCTCTCTCCCTGTTGTGAATGCTTCTGCTGAAAGCCACTGGGTGAGTGCAGG
GACAGAGAGCCACTGAGCTGGCTCAGGGCCTCGTGGTGGTGGTGGTGGTAGGGGGCTGCTCTGGGT
TCTCGAGAGGCTTCTCCAACTCTGACATGATCATACCTGAGGATATTATCGAAATTCAGATATGACTTAG
GAGGCCTGGGATACGGCCCGAGATTCTGCATGCCTGGTGATGCCAGTGTTGCTGCTCTGTTGCCACACTG
GATAAAAGCATCTAGAAGGTATTCCAGGCCAGATGGGGTGGGCATTCCCTCCCTCATACCTTAACTCTTT
GACATGGATTCTGCCACCAACAGAATCCTGGACGTTTTCTCCCAAGAGATGATAAGAAAAATTCACACCA
AAATCATGATGGAATTTCAAAATCTGTTTGGATATTAGAAAATTTCTCCAAACCCTGGCCTTTCCTTCCT
CTCCCAACTCTTGAGCTCACAGGTGTTGCTTCACTGACTAAAATCCTGACAGAGCTCCAATTCTACTACC
TCCCAGACAACTTTATTTGCAAGCTGTTTCTCTACTCAGAAACAGGGGTGTCCCTTCAGCCGAGCTTTTC
CAACAATGCTGAGCTGGGGGCTTTGGTACATCTCCCCCTCCTTCTCAGCCTCAGCTCTCTAGGTCCTGAA
GTTTGACCTGGGGGCCCTGTCCACCGTGGGCAAAGCTGCAGACTTGTTGATGAGAGGAGGATGTGGGTC
TTAGGGAAAGAGAAAGGTGAGCTGGGGACAGCTGGACCAGATTGGAGAGACCACAGGGTCCCTGAAAAGC
AGGGGGTAAGGGGGTAGGAGGCTATCATATAGGGAGGTCCCTTTGGTATGCAGACTTTGGGACAGAAAGC
ACAGTTTTGTCTGAACCCTCCAGAAGGCCCTGAAAGCATGGACATAAGCATTGTGTTGGCGATAACAGC
TGCAGGTGAAGGCAGGTGAATGACAAGGAAGGGTGCTTAGGGTTAGATATGAGAGCTCCAAACCAAGGGG
CCCTGGGCAGGTCCTTTTGTTCTACTGTTGCCCCTCTCTCCTTTCCAAAACCCCAAAGCTCTGTGGTGAG
CTCTGGAGACCTCAGCTTTGTTCTGAGAGCCTCTGAGAGGATTTAGGTGTCTCTTCATGGGCCTGGGGTG
GGAATGGGAGAGACAGAAAGAAAGGGGACACTAGGTACGGCCTCTGGAAATGATTTGAATCCCTGACCCT
TGAAATATGTCAGACCCACCCTGTGTGAAATTCCACGTCTGCTGGAAATGTGACGGAAATGTGTTTAGAG
GGTGCTGGACCTGCACTTCGAAATAAAACAAGGCTGACAGCAAGACTTGAGAATTTACCTAATGATC

FIGURE 212
SEQ ID NO: 204
Genbank ID       : R10289
Unigene ID(#167) : Hs.3844
Unigene name     :       LIM domain only 4 LMO4
>gi|762245|gb|R10289.1|R10289 yf36d12.s1 Soares fetal liver spleen 1NFLS Homo s
apiens cDNA clone IMAGE:128951 3', mRNA sequence
ATATAATAGTTTATTNAAAGTCCGTAATGACCTTAGCCCTCCACATCATTAAATGCGACAATATATTATT
TACTAAAGTTATTAACCACCTCCTTTGAATTTGTACATATCAGGGACATAAGTGCTTATGCCAAAAAGAA
TATAGAAAATGCCTGCAATCTCATTAACCCATTTCCCCCTTTACCATCGCAGTCTAACTTCCTTCAGAAA
GTTCCTTAAAGGAAAAAAAACAAATATAAGGAACCAGAACTAGTTTGAAGGAAATTCCCCAAGGGATCTA
ATTCAAACAGGACATCTANTTCANACCATATATATGTGGATTTCTTCATATTATTTTCTTGGCATTTTAT
TTTTATAGGGGTTCTAACCAA FIGURE 213
SEQ ID NO: 205
Genbank ID       : NM_004260.1
Unigene ID(#167) : Hs.31442
Unigene name     :       RecQ protein-like 4      RECQL4
>gi|4759029|ref|NM_004260.1| Homo sapiens RecQ protein-like 4 (RECQL4), mRNA
ATGGAGCGGCTGCGGGACGTGCGGGAGCGGCTGCAGGCGTGGGAGCGCGCGTTCCGACGGCAGCGCGGGC
GGCGACCGAGCCAGGACGACGTGGAGGCGGCGCCGGAGGAGACCCGCGCGCTCTACCGGGAGTACCGCAC
TCTGAAGCGTACCACGGGCCAGGCCGGCGGCGGGCTCCGCAGCTCCGAGTCGCTCCCCGCGGCGGCCGAA
GAGGCGCCAGAGCCCCGCTGCTGGGGCCCCATCTGAATCGGGCTGCGACCAAGAGTCCACAGCCTACGC
CAGGGCGGAGCCGCCAGGGCTCGGTGCCGGACTACGGGCAGCGGCTCAAGGCCAATCTGAAAGGCACCCT
GCAGGCCGGACCAGCCCTGGGCCGCAGACCGTGGCCTCTAGGAAGAGCCTCATCTAAGGCATCCACCCCA
AAGCCCCCAGGTACAGGGCCTGTCCCCTCCTTTGCAGAAAAAGTCAGTGATGAGCCTCCACAGCTCCCTG
AGCCCCAGCCAAGGCCAGGCCGGCTCCAGCATCTGCAGGCATCCCTGAGCCAGCGGCTGGGCTCCCTAGA
TCCTGGCTGGTTACAGCGATGTCACAGTGAGGTCCCAGATTTTCTGGGGGCCCCCAAAGCCTGCAGGCCT
GATCTAGGCTCAGAGGAATCACAACTTCTGATCCCTGGTGAGTCGGCTGTCCTTGGTCCTGGTGCTGGCT
CCCAGGGCCCAGAGGCTTCAGCCTTCCAAGAAGTCAGCATCCGTGTGGGGAGCCCCAGCCCAGCAGCAG
TGGAGGCGAGAAGCGGAGATGGAACGAGGAGCCCTGGGAGAGCCCCGCACAGGTCCAGCAGGAGAGCAGC
CAAGCTGGACCCCCATCGGAGGGGCTGGGGCTGTAGCAGTTGAGGAAGACCCTCCAGGGGAACCTGTAC
AGGCACAGCCACCTCAGCCCTGCAGCAGCCCATCGAACCCCAGGTACCACGGACTCAGCCCCTCCAGTCA FIGURE 213 cont'd AGCTAGGGCTGGGAAGGCTGAGGGCACAGCCCCCTGCACATCTTCCCTCGGCTGGCCCGCCATGACAGG
GGCAATTACGTACGGCTCAACATGAAGCAGAAACACTACGTGCGGGCCGGGCACTCCGTAGCAGGCTCC
TCCGCAAGCAGGCATGGAAGCAGAAGTGGCGGAAGAAAGGGGAGTGTTTTGGGGGTGGTGGTGCCACAGT
CACAACCAAGGAGTCTTGTTTCCTGAACGAGCAGTTCGATCACTGGGCAGCCCAGTGTCCCCGGCCAGCA
AGTGAGGAAGACACAGATGCTGTTGGGCCTGAGCCACTGGTTCCTTCACCACAACCTGTACCTGAGGTGC
CCAGCCTGGACCCCACCGTGCTGCCACTCTACTCCCTGGGGCCCTCAGGGCAGTTGGCAGAGACGCCGGC
TGAGGTGTTCCAGGCCCTGGAGCAGCTGGGGCACCAAGCCTTTCGCCCTGGGCAGGAGCGTGCAGTCATG
CGGATCCTGTCTGGCATCTCCACGCTGCTGGTGCTGCCTACAGGTGCCGGCAAGTCCCTGTGCTACCAGC
TCCCAGCGCTGCTCTACAGCCGGCGCAGCCCCTGCCTCACGTTGGTCGTCTCTCCCCTGCTGTCACTCAT
GGATGACCAGGTGTCTGGCCTGCCACCGTGTCTCAAGGCGGCCTGCATACACTCGGGCATGACCAGGAAG
CAACGGGAATCTGTCCTGCAGAAGATTCGGGCAGCCCAGGTACACGTGCTGATGCTGACACCTGAGGCAC
TGGTGGGGCGGGAGGCCTCCCTCCAGCCGCACAGCTGCCTCCAGTTGCTTTTGCCTGCATTGATGAGGC
CCACTGCCTCTCCCAGTGGTCCCACAACTTCCGGCCCTGCTACCTGCGCGTCTGCAAGGTGCTTCGGGAG
CGCATGGGCGTGCACTGCTTCCTGGGCCTCACAGCCACAGCCACACGCCGCACTGCCAGTGACGTGGCAC
AGCACCTGGCTGTGGCTGAAGAGCCTGACCTCCACGGGCCAGCCCCAGTTCCCACCAACCTGCACCTTTC
CGTGTCCATGGACAGGGACACAGACCAGGCACTGTTGACGCTGCTGCAAGGCAAACGTTTTCAAAACCTC
GATTCCATTATCATTTACTGCAACCGGCGCGAGGACACAGAGCGGATCGCTGCGCTCCTCCGAACCTGCC
TGCACGCAGCCTGGGTCCCAGGGTCTGGAGGTCGTGCCCCAAAACCACAGCCGAGGCCTACCACGCGGG
CATGTGCAGCCGGGAACGGCGGCGGGTACAGCGAGCCTTCATGCAGGGCCCAGTTGCGGGTGGTGGTGGCC
ACGGTGGCCTTTGGGATGGGGCTGGACCGGCCAGATGTGCGGGCTGTGCTGCATCTGGGGCTGCCCCCAA
GCTTCGAGAGCTACGTGCAGGCCGTGGGCCGGGCCGGGCGTGACGGGCAGCCTGCCCACTGCCACCTCTT
CCTGCAGCCCCAGGGCGAAGACCTGCGAGAGCTGCGCAGACATGTGCACGCCGACAGCACGGACTTCCTG
GCTGTGAAGAGGCTGGTACAGCGCGTGTTCCCAGCCTGCACCTGCACCTGCACCAGGCCGCCCTCGGAGC
AGGAAGGGGCCGTGGGTGGGGAGAGGCCTGTGCCCAAGTACCCCCCTCAAGAGGCTGAGCAGCTTAGCCA
CCAAGCAGCCCCAGGACCCAGAAGGGTCTGCATGGGCCATGAGCGGGCACTCCCAATACAGCTTACCGTA
CAGGCTTTGGACATGCCGGAGGAGGCCATCGAGACTTTGCTGTGCTACCTGGAGCTGCACCCACACCACT
GGCTGGAGCTGCTGGCGACCACCTATACCCATTGCCGTCTGAACTGCCCTGGGGGCCCTGCCCAGCTCCA
GGCCCTGGCCCACAGGTGTCCCCCTTTGGCTGTGTGCTTGGCCCAGCAGCTGCCTGAGGACCCAGGGCAA
GGCAGCAGCTCCGTGGAGTTTGACATGGTCAAGCTGGTGGACTCCATGGGCTGGGAGCTGGCCTCTGTGC
GGCGGGCTCTCTGCCAGCTGCAGTGGGACCACGAGCCCAGGACAGGTGTGCGGCGTGGGACAGGGGTGCT
TGTGGAGTTCAGTGAGCTGGCCTTCCACCTTCGCAGCCCGGGGGACCTGACCGCTGAGGAGAAGGACCAG
ATATGTGACTTCCTCTATGCCGTGTGCAGGCCCGGGAGCGCCAGGCCCTGGCCCGTCTGCGCAGAACCT
TCCAGGCCTTTCACAGCGTAGCCTTCCCCAGCTGCCGGCCCTGCCTGGAGCAGCAGGATGAGGAGCGCAG
CACCAGGCTCAAGGACCTGCTCGGCCGCTACTTTGAGGAAGAGGAAGGGCAGGAGCCGGGAGGCATGGAG
GACGCACAGGGCCCCGAGCCAGGGCAGGCCAGACTCCAGGATTGGGAGGACCAGGTCCGCTGCGACATCC
GCCAGTTCCTGTCCCTGAGGCCAGAGGAGAAGTTCTCCAGCAGGGCTGTGGCCCGCATCTTCCACGGCAT
CGGAAGCCCCTGCTACCCGGCCCAGGTGTACGGGCAGGACCGACGCTTCTGGAGAAAATACCTGCACCTG
AGCTTCCATGCCCTGGTGGGCCTGGCCACGGAAGAGCTCCTGCAGGTGGCCCGCTGA

FIGURE 214
SEQ ID NO: 206
Genbank ID      : BF513468
Unigene ID(#167) : acc_BF513468
Unigene name    :
>gi|11598647|gb|BF513468.1|BF513468 UI-H-BW1-ams-f-03-0-UI.s1 NCI_CGAP_Sub7
Hom
o sapiens cDNA clone IMAGE:3070996 3', mRNA sequence
TTTTTTTTTTTTTGNTTTTAATGGTGTTTTATTTAAAGCAGCAGAATTGGTAGCTAACAGAATAGT
CCCTATGAGTAACATGAAGGGCAAACGTCACATCACCATGTTAACAGACTCGGGAAGTGTATCTGAAGAA
GTCCAACCTCCATTAATGAATAACAATTTTCAGCAGACTTCTCTGGGGGCCTTCCTCCACCTGTGGGAGT
CGTACATCCAGAAGCCGAGTGAGCTGGAAGGACCCCAGTGGGGATGGGCTATGGTTGGAGACCCTGGTAT
GAACCCCAGTTTAGCTTGACATAGACACAGATGGTTCCATGCAGAATATTTATAGACATGTATGTGCAAG
GATTAGCATTCACACACATTCCCTTGCTCTGTCAGCTGAGAATAAAAATGAGGATCATTATTACTATTAC
ATTCTCATCTAGGCCTTTAAATAGCAGCTCCAGTTGTAAACCTCTCTAAGGGGCTCTGGATTAACTGCGT
GAGAGTGATGAGGGGAAAAGGTCTTTCTCATCTCCATCTGACCTACCCATCTACCAACCAAGCTGGACAC
TGACTGTCCTTCCGTCCTCTCCCC

FIGURE 215
SEQ ID NO: 207
Genbank ID            : BE044614
Unigene ID(#167)      : Hs.411644
Unigene name          :        tenascin XB TNXB
>gi|8361667|gb|BE044614.1|BE044614  hq87a07.x1  NCI_CGAP_Thy3  Homo  sapiens cDNA c
lone  IMAGE:3126324  3'  similar  to  gb:M25813  FIBRINOGEN-LIKE  PROTEIN (HUMAN);, mR
NA sequence
TACCTCAGTTTCTCCTTTATTGCTCCCGTACGAACCCCTCCCCTCCCCCCTGTAAACACAGTGCTGCGAG
ATCGCTGGCAGAGAAGGCTTCCTCCAGCGGCTGGGTGGTGAAGGACCCTGGCTCTTCTCTCGGGGCGACC
CCTCAGTGCTCGGCAGTCATACTGGGGTGCGAGAGAGGTGGGCAGCAGCTCAGCCTCCCCCCGCTGGGGA
GCGAAAGTTTCTTGGTCTCAGCTTCATTTCCGTGAAGGGCACCGAGAACTCGAAGCCCTTCCAGTGGTAC
CAGCTCACTCCCTGATGGTCCACTGTGCTCCCGTAGAGCCCGTTGAGGTTGGCGTAGTGGCAGTTCCTGT
ACCACCAGGCCCCTCGGTAGGAGACAGCGCAGGAGATGAGCAAGCTGTTGGGGTCCCGATCACGGGCAGA
GAAGACACTGCCGCTGTGGTAGCTCATGGAGTCCCCTGCGGTGCCGTGGTAGCCCTCCAAGTGGAGGCGG
TAGTACTCCGCAGCCGAGTCTACGTGGAAAGAGTCGTACTGGGCGAACACAGCCTCGTTCCCAGCCCGCA
GGTCCACGCGCATGGAGT

FIGURE 216
SEQ ID NO: 208
Genbank ID            : AI733515
Unigene ID(#167)      : Hs.148907
Unigene name          :        hypothetical protein MGC52019 MGC52019
>gi|5054676|gb|AI733515.1|AI733515  ou99e05.x5  NCI_CGAP_Kid3  Homo  sapiens cDNA c
lone IMAGE:1635968 3', mRNA sequence
TTTGGTGTTGAGATGCTGTTTATTTATCAAGGTTTACATGTACAAAATTATAATAAATCATAGTAATGAA
TATTGCATCTTTTAGTAATAAACTTGTTTATAACAGTAGTTTTCTCTCTTTTCAGAATTTAGGACCTTTA
GAAAAGTTACTCTCTGGAAAATAATATTTTATTTAAACTCTGGCATTAAAAAAACTACTCTTTGGAAATT
TAGGCATGACTTTTAATGTATACATTCTGTTTTTCTTATTATTTCTAATTTTCAAAATAGTAACATATAT
TCTGATCCCACATCTTAAAAATCCTGAAGAGAAATAATGAAACCATTTAAGTTAACATGTACACCATTTT
CTTCATATACTGCAGACCAAGTATTAAATGTTCCATGTGGGCCAGTCACACTGTGCTAAGCACTTTATAT
GATTTACTTATATAAATCTTCATAATAATTCTATTAAGTAGGGGTAATTTTTACTCCTATTAATTGGTGA
ATAAACTAAGATTNTAAAATATTGCCCAAAATTACCTAGATTTGTGTCAGAACTCGTGTTTGAACCTAAG
CCATTTGACTG

FIGURE 217
SEQ ID NO: 209
Genbank ID            : AI694413
Unigene ID(#167)      : acc_AI694413
Unigene name          :
>gi|4971753|gb|AI694413.1|AI694413  wd83d12.x1  NCI_CGAP_Lu24  Homo  sapiens cDNA c
lone IMAGE:2338199 3', mRNA sequence
TTTTTTTAAATATTTAAGAGTTTATTTGAGCAGTGATCCATGAATTGGGCAGCTTCAAGCCAGAAGTGGC
TAGGGAGCTCCCCAGAGAGAACATGAGGAGGAGGCTTTTAGGACAAATAGATAAAAGCAAAGATAATAT
TTCATTGGTTACAGTTATACAGTTACACAGTTATACAGTTGCCTTATTTGGTCTATCCCATGAGGAAGTC
CTAGTTACTAATTACGTTTTTGTTGGCTGCTTCTGATTGGTTGAGCTTAAGTTCTGTGTTTCTTTAACAT
AGGCATTTACAAGAAATACCACAAATAAAGTTTCAGACATGCTTGCAAATCAAGCAAGGTTAAGGTCACT
TAGGAGGCCCAACTGGCTCTGTCTGCTCAAGGATTCTTCTGGCCTCGTCTCCATTTTACATGAACTGTTG
CATAAATAAACACAGAGTACCTGAAACAACGGAGGTGATCATTCTGCCTACCGAGTGTTGGCCACGCCAA
GCTTGGAGTG

FIGURE 218
SEQ ID NO: 210
Genbank ID       : NM_006829.1
Unigene ID(#167) : Hs.511763
Unigene name     :         adipose specific 2       APM2
>gi|5802975|ref|NM_006829.1| Homo sapiens adipose specific 2 (APM2), mRNA
CTCTTGACGACTCCACAGATACCCCGAAGCCATGGCAAGCAAGGGCTTGCAGGACCTGAAGCAACAGGTG
GAGGGGACCGCCCAGGAAGCCGTGTCAGCGGCCGGAGCGGCAGCTCAGCAAGTGGTGGACCAGGCCACAG
AGGCGGGGCAGAAAGCCATGGACCAGCTGGCCAAGACCACCCAGGAAACCATCGACAAGACTGCTAACCA
GGCCTCTGACACCTTCTCTGGGATCGGGAAAAAATTCGGCCTCCTGAAATGACAGCAGGGAGACTTGGGT
CGGCCTCCTGAAATGATAGCAGGGAGACTTGGGTGACCCCCCTTCCAGGCGCCATCTAGCACAGCCTGGC
CCTGATCTCCGGGCAGCCACCACCTCCTCGGTCTGCCCCCTCATTAAAATTCACGTTCCCACCCTGAAA

FIGURE 219
SEQ ID NO: 211
Genbank ID       : AA708016
Unigene ID(#167) : acc_AA708016
Unigene name     :
>gi|2717934|gb|AA708016.1|AA708016    zg05c07.s1    Soares_pineal_gland_N3HPG
Homo sa
piens cDNA clone IMAGE:392460 3', mRNA sequence
TTTTTTTTTTCAGGTTTAATAAACTTTTTAATGAATATTTCAGACATAACAAAAAACTGCAGAGCTTCGT
ACACTTGATTTAAATAATTCTTGAGGGATTTTATAAGGTCATCTTATAGACAAAATTATGAGAAACCAGT
GTGGTTATCAATGCTTTCAGAATACTTGTGTTTATGTAAATATACCCCAGAGTCCAAAACTCTGATATAT
TCATATATATTCACAATGAGAGGATGTCTGTGCCAAATCTGTCAATCAGTACAATAGAAAAGTTAATTAT
ATAACTACAACACGAAACACAAATTTTTAGAAGCAAATTATGTCCTGTAATTTACCCCCCTCCCCGCTGC
TCCTCTGCTAACTCATTTTCCTCTTTTCCCACTCTAAATGTAAGGCAACCCTTGGCTTTGGAGAAGCATC
TGTT

FIGURE 220
SEQ ID NO: 212
Genbank ID       : NM_002416.1
Unigene ID(#167) : Hs.77367
Unigene name     :         chemokine (C-X-C motif) ligand 9       CXCL9
>gi|4505186|ref|NM_002416.1| Homo sapiens chemokine (C-X-C motif) ligand 9 (CXC
L9), mRNA
ATCCAATACAGGAGTGACTTGGAACTCCATTCTATCACTATGAAGAAAAGTGGTGTTCTTTTCCTCTTGG
GCATCATCTTGCTGGTTCTGATTGGAGTGCAAGGAACCCCAGTAGTGAGAAAGGGTCGCTGTTCCTGCAT
CAGCACCAACCAAGGGACTATCCACCTACAATCCTTGAAAGACCTTAAACAATTTGCCCCAAGCCCTTCC
TGCGAGAAAATTGAAATCATTGCTACACTGAAGAATGGAGTTCAAACATGTCTAAACCCAGATTCAGCAG
ATGTGAAGGAACTGATTAAAAAGTGGGAGAAACAGGTCAGCCAAAAGAAAAAGCAAAAGAATGGGAAAAA
ACATCAAAAAAGAAAGTTCTGAAAGTTCGAAAATCTCAACGTTCTCGTCAAAAGAAGACTACATAAGAG
ACCACTTCACCAATAAGTATTCTGTGTTAAAAATGTTCTATTTTAATTATACCGCTATCATTCCAAAGGA
GGATGGCATATAATACAAAGGCTTATTAATTTGACTAGAAAATTTAAAACATTACTCTGAAATTGTAACT
AAAGTTAGAAAGTTGATTTTAAGAATCCAAACGTTAAGAATTGTTAAAGGCTATGATTGTCTTTGTTCTT
CTACCACCCACCAGTTGAATTTCATCATGCTTAAGGCCATGATTTTAGCAATACCCATGTCTACACAGAT
GTTCACCCAACCACATCCCACTCACAACAGCTGCCTGGAAGAGCAGCCCTAGGCTTCCACGTACTGCAGC
CTCCAGAGAGTATCTGAGGCACATGTCAGCAAGTCCTAAGCCTGTTAGCATGCTGGTGAGCCAAGCAGTT
TGAAATTGAGCTGGACCTCACCAAGCTGCTGTGGCCATCAACCTCTGTATTTGAATCAGCCTACAGGCCT
CACACACAATGTGTCTGAGAGATTCATGCTGATTGTTATTGGGTATCACCACTGGAGATACCAGTGTGT
GGCTTTCAGAGCCTCCTTTCTGGCTTTGGAAGCCATGTGATTCATCTTGCCCGCTCAGGCTGACCACTT
TATTTCTTTTTGTTCCCCTTTGCTTCATTCAAGTCAGCTCTTCTCCATCCTACCACAATGCAGTGCCTTT
CTTCTCTCCAGTGCACCTGTCATATGCTCTGATTTATCTGAGTCAACTCCTTTCTCATCTTGTCCCCAAC
ACCCCACAGAAGTGCTTTCTTCTCCCAATTCATCCTCACTCAGTCCAGCTTAGTTCAAGTCCTGCCTCTT
AAATAAACCTTTTTGGACACACAAATTATCTTAAAACTCCTGTTTCACTTGGTTCAGTACCACATGGGTG
AACACTCAATGGTTAACTAATTCTTGGGTGTTTATCCTATCTCTCAACCAGATTGTCAGCTCCTTGAGG
GCAAGAGCCACAGTATATTTCCCTGTTTCTTCCACAGTGCCTAATAATACTGTGGAACTAGGTTTTAATA

FIGURE 220 cont'd

ATTTTTTAATTGATGTTGTTATGGGCAGGATGGCAACCAGACCATTGTCTCAGAGCAGGTGCTGGCTCTT
TCCTGGCTACTCCATGTTGGCTAGCCTCTGGTAACCTCTTACTTATTATCTTCAGGACACTCACTACAGG
GACCAGGGATGATGCAACATCCTTGTCTTTTTATGACAGGATGTTTGCTCAGCTTCTCCAACAATAAGAA
GCACGTGGTAAAACACTTGCGGATATTCTGGACTGTTTTTAAAAAATATACAGTTTACCGAAAATCATAT
AATCTTACAATGAAAAGGACTTTATAGATCAGCCAGTGACCAACCTTTTCCCAACCATACAAAAATTCCT
TTTCCCGAAGGAAAAGGGCTTTCTCAATAAGCCTCAGCTTTCTAAGATCTAACAAGATAGCCACCGAGAT
CCTTATCGAAACTCATTTTAGGCAAATATGAGTTTTATTGTCCGTTTACTTGTTTCAGAGTTTGTATTGT
GATTATCAATTACCACACCATCTCCCATGAAGAAGGGAACGGTGAAGTACTAAGCGCTAGAGGAAGCAG
CCAAGTCGGTTAGTGGAAGCATGATTGGTGCCCAGTTAGCCTCTGCAGGATGTGGAAACCTCCTTCCAGG
GGAGGTTCAGTGAATTGTGTAGGAGAGGTTGTCTGTGGCCAGAATTTAAACCTATACTCACTTTCCCAAA
TTGAATCACTGCTCACACTGCTGATGATTTAGAGTGCTGTCCGGTGGAGATCCCACCCGAACGTCTTATC
TAATCATGAAACTCCCTAGTTCCTTCATGTAACTTCCCTGAAAAATCTAAGTGTTTCATAAATTTGAGAG
TCTGTGACCCACTTACCTTGCATCTCACAGGTAGACAGTATATAACTAACAACCAAAGACTACATATTGT
CACTGACACACGTTATAATCATTTATCATATATACATACATGCATACACTCTCAAAGCAAATAATT
TTTCACTTCAAAACAGTATTGACTTGTATACCTTGTAATTTGAAATATTTTCTTTGTTAAAATAGAATGG
TATCAATAAATAGACCATTAATCAG

FIGURE 221
SEQ ID NO: 213
Genbank ID           : BC006399.1
Unigene ID(#167)    : Hs.155839
Unigene name         :         reticulon 4 interacting protein 1   RTN4IP1
>gi|13623568|gb|BC006399.1|BC006399   Homo     sapiens,    clone    MGC:12934
IMAGE:4309263
, mRNA, complete cds
GGCACGAGGAAGTGGAGGGGGTGAAAGTGAGGGAGGAGAATGGACAGAATACTGACTGGAACGTTAATTC
GAGCATTTCATATGCGAAGAGCGGAATAACAGTTCCGTATTCTTCTTTCAGTTTCTCCATTAGATTAGCT
TCATTTTCGAATGCTCCGTTTTGCATGCTTAATTTTGAAACTAGCCCGTGGTTTGGCAGAATTTGACTGA
ATTCAGGGGTGAGAGTTTGATCCAGTCCAAGTGTATTTGAATTTGAGCACGCAGTTCAACCAGTGTTTAC
AATGGAATTTCTGAAGACTTGTGTACTTAGAAGAAATGCATGCACTGCGGTTTGCTTCTGGAGAAGCAAA
GTTGTCCAAAAGCCTTCAGTTAGAAGGATTAGTACTACCTCTCCTAGGAGCACTGTCATGCCTGCTTGGG
TGATAGATAAATATGGGAAGAATGAAGTGCTTCGATTCACTCAGAACATGATGATGCCTATCATACACTA
TCCAAATGAAGTCATTGTCAAAGTTCACGCTGCCAGTGTAAATCCTATAGACGTTAATATGAGAAGTGGT
TATGGAGCTACAGCTTTAAATATGAAGCGTGATCCTTTACACGTGAAAATCAAAGGAGAAGAATTTCCTC
TGACTCTGGGTCGGGATGTCTCTGGCGTGGTGATGGAATGTGGGCTTGATGTGAAATACTTCAAGCCTGG
AGATGAGGTCTGGGCTGCAGTTCCTCCTTGGAAACAAGGCACTCTTTCAGAGTTTGTTGTAGTCAGTGGG
AATGAGGTCTCTCACAAACCCAAATCACTCACTCATACTCAAGCTGCCTCTTTGCCATATGTGGCTCTCA
CAGCCTGGTCTGCTATAAACAAAGTTGGTGGCCTGAATGACAAGAATTGCACAGGAAAACGTGTTCTAAT
CTTAGGCGCTTCAGGCGGAGTTGGTACTTTTGCTATACAGGTAATGAAAGCATGGGATGCTCATGTGACA
GCAGTTTGCTCCCAAGATGCCAGTGAACTTGTAAGGAAGCTTGGTGCAGACGATGTAATTGATTACAAAT
CTGGAAGTGTGGAAGAGCAGTTGAAATCCTTAAAACCATTTGATTTTATCCTTGATAATGTTGGCGGATC
CACTGAAACATGGGCTCCAGATTTTCTCAAGAAATGGTCAGGAGCCACCTATGTGACTTTGGTGACTCCT
TTCCTCCTGAACATGGACCGATTGGGCATAGCAGATGGCATGTTGCAGACAGGAGTCACTGTAGGTTCAA
AGGCATTAAAGCATTTCTGGAAAGGAGTCCATTATCGCTGGGCATTTTTCATGGCCAGTGGCCCATGTTT
AGATGACATTGCAGAACTGGTGGATGCGGGAAAGATCCGGCCAGTTATTGAACAAACCTTTCCTTTTTCT
AAAGTTCCAGAAGCCTTCCTGAAGGTGGAAAGAGGACACGCACGAGGAAAGACTGTAATTAATGTTGTTT
AAATAAAAATGCAGTTTAGTGAAAAAAAAAAAAAAAAAAAAAAAAAAAA

FIGURE 222
SEQ ID NO: 214
Genbank ID           : NM_007116.1
Unigene ID(#167)    : acc_NM_007116.1
Unigene name         :
>gi|6005907|ref|NM_007116.1| Homo sapiens tenascin XA (TNXA), mRNA
CCTTGTGCATTTGGTCTGAAGACAAAGATGACTGCAGGAGTGGGCAGGCCGGAGTGGGGGTGACCTGGCC

FIGURE 222 cont'd

```
TGTGCCAGGAAGGAGGAGGAGTCTGCAGCCCTGTGCGGTTCAACATCCATCAAGGAGTCCAGAGCAGGAG
CCAGGCCAGGCGGGAGGGAAAGGCCCTGGGAGGGGCTCTCTAATCTCCCAGCCCCGACTCTGCCCCGTCA
CTGCCGCTGCTCCTCATTACTCGCTGGGGCTGCTGTCGCCTCCCCGAAGGGTGGCCTTGTCCAGATAGTG
GCAAACCTCCCTGCCGTGGATGAGTCAGGAGCATTTTCTTAAGAGGAACATCACTGGAAAACAAAATGAG
CGGGGACACAGAAACCAACAGCAGTGGCTGCATTTGTGGTACAGGCTCCTCTTCCAGAGCTCGCTGATGC
CCACCTCAGACAGGCCTGACCACGGCACGGCTGGTGGGATTTGCCAGTCACCTCAACCAGCCAGTTCCAC
CCTCAGCTTCTCTCAGAAGGGAGCACCACACTCCTCAAGCTCAGTGAATGTATCCCGGCATGGGTGGGGC
CAGAGCCTGTGATATCTCGAGGTGGGCTCGGCAGGACACCGGGGTGTGGAAGGGGGAAGCGAGCACCTGA
CTCAGACAGCGCGGGAGCTCGCAGGAGTCACGAGGCCACAGCGACTTCATTGTCTGACTGGGCCTGGACC
TATAAACTTCCCACCTCAGCCTTGGGCCAAGCCTGGAAGATAAAAATGGAGCACCCCATGGCGCCCCTCA
CTCAGATTCTCCCCTGGGCTTCTCCCACGCAGCCCCAGAAGAGGACACCAGCCCCAGAGTTAGCCCCA
GAGGCCCCTGAGCCTCCTGAAGAGCCCCGCCTAGGAGTGCTGACCGTGACCGACACAACCCCAGACTCCA
TGCGCCTCTCGTGGAGCGTGGCCCAGGGCCCCTTTGATTCCTTCGTGGTCCAGTATGAGGACACGAACGG
GCAGCCCCAGGCCTTGCTCGTGGACGGCGACCAGAGCAAGATCCTCATCTCAGGCCTGGAGCCCAGCACC
CCCTACAGGTTCCTCCTCTATGGCCTCCATGAAGGGAAGCGCCTGGGGCCCCTCTCAGCTGAGGGCACCA
CAGGGCTGGCTCCTGCTGGTCAGACCTCAGAGGAGTCAAGGCCCCGCCTGTCCCAGCTGTCTGTGACTGA
CGTGACCACCAGTTCACTGAGGCTCAACTGGGAGGCCCCACCGGGGGCCTTCGACTCCTTCCTGCTCCGC
TTTGGGGTTCCATCACCAAGCACTCTGGAGCCGCATCCGCGTCCACTGCTGCAGCGCGAGCTGATGGTGC
CGGGGACGCGGCACTCGGCCGTGCTCCGGGACCTGCGTTCCGGGACTCTGTACAGCCTGACACTGTATGG
GCTGCGAGGACCCCACAAGGCCGACAGCATCCAGGGAACCGCCCGCACCCTCAGCCCAGTTCTGGAGAGC
CCCCGTGACCTCCAATTCAGTGAAATCAGGGAGACCTCAGCCAAGGTCAACTGGATGCCCCCACCATCCC
GGGCGGACAGCTTCAAAGTCTCCTACCAGCTGGCGGACGGAGGGGAGCCTCAGAGTGTGCAGGTGGATGG
CCAGGCCCGGACCCAGAAACTCCAGGGGCTGATCCCAGGCGCTCGCTATGAGGTGACCGTGGTCTCGGTC
CGAGGCTTTGAGGAGAGTGAGCCTCTCACAGGCTTCCTCACCACGGTTCCTGACGGTCCCACACAGTTGC
GTGCACTGAACTTGACCGAGGGATTCGCCGTGCTGCACTGGAAGCCCCCCAGAATCCTGTGGACACCTA
TGACGTCCAGGTCACAGCCCCTGGGCCCCGCCTCTGCAGGCGGAGACCCCAGGCAGCGCGGTGGACTAC
CCCCTGCATGACCTTGTCCTCCACACCAACTACACCGCCACAGTGCGTGGCCTGCGGGCCCCAACCTCA
CTTCCCCAGCCAGCATCACCTTCACCACAGGGCTAGAGGCCCCTCGGGACTTGGAGGCCAAGGAAGTGAC
CCCCCGCACCGCCCTGCTCACTTGGACTGAGCCCCCAGTCCGGCCCGCAGGCTACCTGCTCAGCTTCCAC
ACCCCTGGTGGACAGAACCAGGAGATCCTGCTCCCAGGAGGGATCACATCTCACCAGCTCCTTGGCCTCT
TTGGGTCCACCTCCTACAATGCACGGCTCCAGGCCATGTGGGGCCAGAGCCTCCTGCCGCCCGTGTCCAC
CTCTTTCACCACGGGTGGGCTGCGGATCCCCTTCCCCAGGGACTGCGGGAGGAGATGCAGAACGGAGCC
GGTGCCTCCAGGACCAGCACCATCTTCCTCAACGGCAACCGCGAGCGGCCCCTGAACGTGTTTTGCGACA
TGGAGACTGATGGGGGCGGCTGGCTGGTGTTCCAGCGCCGCATGGATGGACAGACAGACTTCTGGAGGGA
CTGGGAGGACTATGCCCATGGTTTTGGGAACATCTCTGGAGAGTTCTGGCTGGGCAATGAGGCCCTGCAC
AGCCTGACACAGGCAGGTGACTACTCCATCCGCGTGGACCTGCGGGCTGGGGACGAGGCTGTGTTCGCCC
AGTACGACTCCTTCCACGTAGACTCGGCTGCGGAGTACTACCGCCTCCACTTGGAGGGCTACCACGGCAC
CGCAGGGGACTCCATGAGCTACCACAGCGGCAGTGTCTTCTCTGCCCGTGATCGGGACCCCAACAGCTTG
CTCATCTCCTGCGCTGTCTCCTACCGAGGGGCCTGGTGGTACAGGAACTGCCACTACGCCAACCTCAACG
GGCTCTACGGGAGCACAGTGGACCATCAGGGAGTGAGCTGGTACCACTGGAAGGGCTTCGAGTTCTCGGT
GCCCTTCACGGAAATGAAGCTGAGACCAAGAAACTTTCGCTCCCCAGCGGGGGGAGGCTGAGCTGCTGCC
CACCTCTCTCGCACCCCAGTATGACTGCCGAGCACTGAGGGGTCGCCCCGAGAGAAGAGCCAGGGTCCTT
CACCACCCAGCCGCTGGAGGAAGCCTTCTCTGCCAGCGATCTCGCAGCACTGTGTTTACAGGGGGGAGGG
GAGGGGTTCGTACAGGAGCAATAAAGGAGAAACTGAGGTACCCGAAAA
```

FIGURE 223
SEQ ID NO: 215
Genbank ID      : NM_016524.1
Unigene ID(#167) : Hs.258326
Unigene name    :      B/K protein LOC51760
>gi|7706558|ref|NM_016524.1| Homo sapiens B/K protein (LOC51760), mRNA
```
GGGCGAAAATGGCGTACATTCAGTTGGAACCATTAAACGAGGGTTTTCTTTCTAGAATCTCTGGTCTGCT
GCTGTGCAGATGGACCTGCCGGCACTGCTGTCAGAAGTGCTACGAGTCCAGCTGTTGCCAGTCAAGTCAG
GATGAAGTTGAAATTCTGGGACCTTTCCCTGCTCAGACCCCTCCCTGGCTGATGGCCAGCCGGGGCAGTG
ACAAGGATGGTGACTCTGTCCACACGGCCAGCGAAGTCCCGCTGACCCCACGGACCAATTCCCCGGATGG
AAGACGCTCGTCCTCAGACACATCCAAGTCTACATACAGCCTGACGCGGAGGATTTCGAGTCTTGAGTCA
AGACGTCCAGCTCTCCACTCATCGATATTAAACCCATCGAGTTTGGCGTTCTCAGCGCCAAGAAGGAGC
CCATCCAACCTTCGGTGCTCAGACGGACCTATAACCCCGACGACTATTTCAGGAAGTTCGAACCCCACCT
GTACTCCCTCGACTCCAACAGCGACGATGTGGACTCTCTGACAGACGAGGAGATCCTGTCCAAGTACCAG
CTGGGCATGCTGCACTTCAGCACTCAGTACGACCTGCTGCACAACCACCTCACCGTGCGCGTGATCGAGG
```

FIGURE 223 cont'd

```
CCAGGGACCTGCCACCTCCCATCTCCCACGATGGCTCGCGCCAGGACATGGCGCACTCCAACCCCTACGT
CAAGATCTGTCTCCTGCCAGACCAGAAGAACTCAAAGCAGACCGGGGTCAAACGCAAGACCCAGAAGCCC
GTGTTTGAGGAGCGCTACACCTTCGAGATCCCCTTCCTGGAGGCCCAGAGGAGGACCCTGCTCCTGACCG
TGGTGGATTTTGATAAGTTCTCCCGCCACTGTGTCATTGGGAAAGTTTCTGTGCCTTTGTGTGAAGTTGA
CCTGGTCAAGGGCGGGCACTGGTGGAAGGCGCTGATTCCCAGTTCTCAGAATGAAGTGGAGCTGGGGGAG
CTGCTTCTGTCACTGAATTATCTCCCAAGTGCTGGCAGACTGAATGTTGATGTCATTCGAGCCAAGCAAC
TTCTTCAGACAGATGTGAGCCAAGGTTCAGACCCCTTTGTGAAAATCCAGCTGGTGCATGGACTCAAACT
TGTGAAAACCAAGAAGACGTCCTTCTTAAGGGGCACAATTGATCCTTTCTACAATGAATCCTTCAGCTTC
AAAGTTCCCCAAGAAGAACTGGAAAATGCCAGCCTAGTGTTTACAGTTTTCGGCCACAACATGAAGAGCA
GCAATGACTTCATCGGGAGGATCGTCATTGGCCAGTACTCTTCAGGCCCCTCTGAGACCAACCACTGGAG
GCGCATGCTCAACACGCACCGCACAGCCGTGGAGCAGTGGCATAGCCTGAGGTCCCGAGCTGAGTGTGAC
CGCGTGTCTCCTGCCTCCCTGGAGGTGACCTGAGGGCTGCAGGGAAGGCAGCTTTCATTTGTTTAAAAAA
AAAAAAAAAAAAA
```

FIGURE 224
SEQ ID NO: 216
Genbank ID         : AI651930
Unigene ID(#167)   : acc_AI651930
Unigene name       :
>gi|4735909|gb|AI651930.1|AI651930  wb51c04.x1  NCI_CGAP_GC6  Homo sapiens cDNA cl
one IMAGE:2309190 3', mRNA sequence
```
GCGGCCGCAAATCTTTTTTTTTTTTTTTTTTTTAAACCCCTCGGTTTCTCTTTTTCTTCTCTTTCT
CTCTTGTTTTTGGTTAAAAAAAAATCTAGATCTCTTAAATCTCACACATCTCTGAGGGTTCCTATAGGCC
TGCTAGGCCTTAATTCTGGATTCCCCCTCCTCACTTGCCCCTGCGACAGGGCAGGGGAAAGTGGTGGGGG
ACACCCCAGGATCCTCAGTCCTTAGTCCTACAGCTTCTTCCTTTCTTGTTAATCCCTTTCTTTGTTTGGC
TCTGCCGGCTCCCCTGAGGGGGAGGGGGAGAGGGGGAGGAAGTCCATGGAGTGAAATCCAATCTACTGGA
AGGGTCCCAGGAGGGACCGGGTTCCCCCAGCTCCTCTCTCCACCATTCACCCCCGGGATGCTCCCCCAAG
AAAAGCAA
```

FIGURE 225
SEQ ID NO: 217
Genbank ID         : AI733018
Unigene ID(#167)   : Hs.247824
Unigene name       :       cytotoxic    T-lymphocyte-associated    protein    4
       CTLA4
>gi|5054131|gb|AI733018.1|AI733018  oh60h01.x5  NCI_CGAP_Kid5  Homo sapiens cDNA c
lone IMAGE:1471441 3' similar to contains element MER1 repetitive element
;, mR
NA sequence
```
TTTTCCGGAAAACGACCACCACAGATTTTTATTTAATTAAAAATATTATACATGTTGTTGCATTTTCATG
GAAAATATTGAGTTAAAAACACAAGCAGTGTTAATTTTCAGAAACCTTCATGCACCCCATTCTGCCACCT
GCTGCCTTCTTCTGTCCATGGCATTAACCACATGTTTGTAAGAATTGGGCCCATCGAACTGGAGCTTCCT
AGAAGGTCATACCTGTGGGTCTCCTGGAGTAAGCCATTGTCTTCAAGACAGTGTTCTGTCAAGTCAACTC
AGATACCACCAGCTGTGGCTTCCTTGCAAACCATTGAAAGGAACTGGTGTAAAAGCCCCAAAGCACATGT
CAACACCAACTCAGCACAATTCCACGCAATCAAGCACTGCTATGACCTCATCCAGTTTCCAAGCTAGTTA
GCAAATGACCTTGTGTTCTACCTGGTGTATTAGTGTCCTGAGCTCCTCCACAAAACTTCCCTGGACCCA
AGGTGGAAAGACACTGCCATATAGTGTTTATATTCAAACCATTAACAAATACACAAAAACATACGTGGCT
CTATGCACAATACTATCAAATTA
```

FIGURE 226
SEQ ID NO: 218
Genbank ID         : AI378979
Unigene ID(#167)   : Hs.313068
Unigene name       :       plakophilin 1 (ectodermal dysplasia/skin fragility
       syndrome)    PKP1

FIGURE 226 cont'd

```
>gi|4188832|gb|AI378979.1|AI378979 tc40d07.x1 Soares_total_fetus_Nb2HF8_9w
Homo
 sapiens  cDNA   clone   IMAGE:2067085  3'  similar  to  TR:Q15152  Q15152
PLAKOPHILIN. ;
, mRNA sequence
TTTTTTTTTTTCAAAGAAACACTAGCAATTTATTGATTTTCTCTATTTCCAAAAAAAGCAAATACATTAG
TGTATCACACAAGGAAACTGGGCCTGGCCGGCACAAGGTTCCTCTACAAACATGAAGCAAGGGGAAGGTG
GGCTACAGGGAAGCTCCAAGATCCCTCACAGAAGCCCCCGGTTTCCCTTCCCTGCCCACCCCAGCCGCAG
TTTTGGTCCTCCCAGCCAGTTCAGCCAGATTCCAAGGTGGACACGCAGACAGCAACACTGCCTCTTGCCC
ATGAGGTTCAGGTAGGTGCGGATGGCATCTGAATGGTACAACCAGCCGCTGCCCTTGGGGTTGGTCTTTT
CCTCAGGCAGGGGGCAGTCATAGTTGTTGTTCATCATCTTGTCGCTCTTGTTGCTGAAGCAGCCAGTGGA
GGACTTCTCGGTGTAGGCGTTGCGGGCGTTATACTCCANCTGGCGTAGCGGGTGGGACATCGGCGTCCAG
GCGGAGGAGAGTTTGGCAAAACACACATGCAGTTTTC
```

FIGURE 227
SEQ ID NO: 219
Genbank ID      : NM_001067.1
Unigene ID(#167) : Hs.156346
Unigene name    :       topoisomerase (DNA) II alpha 170kDa TOP2A
>gi|4507632|ref|NM_001067.1| Homo sapiens topoisomerase (DNA) II alpha
(170kD)
(TOP2A), mRNA

```
GGACCACCCAGTACCGATCCCTTCACGACCGTCACCATGGAAGTGTCACCATTGCAGCCTGTAAATGAAA
ATATGCAAGTCAACAAAATAAAGAAAAATGAAGATGCTAAGAAAAGACTGTCTGTTGAAAGAATCTATCA
AAAGAAAACACAATTGGAACATATTTTGCTCCGCCCAGACACCTACATTGGTTCTGTGGAATTAGTGACC
CAGCAAATGTGGGTTTACGATGAAGATGTTGGCATTAACTATAGGGAAGTCACTTTTGTTCCTGGTTTGT
ACAAAATCTTTGATGAGATTCTAGTTAATGCTGCGGACAACAAACAAAGGGACCCAAAAATGTCTTGTAT
TAGAGTCACAATTGATCCGGAAAACAATTTAATTAGTATATGGAATAATGGAAAAGGTATTCCTGTTGTT
GAACACAAAGTTGAAAAGATGTATGTCCCAGCTCTCATATTTGGACAGCTCCTAACTTCTAGTAACTATG
ATGATGATGAAAAGAAAGTGACAGGTGGTCGAAATGGCTATGGAGCCAAATTGTGTAACATATTCAGTAC
CAAATTTACTGTGGAAACAGCCAGTAGAGAATACAAGAAAATGTTCAAACAGACATGGATGGATAATATG
GGAAGAGCTGGTGAGATGGAACTCAAGCCCTTCAATGGAGAAGATTATACATGTATCACCTTTCAGCCTG
ATTTGTCTAAGTTTAAAATGCAAAGCCTGGACAAAGATATTGTTGCACTAATGGTCAGAAGAGCATATGA
TATTGCTGGATCCACCAAAGATGTCAAAGTCTTTCTTAATGGAAATAAACTGCCAGTAAAAGGATTTCGT
AGTTATGTGGACATGTATTTGAAGGACAAGTTGGATGAAACTGGTAACTCCTTGAAAGTAATACATGAAC
AAGTAAACCACAGGTGGGAAGTGTGTTTAACTATGAGTGAAAAGGCTTTCAGCAAATTAGCTTTGTCAA
CAGCATTGCTACATCCAAGGGTGGCAGACATGTTGATTATGTAGCTGATCAGATTGTGACTAAACTTGTT
GATGTTGTGAAGAAGAAGAACAAGGGTGGTGTTGCAGTAAAAGCACATCAGGTGAAAAATCACATGTGGA
TTTTTGTAAATGCCTTAATTGAAAACCCAACCTTTGACTCTCAGACAAAAGAAAACATGACTTTACAACC
CAAGAGCTTTGGATCAACATGCCAATTGAGTGAAAAATTTATCAAAGCTGCCATTGGCTGTGGTATTGTA
GAAAGCATACTAAACTGGGTGAAGTTTAAGGCCCAAGTCCAGTTAAACAAGAAGTGTTCAGCTGTAAAAC
ATAATAGAATCAAGGGAATTCCCAAACTCGATGATGCCAATGATGCAGGGGCCGAAACTCCACTGAGTG
TACGCTTATCCTGACTGAGGGAGATTCAGCCAAAACTTTGGCTGTTTCAGGCCTTGGTGTGGTTGGGAGA
GACAAATATGGGGTTTTCCCTCTTAGAGGAAAAATACTCAATGTTCGAGAAGCTTCTCATAAGCAGATCA
TGGAAAATGCTGAGATTAACAATATCATCAAGATTGTGGGTCTTCAGTACAAGAAAAACTATGAAGATGA
AGATTCATTGAAGACGCTTCGTTATGGGAAGATAATGATTATGACAGATCAGGACCAAGATGGTTCCCAC
ATCAAAGGCTTGCTGATTAATTTTATCCATCACAACTGGCCCTCTCTTCTGCGACATCGTTTTCTGGAGG
AATTTATCACTCCCATTGTAAAGGTATCTAAAAACAAGCAAGAAATGGCATTTACAGCCTTCCTGAATT
TGAAGAGTGGAAGAGTTCTACTCCAAATCATAAAAAATGGAAAGTCAAATATTACAAAGGTTTGGGCACC
AGCACATCAAAGGAAGCTAAAGAATACTTTGCAGATATGAAAAGACATCGTATCCAGTTCAAATATTCTG
GTCCTGAAGATGATGCTGCTATCAGCCTGGCCTTTAGCAAAAAACAGATAGATGATCGAAAGGAATGGTT
AACTAATTTCATGGAGGATAGAAGACAACGAAAGTTACTTGGGCTTCCTGAGGATTACTTGTATGGACAA
ACTACCACATATCTGACATATAATGACTTCATCAACAAGGAACTTATCTTGTTCTCAAATTCTGATAACG
AGAGATCTATCCCTTCTATGGTGGATGGTTTGAAACCAGGTCAGAGAAAGGTTTTGTTTACTTGCTTCAA
ACGGAATGACAAGCGAGAAGTAAAGGTTGCCCAATTAGCTGGATCAGTGGCTGAAATGTCTTCTTATCAT
CATGGTGAGATGTCACTAATGATGACCATTATCAATTTGGCTCAGAATTTTGTGGGTAGCAATAATCTAA
ACCTCTTGCAGCCCATTGGTCAGTTTGGTACCAGGCTACATGGTGGCAAGGATTCTGCTAGTCCACGATA
CATCTTTACAATGCTCAGCTCTTTGGCTCGATTGTTATTTCCACCAAAAGATGATCACACGTTGAAGTTT
TTATATGATGACAACCAGCGTGTTGAGCCTGAATGGTACATTCCTATTATTCCCATGGTGCTGATAAATG
GTGCTGAAGGAATCGGTACTGGGTGGTCCTGCAAAATCCCCAACTTTGATGTGCGTGAAATTGTAAATAA
```

FIGURE 227 cont'd

```
CATCAGGCGTTTGATGGATGGAGAAGAACCTTTGCCAATGCTTCCAAGTTACAAGAACTTCAAGGGTACT
ATTGAAGAACTGGCTCCAAATCAATATGTGATTAGTGGTGAAGTAGCTATTCTTAATTCTACAACCATTG
AAATCTCAGAGCTTCCCGTCAGAACATGGACCCAGACATACAAAGAACAAGTTCTAGAACCCATGTTGAA
TGGCACCGAGAAGACACCTCCTCTCATAACAGACTATAGGGAATACCATACAGATACCACTGTGAAATTT
GTTGTGAAGATGACTGAAGAAAAACTGGCAGAGGCAGAGAGAGTTGGACTACACAAAGTCTTCAAACTCC
AAACTAGTCTCACATGCAACTCTATGGTGCTTTTTGACCACGTAGGCTGTTTAAAGAAATATGACACGGT
GTTGGATATTCTAAGAGACTTTTTTGAACTCAGACTTAAATATTATGGATTAAGAAAAGAATGGCTCCTA
GGAATGCTTGGTGCTGAATCTGCTAAACTGAATAATCAGGCTCGCTTTATCTTAGAGAAAATAGATGGCA
AAATAATCATTGAAAATAAGCCTAAGAAAGAATTAATTAAAGTTCTGATTCAGAGGGGATATGATTCGGA
TCCTGTGAAGGCCTGGAAAGAAGCCCAGCAAAAGGTTCCAGATGAAGAAGAAATGAAGAGAGTGACAAC
GAAAAGGAAACTGAAAAGAGTGACTCCGTAACAGATTCTGGACCAACCTTCAACTATCTTCTTGATATGC
CCCTTTGGTATTTAACCAAGGAAAAGAAAGATGAACTCTGCAGGCTAAGAAATGAAAAAGAACAAGAGCT
GGACACATTAAAAAGAAAGAGTCCATCAGATTTGTGGAAAGAAGACTTGGCTACATTTATTGAAGAATTG
GAGGCTGTTGAAGCCAAGGAAAAACAAGATGAACAAGTCGGACTTCCTGGGAAAGGGGGAAGGCCAAGG
GGAAAAAAACACAAATGGCTGAAGTTTTGCCTTCTCCGCGTGGTCAAAGAGTCATTCCACGAATAACCAT
AGAAATGAAAGCAGAGGCAGAAAAGAAAAATAAAAAGAAAATTAAGAATGAAAATACTGAAGGAAGCCCT
CAAGAAGATGGTGTGGAACTAGAAGGCCTAAAACAAAGATTAGAAAAGAAACAGAAAAGAGAACCAGGTA
CAAAGACAAAGAAACAAACTACATTGGCATTTAAGCCAATCAAAAAAGGAAAGAAGAGAAATCCCTGGCC
TGATTCAGAATCAGATAGGAGCAGTGACGAAAGTAATTTTGATGTCCCTCCACGAGAAACAGAGCCACGG
AGAGCAGCAACAAAAACAAAATTCACAATGGATTTGGATTCAGATGAAGATTTCTCAGATTTTGATGAAA
AAACTGATGATGAAGATTTTGTCCCATCAGATGCTAGTCCACCTAAGACCAAAACTTCCCCAAAACTTAG
TAACAAAGAACTGAAACCACAGAAAAGTGTCGTGTCAGACCTTGAAGCTGATGATGTTAAGGGCAGTGTA
CCACTGTCTTCAAGCCCTCCTGCTACACATTTCCCAGATGAAACTGAAATTACAAACCCAGTTCCTAAAA
AGAATGTGACAGTGAAGAAGACAGCAGCAAAAAGTCAGTCTTCCACCTCCACTACCGGTGCCAAAAAAAG
GGCTGCCCCAAAAGGAACTAAAAGGGATCCAGCTTTGAATTCTGGTGTCTCTCAAAAGCCTGATCCTGCC
AAAACCAAGAATCGCCGAAAAGGAAGCCATCCACTTCTGATGATTCTGACTCTAATTTTGAGAAAATTG
TTTCGAAAGCAGTCACAAGCAAGAAATCCAAGGGGGAGAGTGATGACTTCCATATGGACTTTGACTCAGC
TGTGGCTCCTCGGGCAAAATCTGTACGGGCAAAGAAACCTATAAAGTACCTGGAAGAGTCAGATGAAGAT
GATCTGTTTTAAAATGTGAGGCGATTATTTTAAGTAATTATCTTACCAAGCCCAAGACTGGTTTTAAAGT
TACCTGAAGCTCTTAACTTCCTCCCCTCTGAATTTAGTTTGGGGAAGGTGTTTTTAGTACAAGACATCAA
AGTGAAGTAAAGCCCAAGTGTTCTTTAGCTTT
```

FIGURE 228
SEQ ID NO: 220
Genbank ID           : AK023230.1
Unigene ID(#167)    : Hs.139709
Unigene name         :        hypothetical protein FLJ12572 FLJ12572
>gi|10435070|dbj|AK023230.1|   Homo    sapiens   cDNA   FLJ13168   fis,   clone
NT2RP3003795

```
GCTTCCGGCTCCGGCGTGGGGTTTGATGTCTACGGAGTGGCTTTTGCTTAGCGTCTTGAAGGGGGGAAAA
AAATCCTCTAAGCTGGTGATTTCACGTTCTTTGACAAACTTCAATAGCAACAGGCAACGATACCACTTTA
AGAAAATTCCAAGGAAAAGACCCTCATTTTAAAATTCCCACCTCTGGCTCCCAAAGATTGGTTTGCAAACT
TCGACAAAATACTCTTCTCCACTCGCTATTGATGGAGTCTCGCTCTGTCACCCAGGCTGGAGTATAGTGG
TGTGATCTTGGCTCACTGCAACCTCTGCCTCCCAGGTTCAAGCGATTCTCCTGCCTCAGCCTCTCGAGTA
GCTGGAATTACAGGTCTGGCAGAAGGAACAGTATCAACTGACTGAGTAGGTCTCATTGGCAGTTGTGATT
CAGAGACCTAGAAAGCTGAACCCACGGCTGGCAAGAAGAGGATGGTTTGTGGGACCTGGGCTGATGTCTG
ATGAAATTTTAAGCCCCAGCTATAGCTACTACAAAGAAAGTGGCTGATGATAAGCATGTAACTCAAAAA
GACAATGTATATAAAAATATGCAAGAATCACAGGAAACCCACATATCCAACCACCTAGATGAAGTTGTTG
CTGCTGTTAGCATCACTCATAGAAAGAAGTTCCAAAACAAGCTGCTTCAGACAGCACTATTCCAGCCTCC
TCGAGAGAAACTCCACCTCTGTGAAGAGAAAGCAAAGTCCTATTCCAACAGTCATGAGTACAAACAGGCC
GTCCATGAGCTTGTGCGTTGCGTAGCACTGACAAGAATTTGCTATGGAGACTCACATTGGAAACTAGCAG
AGGCACATGTTAATCTGGCTCAAGGCTACCTCCAGCTGAAAGGACTGTCACTGCAAGCAAAACAACATGC
AGAAAAAGCCAGACAAATCCTCGCCAACTCCATTGTGCCTCCCTATAGTGAGAATACAGATGTTTTCAAG
TTTTCCATTGAGCTTTTCCATACCATGGGCAGAGCTTTACTCTCCCTTCAAAAATTTAAGGAAGCTGCAG
AGAATTTGACAAAAGCAGAGAGACTTTCAAAGGAGCTGCTACAATGTGGAAGAATTATAAAGGAAGAATG
GATAGAAATTGAAGCACGGATCAGATTATCATTTGCACAGGTGTATCAAGGTCAGAAGAAGTCAAAAGAA
GCTTTGTCCCACTATCAAGCAGCTTTGGAATATGTTGAGATCAGTAAAGGTGAAACAAGTCGTGAGTGTG
TACCCATATTGAGAGAATTAGCAGGTGTAGAGCAAGCCCTGGGACTCCACGATGTATCCATCAACCACTT
CCTCCAGGCACATCTCATCATCCTGAGTAGAAGCCCCTCTCAAGTGGAGGCAGCAGACTCGGCACACATC
GTCGCCCATGCTGCTGTCGCTTCAGGGAGACACGAGCACCATGATGTAGCTGAGCAGTATTTTCAAGAGA
```

FIGURE 228 cont'd

```
GCATGGCTCATCTTAAGGATTCTGAAGGGATGGGAAGAACCAAATTTCTTTCAATTCAAGATGAATTTTG
CCATTTTCTACAAATGACTGGACAAAAGAGAGAGCAACCTCGATCCTGAGAGAGTCCCTGGAAGCCAAA
GTGGAAGCATTTGGCGATTTCAGTCCCGAGGTGGCAGAGACATACCGGCTCCTGGGAGGAGCAGACCTGG
CGCAGGGGAACCACAGTGGGGCCCGCAAGAAACTGAAGAAGGTAAAGCTGGAACCAGTACTAACACGAGA
CTAGGCTCTCCCTCCCCTCTCCAAGGCCAATTTCTCTCCCTTGTGGTGGTTCTTTTAAATGAAACTTTAG
AAGTGGCTTGTTTAGATAGGATGACATCACTTTTGTGGTAGATCTAACCTGATACTTTTTGGGTAAAAGA
CATAGTAAGCCTCTTAGACATACATATTTTTTAAATGAATTATCAGTTTTTACTATGCAAATATTTTTAA
TTTTTTACGTAGTACAATTGATCAGTCCTTTATGTTTGCGGTGCTCTCTCTATACTGAGTTTATAGAGGA
ATTCTCTTACACTTTCTTCAATTGTCATTCTTCTTTAAATTTGGAGTTTATTTGTGTGGATGGCATGAGG
AATGGATCTAATCTTACCTTTTTTCCAAATGGCCACCCAGTTGTCCAGCACCATTTAATTAGAGAGCCCA
TCTATGCTCCAGTGACTTCAGATAACACCTTCATCATATACTGATTTTCCTTATGGACTTAAGTCTATTT
CTAGATTTCTCTTCTCTTCCACTAGTCTTTCTGTTTATTCATGTGTCAATATTTCAGTTTTAATTACAGA
GATTTTATAGAATGATTTAATATGTGATAGGAGTAGACACCCCTTATGGCTTTTCTTTTACTAGAATATC
AGGTGTTCTAGCTATTCTTCCGTGTTTATTTTTCTACATGAATTTTTGTATCAATTTGTCTAACTCCATA
AAGAGCTTACTAGTATTTTTATTGCATTATTTATAAATAAATCTTGTGAGAATTG
```

FIGURE 229
SEQ ID NO: 221
Genbank ID        : AW772192
Unigene ID(#167)  : Hs.7888
Unigene name      :        CDNA FLJ44318 fis, clone TRACH3000780
>gi|7704256|gb|AW772192.1|AW772192 hn69f02.x1 NCI_CGAP_Kid11 Homo sapiens
cDNA
clone IMAGE:3033147 3', mRNA sequence
```
AACGTTTGTTTCATATTTTATTGAATTTCATTTATATTAAATTAAAAATATATTTCTGACAGATTCATGT
AACAAAAGGCAGAACAGTTTTCAAATTGTTCAGCTGGGATGATCAGTATGGAATGAGGCAAAGCAGTTC
GCATTCTATAATTGCCTTGTACAGGTACAATTCTTTCCCAAGAGCCAAAAGAGGATCCTTGAGAACTAAC
GGAAAAGCCTAATTACATAAATGTAAAATACTGTTTCTCCCTCATTCTCAAATAACAACAGGAATGAGGG
AAAGGAAGGAGGATGGGTAAAAGGTTGGAGGAGAAGAAAGAATAAGAGAAAGTATACTAAAAATATGCCT
AACATTAAAAAAGTTAGTATGTGTTAGGTGCATGATCCTTCATCAATAACATGGAAAAAAATCAAAATAA
CATTACACCACACACAATTGGCATATCCTATTGTGTAAGCGAGTGCAGAGGTTGAACACATCACAATAGT
GCTGAACACAGAATCACAAGTAATGTCAAAATGATAACTTCCAACC
```

FIGURE 230
SEQ ID NO: 222
Genbank ID        : AI492376
Unigene ID(#167)  : acc_AI492376
Unigene name      :
>gi|4393379|gb|AI492376.1|AI492376 ti27c10.x1 NCI_CGAP_Kid11 Homo sapiens
cDNA
clone IMAGE:2131698 3', mRNA sequence
```
TTATTATTTATTACTATTATTTTTATTGTTAGTTTTTAGTTATACCTTCTGGGATGGGAGACAGTTTTA
AAAGTTAACAATTGTCTTGGATGTTGCTGTTTTTAACTCAGTAAGTACATCTGTTCTGCCAGTGCTGCCC
TGAGCACTGGAACTGGGAGAGCAGGTAGCAAGCTAGCACTGGACACAGCATAAACAGCGACATATTTCTC
TTCCCCTTCAAACTGGCTGGCCCTGTAACCAATAAAATGTGGCCCATGTGACACTGGGTGACTTCTGAGG
CTAGCCCTCCAGAGATCTAGCTTATGTGGTCCTTTATTTGGGAATGCTCCTTCTCGTAATCCATCTGCCA
TGCTATGAGGAAGTCCAAGCAGCCATATGGAGAGCCGCAGGTGCAGGAGAACTAAGGCCCCAGCTAGGAG
CCTGCACCGCATTGCTGGCTGAGCAAGTCAGGCCAGTTTGGACTTTTCAGCCATTCCAGGGCTCCATCCA
ATACCATCTAAAGCAGAACTGGCTGGTCAATCCATAGAAGGAAGGGGG
```

FIGURE 231
SEQ ID NO: 223
Genbank ID        : AB020689.1
Unigene ID(#167)  : Hs.411317
Unigene name      :       KIAA0882 protein  KIAA0882
>gi|4240252|dbj|AB020689.1|AB020689 Homo sapiens mRNA for KIAA0882 protein,
par FIGURE 231 cont'd tial cds
```
GAACTTATGTAGCCTCATTATCCCGCTCCGTGAGGTGACAATTGTGGAAAAGGCAGACAGCTCCAGTGTG
CTCCCCAGTCCCTTATCCATCAGCACCCGAAACAGGATGACCTTCCTATTTGCCAACTTGAAAGATAGAG
ACTTTCTAGTGCAGAGGATCTCAGATTTCCTGCAACAGACTACTTCCAAAATATATTCTGACAAGGAGTT
TGCAGGAAGTTACAACAGTTCAGATGATGAGGTGTACTCTCGACCCAGCAGCCTCGTCTCCTCCAGCCCC
CAGAGAAGCACGAGCTCTGATGCTGATGGAGAGCGCCAGTTTAACCTAAATGGCAACAGCGTCCCCACAG
CCACACAGACCCTGATGACCATGTATCGGCGGCGGTCTCCCGAGGAGTTCAACCCGAAATTGGCCAAAGA
GTTTCTGAAAGAGCAAGCCTGGAAGATTCACTTTGCTGAGTATGGGCAAGGGATCTGCATGTACCGCACA
GAGAAAACGCGGGAGCTGGTGTTGAAGGGCATCCCGGAGAGCATGCGTGGGGAGCTCTGGCTGCTGCTGT
CAGGTGCCATCAATGAGAAGGCCACACATCCTGGGTACTATGAAGACCTAGTGGAGAAGTCCATGGGGAA
GTATAATCTCGCCACGGAGGAGATTGAGAGGGATTTACACCGCTCCCTTCCAGAACACCCAGCTTTTCAG
AATGAAATGGGCATTGCTGCACTAAGGAGAGTCTTAACAGCTTATGCTTTTCGAAATCCCAACATAGGGT
ATTGCCAGGCCATGAATATTGTCACTTCAGTGCTGCTGCTTTATGCCAAAGAGGAGGAAGCTTTCTGGCT
GCTTGTGGCTTTGTGTGAGCGCATGCTCCCAGATTACTACAACACCAGAGTTGTGGGTGCACTGGTGGAC
CAAGGTGTCTTTGAGGAGCTAGCACGAGACTACGTCCCACAGCTGTACGACTGCATGCAAGACCTGGGCG
TGATTTCCACCATCTCCCTGTCTTGGTTCCTCACACTATTTCTCAGTGTGATGCCTTTTGAGAGTGCAGT
TGTGGTTGTTGACTGTTTCTTCTATGAAGGAATTAAAGTGATATTCCAGTTGGCCCTAGCTGTGCTGGAT
GCAAATGTGGACAAACTGTTGAACTGCAAGGATGATGGGGAGGCCATGACCGTTTGGGAAGGTATTTAG
ACAGTGTGACCAATAAAGACAGCACACTGCCTCCCATTCCTCACCTCCACTCCTTGCTCAGCGATGATGT
GGAACCTTACCCTGAGGTAGACATCTTTAGACTCATCAGAACTTCCTACGAGAAATTCGGAACTATCCGG
GCAGATTTGATTGAACAGATGAGATTCAAACAGAGACTGAAAGTGATCCAGACGCTGGAGGATACTACGA
AACGCAACGTGGTACGAACCATTGTGACAGAAACTTCCTTTACCATTGATGAGCTGGAAGAACTTTATGC
TCTTTTCAAGGCAGAACATCTCACCAGCTGCTACTGGGCGGGAGCAGCAACGCGCTGGACCGGCATGAC
CCCAGCCTGCCCTACCTGGAACAGTATCGCATTGACTTCGAGCAGTTCAAGGGAATGTTTGCTCTTCTCT
TTCCTTGGGCATGTGGAACTCACTCTGACGTTCTGGCCTCCCGCTTGTTCCAGTTATTAGATGAAATGG
AGACTCTTTGATTAACTTCCGGGAGTTTGTCTCTGGGCTAAGTGCTGCATGCCATGGGGACCTCACAGAG
AAGCTCAAACTCCTGTACAAAATGCACGTCTTGCCTGAGCCATCCTCTGATCAAGATGAACCAGATTCTG
CTTTTGAAGCAACTCAGTACTTCTTTGAAGATATTACCCCAGAATGTACACATGTTGGATTGGATAG
CAGAAGCAAACAGGGTGCAGATGATGGCTTTGTTACGGTGAGCCTAAAGCCAGACAAAGGGAAGAGAGCA
AATTCCCAAGAAATCGTAATTATTTGAGACTGTGGACTCCAGAAAATAAATCTAAGTCAAAGAATGCAA
AGGATTTACCCAAATTAAATCAGGGGCAGTTCATTGAACTGTGTAAGACAATGTATAACATGTTCAGCGA
AGACCCCAATGAGCAGGAGCTGTACCATGCCACGGCAGCAGTGACCAGCCTCCTGCTGGAGATTGGGGAG
GTCGGCAAGTTGTTCGTGGCCCAGCCTGCAAAGGAGGGCGGGAGCGGAGGCAGTGGGCCGTCCTGCCACC
AGGGCATCCCAGGCGTGCTCTTCCCCAAGAAAGGGCCAGGCCAGCCTTACGTGGTGGAGTCTGTTGAGCC
CCTGCCGGCCAGCCTGGCCCCCGACAGCGAGGAACACTCCCTTGGAGGACAAATGGAGGACATCAAGCTG
GAGGACTCCTCGCCCCGGGACAACGGGGCCTGCTCCTCCATGCTGATCTCTGACGACGACACCAAGGACG
ACAGCTCCATGTCCTCATACTCGGTGCTGAGTGCGGCTCCCACGAGGAGGACAAGCTGCACTGCGAGGA
CATCGGAGAGGACACGGTCCTGGTGCGGAGCGGCCAGGGCACGGCGGCACTGCCCCGGAGCACCAGCCTG
GACCGGGACTGGGCCATCACCTTCGAGCAGTTCCTGGCCTCCCTCTTAACTGAGCCTGCCCTGGTCAAGT
ACTTTGACAAGCCCGTGTGCATGATGGCCAGGATTACCAGTGCAAAAAACATCCGGATGATGGGCAAGCC
CCTCACCTCGGCCAGTGACTATGAAATCTCGGCCATGTCCGGCTGACACGGGCGCCTTCCCGGGGAGTG
GGAGGAGAGGGAGGGGAGGGATTTTTATGTTCTTCTGTGTTGAGTTTTTCTTTCTTTCTTTTAAATTA
AATATTTATTAGTACCTGGCTTGAAGCCTAGTGTTTTCATAATGTAATTCAATGAAAACTGTTGGAGAAA
TATTTAAACACCTCAATGTAGGTACATTACACTCTTGTTGCGGGGAGGGGATTTACCAGAATACAGTTTA
TTTCGTGAATTCTAAAAAACAAAAAGATGAATCTGTCAGTGATATGTGTGTATTATAACTTATTAATCTT
GCTGTTGAGCTGTATACATGGTTTAAAAAATAGTACTGTTTAATGCTAAGTAAGGCAGCAGTCATTTGTG
TATTCAGGCTTTTTAAATAAAATTAGAGCTGTAGGAAAATGAAAAGCCACAAATGCAAGACTGTTCTTA
AATGGAAGGCATAGTCAGCGAGGGTAAATCCTATACCACTTTAGGAAGTATTAAAAATATTTTTAAGATT
TGAAATATATTTCATAGAAGTCCTCTATTCAAAATCATATTCCACAGATGTTCCCCTTCAAAGGGAAAAC
ATTTGGGGTTCTAAACAGTTATGAAAGTAAGTGATTTTTACATGATTCCAGAATAACACTTGTATTGACC
AATTTAGACAGATACCAGACCAATTTTGCATTTAAGAAATTGTTCTGATTATTTACGTCAACTCATTAGA
ATTCAGTGAAAAGTAACAGTCTTTTGTCACAGAGAATCTGAAAGTAGCAGCAAAGACAGAGGGCTCATGA
CAGGTTTTTGCTTTTGCTTTGCTTTTGTTTTTGAAAGAGTAAAAGTACTGATGCTTCTGATACTGGATGT
TTAGCTTCTTACTGCAAAAACATAAGTAAAACAGTCAACTTTACCATTTCCGTATTCTCCATAGATTGAA
GAAATTTATACCACATATCGCATATGACCATCTTTCCATCAAATCAATGTAGAGATAATGTAAACTGAAA
AAAAATCTGCAAGATAATGTAACTGAATGTTTTAAAAACAGAACTTGTCACTTTATATAAAAGAATAGTA
TGCTCTATTTCCTGAATGGATGTGGAAATGAAAGCTAGCGCACCTGCACTTTGAATTCTTGCTTCTTTTT
TATTACTGTTATGATTTTGCTTTTTACAGATGTTGGACGATTTTTCTTCTGATTGTTGAATTCATAATC
ATGGTCTCATTTCCTTTGCTTCTTTGGAATATTTCTTTCAACACATTCCTTTATTTTATTATACATTGTG
TCCTTTTTTTAGCTATTGCTGCTGTTGTTTTTATTCTATTTACAGGATGATTTTAAACTGTCAAATGA
AGTAGTGTTAACCCTCAAATAGGCTAAATGTGAACAAATAAAATACAGCAAATACTC
```

FIGURE 232
SEQ ID NO: 224
```
Genbank ID         : AI307915
Unigene ID(#167)   : Hs.79414
Unigene name       :    SAM  pointed  domain  containing  ets  transcription
factor      SPDEF
>gi|4002550|gb|AI307915.1|AI307915  tb39c07.x1  NCI_CGAP_Br17  Homo  sapiens
cDNA c
lone IMAGE:2056716 3', mRNA sequence
GCGGCCGCCTACTACTACTATACGGCTGTTAGAAGACGACAGAAGGGCAGTGACTCGACAAAGGCCACAG
GCAGTCCAGGCCTCTCTCTGCTCCATCCCCCTGCCTCCCATTCTGCACCACACCTGGCATGGTGCAGGGA
GACATCTGCACCCCTGAGTTAGGCAGCCAGGAGTGCCCCGGGAATGGATAATAAAGACACTAGAGAACT
CAAAAAAAAAAAAAAAAAAAAAAAAAAAAAGTCGTATCGATGT
```

FIGURE 233
SEQ ID NO: 225
```
Genbank ID         : AI693336
Unigene ID(#167)   : Hs.163484
Unigene name       :       forkhead box A1    FOXA1
>gi|4970676|gb|AI693336.1|AI693336  wd91d09.x1  NCI_CGAP_Lu24  Homo  sapiens
cDNA c
lone IMAGE:2338961 3', mRNA sequence
ACATTTTGTTGTTGCTGCCGATGATTTCAACGCCTGGCTTTGAGATTCCGTGAGTAGTCTTGAATAATTT
AAAATTCGAAAATCAAATTCTACTTATTTTCTCTTAATGCTATTGTATTTCCTAATTCTCAGCTTTAACA
TGTAAGAAAGTACTTTCGCTAGGGGTCTTAATTGAATGGTGGGGTCGAGATGACTGCGTCAGAATTAAAT
CTCTGGAAGACCTCTGAGCTCCTTTTAAAATCATCAACAAGCGAAAATCCTTATCAATAGCGATGTGGGA
ATGCATTAGGTACAGTATTTTAAACATACAAAACCTAGGCATATTAAAAAGCACTCCTCTGGTAATTTAA
TAAGGAATAATGATGTCCTTAAGTTTATTTTAATCAGCAAGTATGACTCAATTTGAAAATATGAGAACAA
ATAGATTTAAATAGGAACACCCAGTAAACTATGGTATGCAAATAAACTCAGAGGTAAACTTGTGAATACA
TAAATCTAAATAAGTCAGTTACCATCAAAATATTACGTGATCCTATATTNTTCTGTCCACGTCT
```

FIGURE 234
SEQ ID NO: 226
```
Genbank ID         : NM_007050.2
Unigene ID(#167)   : Hs.225952
Unigene name       :     protein  tyrosine  phosphatase,  receptor  type,  T
     PTPRT
>gi|7427522|ref|NM_007050.2|  Homo  sapiens  protein  tyrosine  phosphatase,
recepto
r type, T (PTPRT), mRNA
CCTCCCGCCTCAGTTCGCGCCGCGCCTCGGCTTGGAACGCAGGAGCGCCGGCTCCGGGAGCCCGAGCGGA
GCCAGCCGCGCGCACAGCCAGCGGCCGCGCCGGCGATGCGGGGCCACCCGCGCCCGCCCCAGTCCCGGC
CCCGGCCCCCGCGGGAAGGGGCTGAGCTGCCCGCCGCCGCCCGGATGGCGAGCCTCGCCGCGCTCGCCCT
CAGCCTGCTCCTGAGGCTGCAGCTGCCGCCACTGCCCGGCGCCCGGGCTCAGAGCGCCCCAGGTGGCTGT
TCCTTTGATGAGCACTACAGCAACTGTGGTTATAGTGTGGCTCTAGGGACCAATGGGTTCACCTGGGAGC
AGATTAACACAACGGAGAAACCAATGCTGGACCAGGCAGTGCCCACAGGATCTTTCATGATGGTGAACAG
CTCTGGGAGAGCCTCTGGCCAGAAGGCCCACCTTCTCCTGCCAACCCTGAAGGAGAATGACACCCACTGC
ATCGACTTCCATTACTACTTCTCCAGCCGTGACAGGTCCAGCCCAGGGGCCTTGAACGTCTACGTGAAGG
TGAATGGTGGCCCCAAGGGAACCCTGTGTGGAATGTGTCCGGGTCGTCACTGAGGGCTGGGTGAAGGC
AGAGCTCGCCATCAGCACTTTCTGGCCACATTTCTATCAGGTGATATTTGAATCCGTCTCATTGAAGGGT
CATCCTGGCTACATCGCCGTGGACGAGGTCCGGGTCCTTGCTCATCCATGCAGAAAAGCACCTCATTTTC
TGCGACTCCAAAACGTGGAGGTGAATGTGGGCAGAATGCCACATTTCAGTGCATTGCTGGTGGGAAGTG
GTCTCAGCATGACAAGCTTTGGCTCCAGCAATGGAATGGCAGGGACACGGCCCTGATGGTCACCCGTGTG
GTCAACCACAGGCGCTTCTCAGCCACAGTCAGTGTGGACACACTGCCCAGCGGAGCGTCAGCAAGTACC
GCTGTGTGATCCGCTCTGATGGTGGGTCTGGTGTGTCCAACTACGCGGAGCTGATCGTGAAAGAGCCTCC
CACGCCCATTGCTCCCCCAGAGCTGCTGGCTGTGGGGGCCACATACCTGTGGATCAAGCCAAATGCCAAC
```

FIGURE 234 cont'd

```
TCCATCATCGGGGATGGCCCCATCATCCTGAAGGAAGTGGAATATCGCACCACCACAGGCACGTGGGCAG
AGACCCACATAGTCGACTCTCCCAACTATAAGCTGTGGCATCTGGACCCCGATGTTGAGTATGAGATCCG
AGTGCTCCTCACACGACCAGGTGAGGGGGGTACGGGACCGCCAGGGGCTCCCCTCACCACCAGGACCAAG
TGTGCAGATCCGGTACATGGCCCACAGAACGTGGAAATCGTAGACATCAGAGCCCGGCAGCTGACCCTGC
AGTGGGAGCCCTTCGGCTACGCGGTGACCCGCTGCCATAGCTACAACCTCACCGTGCAGTACCAGTATGT
GTTCAACCAGCAGCAGTACGAGGCCGAGGAGGTCATCCAGACCTCCTCCCACTACACCCTGCGAGGCCTG
CGCCCCTTCATGACCATCCGGCTGCGACTCTTGCTGTCTAACCCCGAGGGCCGAATGGAGAGCGAGGAGC
TGGTGGTGCAGACTGAGGAAGACGTTCCAGGAGCTGTTCCTCTAGAATCCATCCAAGGGGGGCCCTTTGA
GGAGAAGATCTACATCCAGTGGAAACCTCCCAATGAGACCAATGGGGTCATCACGCTCTACGAGATCAAC
TACAAGGCTGTCGGCTCGCTGGACCCAAGTGCTGACCTCTCGAGCCAGAGGGGGAAAGTGTTCAAGCTCC
GGAATGAAACCCACCACCTCTTTGTGGGTCTGTACCCAGGGACCACCTATTCCTTCACCATCAAGGCCAG
CACAGCAAAGGGCTTTGGGCCCCTGTCACCACTCGGATTGCCACCAAAATTTCAGCTCCATCCATGCCT
GAGTACGACACAGACACCCCATTGAATGAGACAGACACGACCATCACAGTGATGCTGAAACCCGCTCAGT
CCCGGGGAGCTCCTGTCAGTGTTTATCAGCTGGTTGTCAAGGAGGAGCGACTTCAGAAGTCACGGAGGGC
AGCTGACATTATTGAGTGCTTTTCGGTGCCCGTGAGCTATCGGAATGCCTCCAGCCTCGATTCTCTACAC
TACTTTGCTGCTGAGTTGAAGCCTGCCAACCTGCCTGTCACCCAGCCATTTACAGTGGGTGACAATAAGA
CATACAATGGCTACTGGAACCCTCCTCTCTCTCCCTGAAAAGCTACAGCATCTACTTCCAGGCACTCAG
CAAAGCCAATGGAGAGACCAAAATCAACTGTGTTCGTCTGGCTACAAAAGCACCAATGGGCAGCGCCCAG
GTGACCCCGGGGACTCCACTCTGCCTCCTCACCACAGGTGCCTCCACCCAGAATTCTAACACTGTGGAGC
CAGAGAAGCAGGTGGACAACACCGTGAAGATGGCTGGCGTGATCGCTGGCCTCCTCATGTTCATCATCAT
TCTCCTGGGCGTGATGCTCACCATCAAAAGGAGAAGAAATGCTTATTCCTACTCCTATTACTTGTCCCAA
AGGAAGCTGGCCAAGAAGCAGAAGGAGACCCAGAGTGGAGCCCAGAGGGAGATGGGGCCTGTGGCCTCTG
CCGACAAACCCACCACCAAGCTCAGCGCCAGCCGCAATGATGAAGGCTTCTCTTCTAGTTCTCAGGACGT
CAACGGATTCACAGATGGCAGCCGCGGGGAGCTTTCCCAGCCCACCCTCACGATCCAGACTCATCCCTAC
CGCACCTGTGACCCTGTGGAGATGAGCTACCCCGGGACCAGTTCCAACTCGCCATCCGGGTGGCTGACT
TGCTGCAGCACATCACGCAGATGAAGAGAGGCCAGGGCTACGGGTTCAAGGAGGAATACGAGGCCTTACC
AGAGGGGCAGACAGCTTCGTGGGACACAGCCAAGGAGGATGAAAACCGCAATAAGAATCGATATGGGAAC
ATCATATCCTACGACCATTCCCGGGTGAGGCTGCTGGTGCTGGATGGAGACCCGCACTCTGACTACATCA
ATGCCAACTACATTGACGGATACCATCGACCTCGGCACTACATTGCGACTCAAGGTCCGATGCAGGAGAC
TGTAAAGGACTTTTGGAGAATGATCTGGCAGGAGAACTCCGCCAGCATCGTCATGGTCACAAACCTGGTG
GAAGTGGGCAGGGTGAAATGTGTGCGATACTGGCCAGATGACACGGAGGTCTACGGAGACATTAAAGTCA
CCCTGATTGAAACAGAGCCCCTGGCAGAATACGTCATACGCACCTTCACAGTCCAGAAGAAAGGCTACCA
TGAGATCCGGGAGCTCCGCCTCTTCCACTTCACCAGCTGGCCTGACCACGGCGTTCCCTGCTATGCCACT
GGCCTTCTGGGCTTCGTCCGCCAGGTCAAGTTCCTCAACCCCCGGAAGCTGGGCCCATAGTGGTCCACT
GCAGTGCTGGGGCTGGGCGGACTGGCTGCTTCATTGCCATTGACACCATGCTTGACATGGCCGAGAATGA
AGGGGTGGTGGACATCTTCAACTGCGTGCGTGAGCTCCGGGCCCAAAGGGTCAACCTGGTACAGACAGAG
GAGCAATATGTGTTTGTGCACGATGCCATCCTGGAAGCGTGCCTCTGTGGCAACACTGCCATCCCTGTGT
GTGAGTTCCGTTCTCTCTACTACAATATCAGCAGGCTGGACCCCAGACAAACTCCAGCCAAATCAAAGA
TGAATTTCAGACCCTCAACATTGTGACACCCCGTGTGCGGCCCGAGGACTGCAGCATTGGGCTCCTGCCC
CGGAACCATGATAAGAATCGAAGTATGGACGTGCTGCCTCTGGACCGCTGCCTGCCCTTCCTTATCTCAG
TGGACGGAGAATCCAGCAATTACATCAACGCAGCACTGATGGATAGCCACAAGCAGCCTGCCGCCTTCGT
GGTCACCCAGCACCCTCTACCCAACACCGTGGCAGACTTCTGGAGGCTGGTGTTCGATTACAACTGCTCC
TCTGTGGTGATGCTGAATGAGATGGACACTGCCCAGTTCTGTATGCAGTACTGGCCTGAGAAGACCTCCG
GGTGCTATGGGCCCATCCAGGTGGAGTTCGTCTCCGCAGACATCGACGAGGACATCATCCACAGAATATT
CCGCATCTGTAACATGGCCCGGCCACAGGATGGTTATCGTATAGTCCAGCACCTCCAGTACATTGGCTGG
CCTGCCTACCGGGACACGCCCCCCTCCAAGCGCTCTCTGCTCAAAGTGGTCCGACGACTGGAGAAGTGGC
AGGAGCAGTATGACGGGAGGGAGGGACGTACTGGTCCACTGCCTAAATGGGGGAGGCCGTAGTGGAAC
CTTCTGTGCCATCTGCAGTGTGTGTGAGATGATCCAGCAGCAAAACATCATTGACGTGTTCCACATCGTG
AAAACACTGCGTAACAACAAATCCAACATGGTGGAGACCCTGGAACAGTATAAATTTGTATACGAGGTGG
CACTGGAATATTTAAGCTCCTTTTAGCTCAATGGGATGGGGAACTGCCGGAGTCCAGAGGCTGCTGTGAC
CAAGCCCCCTTTTGTGTGAATGGCAGTAACTGGGCTCAGGAGCTCTGAGGTGGCACCCTGCCTGACTCCA
AGGAGAAGACTGGTGGCCCTGTGTTCCACGGGGGCTCTGCACCTTCTGAGGGGTCTCCTGTTGCCGTGG
GAGATGCTGCTCCAAAAGGCCCAGGCTTCCTTTTCAACCTAACCAGCCACAGCCAAGGGCCCAAGCAGAA
GTACACCCACAAGCAAGGCCTTGGATTTCTGGCTCCCAGACCACCTGCTTTTGTTCTGAGTTTGTGGATC
TCTTGGCAAGCCAACTGTGCAGGTGCTGGGGAGTGGGAGGCTCCCCTGCCCTCCTTCTCCTTAGGAGTGG
AGGAGATGTGTGTTCTGCTCCTCTACGTCATGGAAAAGATTGAGGCTCTTGGGGGTCACTGCTCTGCTGC
CCCCTGCAACCTCCTTCAGGGGCCTCTGGCACCAGACATTTGCAGTCTGGACCAGTGTGACCTTACGATG
TTCCCTAGGCCACAAGAGAGGCCCCCCATCCTCACACCTAACCTGCATGGGGCTTCGCCCACAACCATTC
TGTACCCCTTCCCCAGCCTGGGCCTTGACCGTCCAGCATTCACTGGCCGGCCAGCTGTGTCCACAGCAGT
TTTTGATAAAGGTGTTCTTTGCTTTTTTGTGTGGTCAGTGGGAGGGGTGGAACTGCAGGGAACTTCTCT
GCTCCTCCTTGTCTTTGTAAAAAGGGACCACCTCCCTGGGGCAGGCTTGGGCTGACCTGTAGGATGTAA
```

FIGURE 234 cont'd

```
CCCCTGTGTTTCTTTGGTGGTAGCTTTCTTTGGAAGAGACAAACAAGATAAGATTTGATTATTTTCCAAA
GTGTATGTGAAAAGAAACTTTCTTTTGGAGGGTGTAAAATCTTAGTCTCTTATGTCAAAAAGAAGGGGGC
GGGGGAGTTTGAGTATGTACCTCTAAGACAAATCTCTCGGGCCTTTTATTTTTTCCTGGCAATGTCCTTA
AAAGCTCCCACCCTGGGACAGCATGCCACTGAGCAAGGAGAGATGGGTGAGCCTGAAGATGGTCCCTTTG
GTTTCTGGGGCAAATAGAGCACCAGCTTTGTGCATAATTTGGATGTCCAAATTTGAACTCCTTCCTAAAG
AAACCCAGCAGCCACCTTGAAAAAGGCCATTGTGGAGCCCATTATACTTTGATTTAAAATAGGCCAAGAG
AATCAGGCCTGGAGATCTAGGGTCTTGTCCAAAGTGTGAGTGAGTCAATGAGAGGGAACCAACATTTGCT
AAGTCTCTACTGTATGCCAGGGATCATGCTTGGCACTTTCCATAGGACATTTCACACAGTCCTTAGAACC
CCCAGGAGAGAGCTACTGACTTGTTATCATCTCCATTTGATCATCTCCTCCAATGAGGAAACCCACGCAC
CTTCCTTAGTAATGAAATCCTGGGTTCCAAAGGGGCAGGTAATGGCAATGAGACTTCTCCGTGCTGTTTT
CTTCATCTTCTCTAAGCCAAGCAATTATTTTATGGAGGGAAAATAAGGCCAGAAACTTCTGAGCAGATAA
CTCCACAAATGGAAATTTAGTACTTTCTTCCTGATGCCAGTTCTTCTGGGAAGCGCAGAATTTCAGATAT
ATTTTAGTAACACATTCCCAGCTCCCCAGGAAAGCCAGTCTCATCTAATTTCTTAGTCAGTAAAAACAAT
TCCCTGTTCCTTCAGGCTATGAATGGACCAGCCAGGGAAACTCTCGACCTTGATCTCTAGCCAGTGCTTA
GGCCCAATATCTGACAGCCTCAGGTGGGCTGGGACCTAGGAAGCTCCATCTTGAAGGCTGGTCTAGCCCC
AGACAGGGCATGAGGGGCAGAGAATTCAAGAAGGTACAGCTTTGGCCCTCAAGAGCCCACTGTATGCTGG
GGAAATGGAACCATGGTGCAGTAGTGTGGAGTGGATGAGTGTTCCATGAGCCTAGGAGCAAGAAAGTCTC
TTCGGCCTCGGGCTTCCTGGAGAAGGGGACGTCCATTCCTGCTGGGTCTTAACAAGCATAAAAAGGAAAA
AAAGGAAACTCAGGCAAAGGGATCCATATGTGCAATGGCAAAGAAATGTGAAAAGGCATTGGGAGAAGCA
GTCTGGGGGAGGCCAGCCCAGTGCGGGCACAGCACAACACGGGGAGCAGCAAGAGATGAGCCAGGGTCCA
GGAGACAGATGCCCATCGCGAGTACAGACTTTGTCCTATTGGCAACAAGGAGTCCATGGAGCTTTAGAGA
GATGCACTCAGCTTCGTGTTGGCCAAGACTCCTTCTGGGCCAATGGGGCTGCCTCTTTTCCTTTCATCAG
ACACTGTGAAAACATTCCCTTAAGCGTGCACTTTTTAATATCACATCTATTTGTCTGTCTGCTCATTGTT
TTGTTGCTGGAACTAAATATGCAATGGATCATGAGACTCAGATTCTATGAGAAACCCAGGGTCTCTGCTT
TACCACGGAGCAGGGTCACCAACCCAGATCTCCAGGCCCATGAGGATGGAACATGAAAGGAGCCGACAAA
AGTTGCTTCCATTGGCATGGGCTCTGGAGCTGTCCAGAAGTCCAGGGACACCAGACTTGATCAAGGAAGG
GCTGTCACTTTAGAGGTTCAAAAGGAAGTGCCTCAAAGCAAAGGCAAGCAAAGGAACCCCACGATGAACT
TGCTCTTTTCCTTTGATGAGCCTCTCCCCAGGTGTATTTCAGCAGACCCCGGGGACCCACCCCACTGGG
CCTGCTGGCCTCCCTCGGCTCCAGCCCAATGCCCCAGCTGGCCTTCCCCAGCCTGCAAGGAGCCTGTAGC
ATGGCAAATCTGCCTGCTGTATGCTATTTTCTTAGATCTTGGTACATCCAGACAGGATGAGGGTGGAGGG
AGAGCTATTTAACACAAATCCTAAGATTTTTTTCTGCTCAGGAAGGGGTGAAATAGCTGGCAGATACAAA
AGACAGTGGCTTTTATCATTTTAAATGGTAGGAATTTAAGGTGTGACTTCAGGGAGAAACAAACTTGCAA
AAAAAAAAAATCTCAGGCCATGTTGGGGTAACCCAGCAAGGGCCAGTGATGATTTCCCCAGCTCATCCC
CTTATTTTCCCACAACCCAACCATTCTCTAAAGCAGGACAGTGAATAGGTCTTAGGCCAGTGCACACAGG
AAGAAATTGAGGCTTATGGATGGGATGACTTCCCTAAGATCCCATGGGACAAGGATGTGGCAAGGCTTG
GATGAGATGGGGCACCAGTGCCCAGGAATTTGAACATTTTCCTTTACCCAGGAAATCTCCGGAGCCAACA
CCACCACCCCAGGGGGTCTCCCCACCCCACCCCATTTACAGGGTGAGCTCAGCCTGTCATGAGCAGAGG
AAAATATTATTAATGCTCTCTGAGTCTTTACAACAGGAGCTCTTACCTCATAGATGTGGGCTCTGTTTGG
GGAAGATGCAAGGAAGTAATGAGAAGCCCAGGAAATTTCTCCACCTGTGTTTATGGCCTAAATAGCTTCA
GGATGTATCTTAGCTGCACTCCAACATTGCATCCTTTCTGGGGTGAAGAATCTGGGCCAACCAGGGGTCC
TTGGGCCTCTAGAAGGCCACAGTAGGCCTCTCTTTGTGGGAATGGAAGGGGACAGTTTGCTTTTAGTGCT
GGCCCTCTCTGTGGGTGTGGCCTGCAAAGGAACCAACAGACCCTATGCTGGGGACTCTAACATGTGAGCT
CATTAAATTCTTCCAGCATTCTAAAGGAGGGTTTGTGATTGTCACCATTTACTGATGAGGAAACTAAGGC
TCCTAGGGGAGAAATCACTTGCCCACAGTTCCACAGCTAGTGAGTGAATGAACCAGGATTTAAACCGGTT
TTTTCTCACTACAGAGACAATATTTTTCCACCATTGTATCTCACATTTTTCCCAGGAGGTTACCCATAAC
AGAAGAGACTAGAGTGGAACAGATACGTCAGTGGATAAAGCTCAAAGCAAACAACAGTAAGCTTAAAATT
CCTTCATAGTCTCATGTTTTACGTTCACAATTCATGCAAAATTTGCATTCCACTTTCTGATTTAGCCTTG
TTGGTTTTAATATGACTCTATGAATATTTCAAAAAAAAATGTGCTCTGTTCCTCATGTTGTTCTGTTCTG
TTCACCCCGCTATGACGGACCCTAGGTCAGCTGGTCTTCAGCTTGACCCTAGAATTGACTCTAGGAGCAG
TGACCCTGCTGCCTCCCAGAGCCAGTTATAGGCTCAAGATCAAGACCAACTGACCTTCTCCTAGGCAGCT
CCTTTGGTGTGTGGGTGCTCTGACCTCACTGTTCATGAGGGGACCTCAACTAAGGCATCTTCCAGTTGGG
TGCTGGAAGGAACCCATTAACTCACACTAGAATGATGAGGATTTGCTCATCTGGTGGAGAAGGATGAG
CCCACAAAACCCTAAAGGGAAAAGAGAAGCTGGACACAGCTGTACTCAGCAGATTCCTGAATGCTAGGCT
GGAAAGTGGTGCCTGTTGTCCAAGTGGAGTCACATGGTTGCTAATGTGGGCAAGTCTGAGGACACACTTC
ATGAGCAGCTGGGGTCTGGAAGGCTCCTCACTTTACCCTAGCCACACATAATTACTGGGTGCCTACAGCA
CCTAGCACCTTGGAGGGGCACTATTAGGAAATCGAGATTACTATGGCACAATTAATTCCTGGGTAAGGC
ATGGGGTTGTGGTGGACAGAGCTCAGTCTTTAGTTTGAACGAAAACATACATACATGAAAAACATACATG
AAAAAAGGACCCTCATCAACATTAGAAGGGGTAGATTTGGAGCACTTTAGGCAGGAAAACAGGAACGCAA
GGCCAGGAAACTGGAACCCAGTGAATACTCAGAACCGAGGATGCAGATGACTTATTTAGCAAAATGGTCA
CTTCTGTGACATAGCTGGAGAAAGGATGGGTAACAGCTTGCCAGAGCCACTTGGAACAAGGGCAAATCTC
AGTGTCTGGGCAAAAGATGATGCATTTCCCTCTGACCCATCATGTTTATTCATCCTCCACTCCCCATTG
```

FIGURE 234 cont'd
CCACACTAGCTCTTGCTGTAAGTCCTCACCAGGATCTACATTTCCTCGTCGCTGGTGGGAACCCCTTAGA
GTACATAGAGGTATCAGTCCAGTAAGACTGCTCTACACAACAGAAGTGAGGCCCAGGGAGTAGCAGCCAG
GCCCTTATCCTGTTACCTCTGCAGGAGTGACTGCCCAACCCAGATCCAGAGACATTGAAGGAAATGATAA
TTCCTTGGTACCTCACTGCCTTGGGACAAAATGAAGAAAGCCACCCTTCCTTAGGCTGCAGCTTGCCACT
CCTGGGCTGGGTAAACAGGTCATCAGCACCAGGCTCAACCAGGAGTAACATTCTGGAAGACATGGGTGAG
CCCAAGAGGAAGCATGAACAGGACGCTGTTCCTAAGTCATGTCAACAGGTTGTGCTGGGCCAGGATCCCC
AGGGAAAAAAATGGTCAACCCAACTGGAGGGTAGGTTAGAAGAAAAAAAACATAAACGTGGATAGTCATG
TCATCTCAAATCCCTGACTTGGCTTCCCCATTACTTGACAGTCTGAGCTCCTTCTTAGCCTGTGACCAGC
TTCAAATCACAGCCAAGTAAAACAAGGAAATAGGAAAAGTAAATCCAACTAGAAGAGACAAGCTGAGATT
CAGATTTGTTTACTCCTCCCATGCAAAGTTTCCCTGTTGGAGGTTTTCCATGTATACATGTCTAGAAGTG
ATAGAATGCAAGGCCTTGGCTTTGTCTTGCAGGGATCTGCCTTTGAGGTCATAGACTGAACAGCAGGGAG
AGAGGTTAGTGGTGGAGTGTGGGGGGAGCTGTTCTAGCTCCAGTTTCTTCTGACACATTTTTCAGGATCA
TGGATCTGATCCTCCGAAGCACAGCAGAGATATCTAAGCCATATTTGTGCACATGAGCAGACTCTTCTAG
TTTTTTAGTAACCAGGGATGGGCTTTTGCATGGCACTGACTATAGAGATGTCTTGTAGAGATCAAGCCAG
TCTTTTGCATCCCACCTGCCCACCTCCAGAAGAGATGGGAAAAGGTCATCAAAGGGCATTCACCAACTGA
AATCCACTCATGAATGTTAGGTCTCTAAAAGGAGGCATCAACACTCACAATGGTAGCCTCCAAACCTAGC
ATCCCACCTATCTAAGAGCTCAGGGGTGGTCCACTGGGGCAGATACAAGGGAAGTGCAAGGGCTCAGGAT
GAAAGAAAATCTATTGGGAAGAGTTTTAGGGGCTTGATCATTATGGGCTTCCTTCTATATCTGAGAACT
GCTCTGGGTGGTGAGATGTGGACTCTGATCCTTAATTGGAATGTTCGGAGAATGAGTGTCTGGTGGCCTT
GAAGTGTTGGACAGAAAAGTATCAGTATAAAAGCCTGGAGCTCAGGGTAATTAATGTAGTTCATGGTTCC
TTAGTGAGCAGGACTCTTGGATGTGGAGGAGAAAGGGTCATAGGAAGTAAACCACCAAAATTACAAAATT
GAGTCTCTGTACAATTACTTCAGTGCCTTTGGGCTTATGAATACAAATCAGTGGGCCTTCTCTATGATGG
TCCAACAAACTCTCAGTGTCCACCCTGTCCCTGTATCTCCCATGGAAGATGAATAATGTCAGGTGTTCTT
TGGGTCAAAGGCCCCAGGGCAGTCTGGAGGCTTAGAGGGCAGAGTGGTGTCATTCCATGTAAAGTTAGGC
TTCTGAGGGGTCAGGCAGAATATGGTGTCCATATCTTCCATAGCTCTGCAGATTCTTGGATGAAGTCAAG
CACAGTTTGCTAGACCCAGGTCACTCCTCTGAGTATAACTAGGACCCATGAGTGAAACTTAATAGCTGTA
AGGAAGAACCTGCTGTCTGCCAGAGAGGATAAGCTGCCCATCTCAGCAGCTGTCTAAAAGAAGGCAGGTG
TCTCTTTAAAGGGAAGAGAAGCATTGGTGAAATGGATTTCAGGTCACTTCCATTCCAGATGGGTGAGATC
TTGTGGAGCTGGGATCATGTTTGAACTCATTCATACCTGTAGAGCACGAATCCAAGTAGATTGTGTTTGG
TCTGTACAGGCTGAAGCCCCCTGCTCTCCCACCCAAGTGCCCCCACTGAGCAGGCCAACATGCTGTTGTG
GCCACATATACTGGGCTGATCCAGGCTGGTTATCACCAAACAGCAAACCATAGGGAACAGCTGCTTTGCC
ATAGACCCAATACCCATGTAGATCTCTCATGAGAGCAGCCATAACTCAGACCCACTGACCAACAGGGCCA
TGAGTGACAGCCAGAACCAGTGAAGGTCCAAGTAGGACACAGAGCAGGGCTTTTCTTACCATACACATTA
TCTCCAGAGGTTATTTCTACCCCACTCCCTATTCAAGGCCTGTTGGAGCACACTGCAAAAGCAAAAGCAC
AGTAACTCAATTTACACATGATTATAATCATTTCCAGTGCACACATTTCATCACCAGGTGGATCCTGAGC
TAGCCCATGTAAATCCGGGTTAACCCATATTGGTAATCATACTCAAAAGCACTTTTCACCCTACATTCTA
CTAGCCAATCAAAGACAAAGAGTTGTGGCCTCTACCATTGCCTTGGCTTCTGGACACCCTCACAAGCTAT
CCCAAGGTTCCCGCTCAACTCCAGGGAGGCTGACATCTTCACATCCACTGGGCATATAATATTGCATGAG
ACCAAAGTCTCCACACTCTTTGCAGCCTCCTCCATGAATCCCAATGGCCTGCACTTGTACAGTTTGGGTG
TTTGATAGATAAAGCACGTATGAGAAGAGAAAACAAAATAAATCAACTTTTTAAAAAAGCCAGCACTGTG
CTGTCAATGTTTTTTTTTTCTTTTCAATTCTAGCTCAGAAAAGCAGAAGGTAAATAATGTCAGGTCAATG
AATATCAGATATATTTTTGACTGTACATTACAGTGAAGTGTAATCTTTTTACACCTGCAAGTCCATCTT
ATTTATTCTTGTAAATGTTCCCTGACAATGTTTGTAATATGGCTGTGTTAAAAAATCTATACAATAAAGC
TGTGACCCTG

FIGURE 235
SEQ ID NO: 227
Genbank ID        : AW665865
Unigene ID(#167)  : Hs.193143
Unigene name      :        KIAA1069 protein   KIAA1069
>gi|7458414|gb|AW665865.1|AW665865   hi94h02.x1   Soares_NFL_T_GBC_S1   Homo sapiens
cDNA clone IMAGE:2979987 3', mRNA sequence
TTTGTTTAAAAATGTGTTTTAATTATATTTTCATGAATTCCAGGAAGAACATCATTGCAGTTAATGTTAC
AAAAAAAAAAAAACAAAGAGGGACATCTGAACATGCAATAAAAAAGTGAATTCACAGTGAAAATAATGCA
TGTCAGTACTAAAATAGAGTTGCTTGGTTCCCTGAAGGAAAAGGGTTTCTTCTAATTATCTGTTCACTTG
GATTTTATTATGAGAAAATATTCTGTGAAAGCTTTGGGGAAGTTTTCAATTTGTGCTACTATTATCATTA
GAGTCTGATGGAAGTCCCTCATTCTGAAAGCCGTTGTTCGCAGTCTGTAATTCAATCAGAAAATTCAAAA
GTACAACAGGTAGTTTGGCAACTCGCTTCTTGTTACATACAAAGCCATTAGCAAAAATATGTAACAAAAT
TTATGTAAAACAAACAATTTTGTCCTTATGTACAAAAGACAGCCTTCTTCCTCACACCCTCACGGCCTAT FIGURE 235 cont'd

TCCAAAAAGTGGGAAGG

FIGURE 236
SEQ ID NO: 228
Genbank ID        : NM_018407.1
Unigene ID(#167)  : Hs.296398
Unigene name      :       lysosomal associated protein transmembrane 4 beta
      LAPTM4B
>gi|8923827|ref|NM_018407.1| Homo sapiens lysosomal associated protein transmem
brane 4 beta (LAPTM4B), mRNA
ACACGGACCAAGGAGTCTAACACGTGCGCGAGTCGGGGGCTCGCACGAAAGCCGCCGTGGCGCAATGAAG
GTGAAGGCCGGCGCGCTCGCCGGCCGAGGTGGGATCCCGAGGCCTCTCCAGTCCGCCGAGGGCGCACCAC
CGGCCCGTCTCGCCCGCCGCGCCGGGGAGGTGGAGCACGAGCGCACGTGTTAGGACCCGAAAGATGGTGA
ACTATGCCTGGGCAGGGCGAAGCCAGAGGAAACTCTGGTGGAGGTCCGTAGCGGTCCTGACGTGCAAATC
GGTCGTCCGACCTGGGTATAGGGGCGGGCTCCAGGCGAGGCGGTCGACGCTCCTGAAAACTTGCGCGCGC
GCTCGCGCCACTGCGCCCGGAGCGATGAAGATGGTCGCGCCCTGGACGCGGTTCTACTCCAACAGCTGCT
GCTTGTGCTGCCATGTCCGCACCGGCACCATCCTGCTCGGCGTCTGGTATCTGATCATCAATGCTGTGGT
ACTGTTGATTTTATTGAGTGCCCTGGCTGATCCGGATCAGTATAACTTTTCAAGTTCTGAACTGGGAGGT
GACTTTGAGTTCATGGATGATGCCAACATGTGCATTGCCATTGCGATTTCTCTTCTCATGATCCTGATAT
GTGCTATGGCTACTTACGGAGCGTACAAGCAACGCGCAGCCTGGATCATCCCATTCTTCTGTTACCAGAT
CTTTGACTTTGCCCTGAACATGTTGGTTGCAATCACTGTGCTTATTTATCCAAACTCCATTCAGGAATAC
ATACGGCAACTGCCTCCTAATTTTCCCTACAGAGATGATGTCATGTCAGTGAATCCTACCTGTTTGGTCC
TTATTATTCTTCTGTTTATTAGCATTATCTTGACTTTTAAGGGTTACTTGATTAGCTGTGTTTGGAACTG
CTACCGATACATCAATGGTAGGAACTCCTCTGATGTCCTGGTTTATGTTACCAGCAATGACACTACGGTG
CTGCTACCCCGTATGATGATGCCACTGTGAATGGTGCTGCCAAGGAGCCACCGCCACCTTACGTGTCTG
CCTAAGCCTTCAAGTGGGCGGAGCTGAGGGCAGCAGCTTGACTTTGCAGACATCTGAGCAATAGTTCTGT
TATTTCACTTTTGCCATGAGCCTCTCTGAGCTTGTTTGTTGCTGAAATGCTACTTTTTAAAATTTAGATG
TTAGATTGAAAACTGTAGTTTTCAACATATGCTTTGCTAGAACACTGTGATAGATTAACTGTAGAATTCT
TCCTGTACGATTGGGGATATAATGGGCTTCACTAACCTTCCCTAGGCATTGAAACTTCCCCCAAATCTGA
TGGACCTAGAAGTCTGCTTTTGTACCTGCTGGGCCCAAAGTTGGGCATTTTTCTCTCTGTTCCCTCTCT
TTTGAAAATGTAAAATAAAACCAAAAATAGACAACTTTTTCTTCAGCCATTCCAGCATAGAGAACAAAAC
CTTATGGAAACAGGAATGTCAATTGTGTAATCATTGTTCTAATTAGGTAAATAGAAGTCCTTATGTATGT
GTTACAAGAATTTCCCCCACAACATCCTTTATGACTGAAGTTCAATGACAGTTTGTGTTTGGGTGGTAAA
GGATTTCTCCATGGCCTGAATTAAGACCATTAGAAAGCACCAGGCCGTGGGAGCAGTGACCATCTGCTG
ACTGTTCTTGTGGATCTTGTGTCCAGGGACATGGGGTGACATGCCTCGTATGTGTTAGAGGGTGGAATGG
ATGTGTTTGGCGCTGCATGGGATCTGGTGCCCCTCTTCTCCTGGATTCACATCCCCACCCAGGGCCCGCT
TTTACTAAGTGTTCTGCCCTAGATTGGTTCAAGGAGGTCATCCAACTGACTTTATCAAGTGGAATTGGGA
TATATTTGATATACTTCTGCCTAACAACATGGAAAAGGGTTTTCTTTTCCCTGCAAGCTACATCCTACTG
CTTTGAACTTCCAAGTATGTCTTAGCTCACCTTTTAAAATGTAAACATTTTCAGAAAAATGAGGATTGCCTT
CCTTGTATGCGCTTTTTACCTTGACTACCTGAATTGCAAGGGATTTTTATATATTCATATGTTACAAAGT
CAGCAACTCTCCTGTTGGTTCATTATTGAATGTGCTGTAAATTAAGTTGTTTGCAATTAAAACAAGGTTT
GCCCACAAAAAAAAAA

FIGURE 237
SEQ ID NO: 229
Genbank ID        : NM_014398.1
Unigene ID(#167)  : Hs.10887
Unigene name      :       lysosomal-associated membrane protein 3    LAMP3
>gi|7657660|ref|NM_014398.1| Homo sapiens lysosomal-associated membrane protein
   3 (LAMP3), mRNA
GGCACCGATTCGGGGCCTGCCCGGACTTCGCCGCACGCTGCAGAACCTCGCCCAGCGCCCACCATGCCCC
GGCAGCTCAGCGCGGCGGCCGCGCTCTTCGCGTCCCTGGCCGTAATTTTGCACGATGGCAGTCAAATGAG
AGCAAAAGCATTTCCAGAAACCAGAGATTATTCTCAACCTACTGCAGCAGCAACAGTACAGGACATAAAA
AAACCTGTCCAGCAACCAGCTAAGCAAGCACCTCACCAAACTTTAGCAGCAAGATTCATGGATGGTCATA
TCACCTTTCAAACAGCGGCCACAGTAAAAATTCCAACAACTACCCCAGCAACTACAAAAAACACTGCAAC
CACCAGCCCAATTACCTACACCCTGGTCACAACCCAGGCCACACCCAACAACTCACACACAGCTCCTCCA

FIGURE 237 cont'd

```
GTTACTGAAGTTACAGTCGGCCCTAGCTTAGCCCCTTATTCACTGCCACCCACCATCACCCCACCAGCTC
ATACAGCTGGAACCAGTTCATCAACCGTCAGCCACACAACTGGGAACACCACTCAACCCAGTAACCAGAC
CACCCTTCCAGCAACTTTATCGATAGCACTGCACAAAAGCACAACCGGTCAGAAGCCTGATCAACCCACC
CATGCCCCAGGAACAACGGCAGCTGCCCACAATACCACCCGCACAGCTGCACCTGCCTCCACGGTTCCTG
GGCCCACCCTTGCACCTCAGCCATCGTCAGTCAAGACTGGAATTTATCAGGTTCTAAACGGAAGCAGACT
CTGTATAAAAGCAGAGATGGGGATACAGCTGATTGTTCAAGACAAGGAGTCGGTTTTTCACCTCGGAGA
TACTTCAACATCGACCCCAACGCAACGCAAGCCTCTGGGAACTGTGGCACCCGAAAATCCAACCTTCTGT
TGAATTTTCAGGGCGGATTTGTGAATCTCACATTTACCAAGGATGAAGAATCATATTATATCAGTGAAGT
GGGAGCCTATTTGACCGTCTCAGATCCAGAGACAGTTTACCAAGGAATCAAACATGCGGTGGTGATGTTC
CAGACAGCAGTCGGGCATTCCTTCAAGTGCGTGAGTGAACAGAGCCTCCAGTTGTCAGCCCACCTGCAGG
TGAAAACAACCGATGTCCAACTTCAAGCCTTTGATTTTGAAGATGACCACTTTGGAAATGTGGATGAGTG
CTCGTCTGACTACACAATTGTGCTTCCTGTGATTGGGGCCATCGTGGTTGGTCTCTGCCTTATGGGTATG
GGTGTCTATAAAATCCGCCTAAGGTGTCAATCATCTGGATACCAGAGAATCTAATTGTTGCCCGGGGGGA
ATGAAAATAATGGAATTTAGAGAACTCTTTCATCCCTTCCAGGATGGATGTTGGGAAATTCCCTCAGAGT
GTGGGTCCTTCAAACAATGTAAACCACCATCTTCTATTCAAATGAAGTGAGTCATGTGTGATTTAAGTTC
AGGCAGCACATCAATTTCTAAATACTTTTTGTTTATTTTATGAAAGATATAGTGAGCTGTTTATTTTCTA
GTTTCCTTTAGAATATTTTAGCCACTCAAAGTCAACATTTGAGATATGTTGAATTAACATAATATATGTA
AAGTAGAATAAGCCTTCAAATTATAAACCAAGGGTCAATTGTAACTAATACTACTGTGTGTGCATTGAAG
ATTTTATTTTACCCTTGATCTTAACAAAGCCTTTGCTTTGTTATCAAATGGACTTTCAGTGCTTTTACTA
TCTGTGTTTTATGGTTTCATGTAACATACATATTCCTGGTGTAGCACTTAACTCCTTTTCCACTTTAAAT
TTGTTTTTGTTTTTTGAGACGGAGTTTCACTCTTGTCACCCAGGCTGGAGTACAGTGGCACGATCTCGGC
TTATGGCAACCTCCGCCTCCCGGGTTCAAGTGATTCTCCTGCTTCAGCTTCCCGAGTAGCTGGGATTACA
GGCACACACTACCACGCCTGGCTAATTTTTGTATTTTTATTATAGACGGGTTTCACCATGTTGGCCAGAC
TGGTCTTGAACTCTTGACCTCAGGTGATCCACCCACCTCAGCCTCCCAAAGTGCTGGGATTACAGGCATG
AGCCATTGCGCCCGGCCTTAAATGTTTTTTTAATCATCAAAAAGAACAACATATCTCAGGTTGTCTAAG
TGTTTTTATGTAAAACCAACAAAAAGAACAAATCAGCTTATATTTTTATCTTGATGACTCCTGCTCCAG
AATTGCTAGACTAAGAATTAGGTGGCTACAGATGGTAGAACTAAACAATAAGCAAGAGACAATAATAATG
GCCCTTAATTATTAACAAAGTGCCAGAGTCTAGGCTAAGCACTTTATCTATATCTCATTTCATTCTCACA
ACTTATAAGTGAATGAGTAAACTGAGACTTAAGGGAACTGAATCACTTAAATGTCACCTGGCTAACTGAT
GGCAGAGCCAGAGCTTGAATTCATGTTGGTCTGACATCAAGGTCTTTGGTCTTCTCCCTACACCAAGTTA
CCTACAAGAACAATGACACCACACTCTGCCTGAAGGCTCACACCTCATACCAGCATACGCTCACCTTACA
GGGAAATGGGTTTATCCAGGATCATGAGACATTAGGGTAGATGAAAGGAGAGCTTTGCAGATAACAAAAT
AGCCTATCCTTAATAAATCCTCCACTCTCTGGAAGGAGACTGAGGGGCTTTGTAAAACATTAGTCAGTTG
CTCATTTTTATGGGATTGCTTAGCTGGGCTGTAAAGATGAAGGCATCAAATAAACTCAAAGTATTTTAA
ATTTTTTTGATAATAGAGAAACTTCGCTAACCAACTGTTCTTTCTTGAGTGTATAGCCCCATCTTGTGGT
AACTTGCTGCTTCTGCACTTCATATCCATATTTCCTATTGTTCACTTTATTCTGTAGAGCAGCCTGCCAA
GAATTTTATTTCTGCTGTTTTTTTGCTGCTAAAGAAAGGAACTAAGTCAGGATGTTAACAGAAAAGTCC
ACATAACCCTAGAATTCTTAGTCAAGGAATAATTCAAGTCAGCCTAGAGACCATGTTGACTTTCCTCATG
TGTTTCCTTATGACTCAGTAAGTTGGCAAGGTCCTGACTTTAGTCTTAATAAAACATTGAATTGTAGTAA
AGGTTTTTGCAATAAAAACTTACTTTGG
```

FIGURE 238
SEQ ID NO: 230
Genbank ID        : AA456099
Unigene ID(#167)  : Hs.176376
Unigene name      :       Transcribed sequences
>gi|2178875|gb|AA456099.1|AA456099 aa17e01.s1 Soares_NhHMPu_S1 Homo sapiens cDN
A clone IMAGE:813528 3', mRNA sequence
```
AAAAAATAAAAATCATTTATTTAAACAAAAATATACACACAGTGTACAATGAATATGGTTTACACAGAAC
AATAAAACAAAAATGATATCTCTTAAATGCCAACATAAAATGATCTATTTATGCCTAGAAAAAATTTCTA
GGAATACACATTATTGATTCATCTAAAATACATATATAACATAAAAAGAAAACAAATGCCAACCTTTCAG
ATGAGTACCACAAAAACCTAAAAGTTAAATGTTAGATTAAATAAAATTATAAAATATCCACACGAGAAGT
ATGTGTATACAAAGTATTGTATGTATGCAGTGAAATGAGAGTGCCCATACAGTTATATGCAAACTTTTGA
AAGTTTCATAGTTGTTTAACAAAATATTTTTAATGTTGATAGTGACATAAAAACATCACAAGAATTATCT
AGATAATATAGCAATATTGCCAAAATTTGAGTCAATGTTAC
```

FIGURE 239
SEQ ID NO: 231
```
Genbank ID      : NM_004522.1
Unigene ID(#167) : Hs.6641
Unigene name    :       kinesin family member 5C       KIF5C
>gi|4758649|ref|NM_004522.1| Homo sapiens kinesin family member 5C (KIF5C),
mRN
A
GATGGCTGAGCGCGCAGGAGCCCGGGAGGTCTGAGCCGGGCGAGGCTCGCTCCCTGCGCATCGCCTCCTC
CGCCCGCCGCGTGGTCGCGGGCAGGTGGGCCGGGGGGCGCTGGGCAGGGGCGGGGCAGGGCCAGGGCAGG
CCGGTCTGCAGCCGGAGGGGCCGGAGCGGAGAAGCTGCCCACCTTCCCGGGCTCGGAGCGGCCGGGGCTG
CTCAGCCGGCCGGGCTCGCGATGACCTGCTGAGAAGCGTCGTCGGAGGCTGCAGGAGGCGGCCTAGCTGT
GGGCGGTGCAGCTCGCGGCCTCCTCCCTCGTCGTTCCCGGCCCGGCCCCCCACCCATCCCCGTGCCCCC
TCCCTACCGCCGGCCGAGATGGCGGATCCAGCCGAATGCAGCATCAAAGTGATGTGCCGGTTCCGGCCCC
TCAACGAAGCGGAGATCCTCCGCGGGACAAATTCATCCCCAAATTTAAAGGCGATGAGACCGTGGTGAT
CGGGCAAGGGAAGCCATATGTCTTCGACAGAGTGCTACCTCCCAACACGACCCAAGAGCAGGTTTACAAT
GCATGTGCGAAGCAAATTGTCAAAGATGTCCTTGAAGGTTATAACGGGACGATTTTTGCGTATGGGCAGA
CTTCATCAGGAAAAACCCACACCATGGAGGGGAAGCTGCATGACCCCCAGCTCATGGGATCATCCCACG
AATTGCCCATGATATCTTTGACCATATCTACTCCATGGATGAGAACCTGGAGTTTCACATAAAGGTTTCC
TATTTTGAGATCTACTTGGACAAAATAAGGGACTTACTTGATGTATCCAAGACCAACTTGGCTGTTCATG
AAGATAAAAACAGAGTCCCGTATGTAAAGGGGTGCACTGAGCGGTTTGTGTCGAGCCCTGAGGAAGTCAT
GGATGTAATAGATGAAGGCAAAGCAAACCGACACGTGGCTGTGACAAACATGAATGAACACAGCTCTAGA
AGTCACAGTATCTTCCTGATAAATATTAAACAAGAGAATGTAGAGACTGAAAAAAAACTCAGTGGGAAAC
TTTATTTGGTTGATTTGGCTGGGAGCGAAAAGGTCAGCAAAACTGGTGCCGAGGGAGCTGTTCTTGACGA
AGCTAAAAATATCAATAAGTCTTTGTCTGCTCTTGGAAATGTGATCTCTGCTTTGGCAGAAGGGACAAAA
ACACATGTGCCATACCGGGACAGCAAGATGACTCGGATTCTTCAGGACTCTTTGGGTGGGAACTGCAGAA
CCACCATCGTCATTTGCTGTTCTCCTTCTGTCTTCAATGAGGCTGAGACCAAGTCCACACTGATGTTCGG
ACAGAGAGCTAAGACCATCAAGAATACAGTCTCTGTGAACCTAGAACTGACAGCAGAAGAATGGAAGAAG
AAATATGAAAAAGAGAAAGAGAAAAACAAGACTTTGAAGAATGTTATCCAGCATCTGGAGATGGAGCTAA
ACAGGTGGAGGAATGGAGAAGCTGTGCCTGAGGATGAACAGATCAGTGCCAAGGACCAGAAGAACCTGGA
GCCTTGTGATAACACCCCCATCATAGACAATATTGCTCCTGTTGTTGCTGGCATCTCTACAGAGGAGAAA
GAGAAGTACGATGAGGAGATCTCCAGTCTCTACAGACAACTGGATGACAAGGATGATGAAATTAACCAGC
AGAGCCAGCTGGCTGAAAAGCTGAAGCAACAGATGTTGGATCAGGATGAGCTTTTAGCTTCCACAAGAAG
AGACTATGAGAAGATACAGGAGGAGCTGACACGTCTCCAGATTGAAAATGAGGCAGCCAAGGATGAGGTG
AAAGAAGTTCTCCAGGCCCTGGAGGAGCTGGCTGTCAATTATGACCAGAAATCACAGGAAGTGGAGGATA
AGACCCGGGCCAATGAGCAGCTGACAGACGAGCTGGCCCAGAAAACGACTACATTGACAACCACACAGAG
AGAGCTGAGCCAGCTACAAGAGCTTAGCAACCACCAGAAGAAAAGGGCAACTGAGATCCTGAATTTGCTG
TTGAAAGATCTGGGGGAGATAGGTGGAATTATTGGCACCAATGATGTGAAAACTTTGGCAGATGTGAATG
GAGTCATTGAGGAGGAGTTTACCATGGCCCGCCTGTACATCAGCAAGATGAAGTCAGAGGTCAAGTCCCT
GGTGAACCGCAGCAAACAGCTCGAGAGCGCCCAGATGGACTCCAACAGGAAGATGAATGCCAGCGAGCGG
GAGCTGGCAGCCTGCCAGCTGCTCATCTCCCAGCACGAAGCCAAGATCAAGTCTCTGACAGACTACATGC
AGAACATGGAACAGAAGAGGAGGCAGCTAGAAGAGTCCCAGGACTCGCTCAGCGAAGAGCTGGCAAAGCT
CCGAGCCCAGGAAAAAATGCACGAAGTCAGCTTCCAGGATAAGGAGAAGGAACATCTGACGCGGTTGCAG
GATGCTGAAGAAATGAAGAAGGCGCTGGAGCAGCAGATGGAGAGCCACCGGGAAGCTCACCAGAAGCAGC
TGTCCAGACTCCGAGACGAAATTGAGGAGAAGCAGAAAATCATTGATGAGATTCGGGATTTGAATCAGAA
ACTGCAACTGGAACAGGAGAAGCTTAGTTCTGATTATAACAAGCTGAAAATAGAGGACCAAGAGAGAGAA
ATGAAGCTGGAAAAGCTCTTATTGCTCAACGATAAAAGGGAACAAGCCAGAGAAGACCTCAAAGGGCTGG
AGGAGACAGTGTCTAGAGAATTGCAGACACTGCACAACCTTCGGAAACTCTTTGTCCAGGATCTGACCAC
CCGAGTTAAAAAAGTGTGGAGTTGGACAACGATGATGGAGGGGCAGTGCTGCCCAGAAGCAGAAAATT
TCCTTCTTGGAGAATAACCTGGAGCAGCTCACCAAAGTTCACAAGCAGCTGGTCCGGGACAACGCAGACC
TGCGCTGTGAACTGCCCAAGCTGGAGAAGCGGCTGCGTGCCACGGCGGAGCGCGTCAAGGCTCTGGAGAG
CGCGCTGAAGGAGGCCAAGGAGAACGCCATGCGGGACCGTAAGCGCTACCAGCAGGAGGTGGATCGTATC
AAGGAGGCCGTGCGGGCCAAGAACATGGCCAGAAGGGCCCATTCAGCCCAGATCGCCAAGCCCATCCGCC
CCGGACACTACCCGGCCTCATCTCCAACGGCCGTCCATGCCATTCGAGGGGAGGAGGCAGCTCTTCAAA
TTCCACTCACTACCAGAAATAAATACAAAATATGACTCCACGTAGCATGTCAAGGACTACATTAATCACC
AATTCCTTTATTTTTCCCCCCTACAGTTTCCATTTTTTTTTATACTTGCTTACTCCAGCCATCTGCAG
TACACCAGTTTCAGGTCTTTTGAGCTGTGTAGAGTTTCTGTGTGTACAGATGTGTGCTCGGACTTTTCTC
TTTTTGAGAAATCTGAAGGAGATGGTTGCAGAAGATCCACTTACTACTGAGAACCATTACCACCGACTCG
GCCTCCGGGGTGTTGGGTGGTTTCTGGGTGGTTCCTGGAGCCTCCTCTGGGCAGTGCACTGTCCCATCTG
TACGCCCTAATGTGCCATTCCCTAGAGGGGAACAACCAAGTGCCGTGGAGGCAGATGATCATGGTCTGCC
TCAACTGTCTGGTTTCCTGTAAAATAAACACATTGTTTTATATTTTTAGGGAACAAAAAGTGCTGCTATA
```

FIGURE 239 cont'd

```
GGGTTCAAAGTTTTCCTTCTGAACACTTTTCCGAAACAAATTACCCCAAAGACACATTTTGAATATCCTG
GTCACATCTTTGGATCTGTAAAATATACCTTTTAGTATGGCACCTGTTAAAATGCAAAGCAAATTTCTTT
GGGGCAGAAAAACAATCTGACAGTAGCAGTGTAGAATTTGTTCATTCAAATACATCTGTGTAAATGCAAA
AAGTCATAAAATTCACCTCCGAGCTGCTTGCTTTTGAACCTGCAGCAACTAGTCTTAGCCGGCCCGGTTT
GAACATCGTTCTTTCAGAAGTGCTGAAAATGCTGCAAAGTTGGATAAGTGGAAATGTGGCTGCCCCTCTC
CTCACTACTTCCTCTCTGATCGTTCTGAAGCTTGCATTGGGAATGGCTGCTTTCTCTAACCATTTTCAGC
TTGAGTGGGTATTGCTGAAGAAATCCAACATCATTCCAGCAGTTGAAAAAGGAAGCCTTCGGGAGAAAGT
GCTTGTCAAAATTTTGTTCTTTGTGCTTGTGTATGAGTAAGTTGCCATGAATAAGTTATTATTTTAACCC
ATAATTGGCGACTGTTTATATGAATTCTTTCTTTGGCACCAAATAGGTTTCATCTTCTTAGGCACAATTA
GAAAAAATCCACATAGATGGATATTTTACATTTAGTTATTGCTTTATCCAAATACATGAATCTAAAGCTG
AATCAACCCTTACTTCCAGTTGTGCTTATTAAGAAGATCAATTTCCAAGTAGTAAAGTTTTCAGGGAAAC
TGACTGTGCTGCTATTTGTTTTGACAAATTTGGGGGTAAGTCAATGACAACCAAACCAATCTCGGTGGAA
ACTCCTATCCTATCATGTTGTGTGCCCAAGATGAGTGAGCTGGCACTGTGCCCTGAAGCTTTCACCACTG
TAATGAAATATATGCCAGGGGAGACTTTGGGCTTTTCTCATGACTGTGTGGGTCGAAGGTAGCTCAAGTG
TGTGTGTGTGTGTGTGTGTGTGTGTGTGTGTGTATGTGTGTAAAGTGCTAAGAACTGTGCATTG
ACATCCAAACATTTCTTGTACAAAATTTCCCTAGCAAAGCAAACCTGCTTTGACTTAATTTATTTGTTAA
ATGTTGCACTTTGTTTATGTATGTTTGTTTTGGTGGGAATAAGGAGAGAGAGGACGACAAATTCTAT
TGAAGTATTTATTTTGTGAAGATGGCAATTTTGCATTTGTTTAAATTTTTTTCATTCTTTAATTTTGTTA
TCAGTGCCAGCCCAATATACCTGCTCTACCATTATTTGCGGTCTGATAAAAGGGTCCTTGTGGGCAGGT
TTTGCAAAGCTTATCAGGTAATAACATATGCCACATAACCTTGTTGATATGTTTGCTTCTGATTTGGGAA
GCTAAACATTGGTGTTTGAGAGGATTGCCAATTATTAATTGTCATTACCACTACTCTCCATTACTTTTTG
TTTGGAAATTGAACAAAGGTCAGTAATGGTTTTTGGCTCTTGTTAATATCCATCATAAAATAGATTGTTT
TAGATTCTTTCCAGGGTGATTTTTCCCTGGGTACCCCGTTTCTACTTCTAAAGAATTGCTTGGCACTTTC
ATGTTTCAAAGGGAAACATTCGCTTGTAGTTCCATTTTACTTGATCTCTACAAGGGACTGACAACATTTG
CTTTATTTTTATTCACAGAGAAAGTTGGCTTTGATGTCTCTTAAAGATAATTCTGCTAGTTGCTGATCAG
CCAGTCAGTTCACCTAGCTTCAATCTTTATAGGACTTCTAATCTAATTTTCCTATAGTGTGACTAAAAGG
GAGGCAAATTATTGGAACGGATTATTCAAATGGATCCTTAAATATTGCTATGTATAATAAGCCAGTTATT
ATATCAGGACCATGTTCTCTGTAGGCCACTTTCTAAAAAAGCCACATATGTGCAATTTTCAGGTTTTTAG
ACTATTGCTCCCTGTACTTTAAATGTAAAAACCACACTTCTGAACAACTAAGCTCATGAATATGATTTTG
GTTATATGCAGCTTTTGACTAGCATGTATTGTGTCTTTTTCTCCTCTATGAATAATTTTATATTTCATGC
TACTTCTTGAAAGTTTACTCTTTGATGCTCTAAGAGAACAGCCAGATGGTTTATATGAATAATCTTTATC
TGCAGGATGGTGGATTGGTAAATTAGGAGAATGTTGTTTGAGATATCAAGATTTATGTCTGGGAACTAAA
ATATATAATGCCAAATGTGTTTTTGTCAATTACTAGAGAATTCTGTGCAAACATATCATCTCTTCAAATG
CTGCACACTTTGCTTTTGTTAAACAGCAGGTAGTAGACAGAACAATAACAGTTTCGCGTTAAGACTTTTA
AAGGAAATAGAATCGTGATTAGAAATCAGAATTTATAGATATATTGGGATAAATGAAGAAATAAAAATG
TTTGTCTAGAATGTAGCATCTAGTGACTTTTTAAAGCCCTAACGTTTACATAAAGAAGCTCTAGTTCTTA
TAGAAATAACAAAGCAAATAAAAGTTCTTAACAATCCCCTCTTTCGAAGTGCATTTTTTTAAAGCAGGGC
AGGAGACATTTGGACTCTAGCTATATGACATACTGGGAAAGGCAGAGGGTGGAGGGAAGATTTCACTTCA
TTGTCTAGCCCAGAATCTTGAGCAAGCTAAAGAAACCATCATAATCTAAAATTGCTTCATTTAACACTAA
CAATTTAGACTTTTTAAACCAAGCATTGAATAATGGCTGGATAACTGCCGAAGTAAGCGCCGCTCCATGA
AGTCTGCTTACTTATTTAAAAATTGTGTATCAGTTTTAAATACTGTTCATTGTGTGCAGATATAAGGGGA
ATAGGGCATTCTGTAGAATTATACATGTCTAGTTTGTAAAGTGTGTCCTGTGTACTGCAGATGTGTGTTC
TCTGGGCTTTATGTATCTGTACAGTAGCTTTCACATTAAAAAAATTGTGGACAAACTTGTCCGGGGGGTT
TGAGGGGAGAATGGTGGTTTATATCAATAACGATGCTGTACTATAGTCCATGTAACAAAAGATCTGGAAG
TCACCCTCCTCTGGCCCACGGAAAATTTTGGTAATCTTCTAGGTTCTAAAATGAAGATGTATGGGTACTC
TGGCAGACTGCATGTTGTATAATTTGAAAAATACTAAAAGTGGAAAATAAAATTGAATTAAACTTTG
```

FIGURE 240
SEQ ID NO: 232
Genbank ID       : W52934
Unigene ID(#167) : Hs.113009
Unigene name     :       hypothetical protein FLJ22527 FLJ22527
>gi|1350405|gb|W52934.1|W52934  zc97a09.r1  Pancreatic  Islet  Homo  sapiens cDNA cl
one IMAGE:339064 5', mRNA sequence

```
GCAAACCAAGAGGAAGAAGAAAAAAACAAAAGAAGAAGAAGAAAAAGGAAAAACAACCCAAGAAAGCCA
AAAAACAAAAGAAAGGAACAAAGGAGAAAAATAAGGAAGAAGACGAAAAATGGAAAATGTCACCAAGTCT
TTTTCTTCCTGCAATGAAGGAAGGATGTAACGCATACAAAGAAATCTGGATGAAAAAGATGAGTCTTGG
AATTTCTCTCAGGACTATGATCCAGAACTGATCAAAGAGGAGAAACGAAAAGAATTACAGTCAGAGATCA
GGATACAGGTTGATGAGTTGATGAGACAGGAACTTAAAAACTTAAAGCTAGCTGTGGACAGAGAAAGGGA
```

FIGURE 240 cont'd

```
GCGCCCAGTTGAAAGCAGGAAAGAAAAAGGGACAAGAAGANAGGAAAGAAAGGCNAAAAGAAAGAGAAGA
AGGCNAAGAAGGGTTAAGATTCTGACAGCTGACAGGACCATCGAGTCTCCTGTATTAAGGGACTGGTTGG
AAGAAGATTNCTGTCCAGGCTCTTGNAAGTCACCCCNCCTGATTTCCTTTGGTGAGNTCCGCTNCCTGGG
NCTTCTCTTTCNCCAGTGTCCCTTGACC
```

FIGURE 241

SEQ ID NO: 233
Genbank ID         : NM_030953.1
Unigene ID(#167)   : Hs.169333
Unigene name       :        tigger transposable element derived 6         TIGD6
>gi|13569923|ref|NM_030953.1|    Homo    sapiens    hypothetical    protein
DKFZp761E2110 (
DKFZP761E2110), mRNA

```
CGGACTGCTTCCGGCCAGAGGTCCCGGGCGGAGGAGGAAGCTGTGGCTGCCGGCGGTGGGACGCCCCGGC
CGCTCAGCCCCCGGGCACTGCTGTGGGGCGTTCAGCTTTCCACACTTGGGGCAAAGCAAGCCGCGAGGAG
GAACCAGACAGTCCTGTTAGTTGTGGCCAGCCCTCATTCCCTGGAAATGGCAAACAAGGGGAACAAGAAG
CGTCGGCAGTTCTCTCTGGAGGAGAAAATGAAAGTTGTGGGAGCTGTAGACTCAGGCAAGAGGAAAGGTG
ATGTGGCAAAAGAATTTGGTATCACTCCCTCTACTTTATCTACATTCTTAAAGGATCGCACCAAATTTGA
AGAAAAGGTGCGGGAGGCATCCGTGGGACCCCAGCGGAAAAGGATGAGGAGCGCTCTTTATGATGACATT
GATAAGGCTGTTTTTGCTTGGTTTCAAGAAATCCATGCCAAAAACATTCTTGTGACTGGTTCTGTCATTC
GGAAAAAAGCACTAAACTTGGCCAACATGCTTGGCTATGACAATTTTCAAGCAAGTGTGGGCTGGCTGAA
CAGATTTAGAGATCGCCACGGAATTGCTTTGAAAGCAGTCTGTAGAGAAGATAGTGACAGGTTAATGAAT
GGTCTAGGAATAGATAAGATTAATGAGTGGCATGCAGGGGAAATTATAAAACTGATTGCTGACTACAGCC
CAGATGATATCTTTAATGCTGATGAGACAGGAGTGTTTTTCCAGTTGCTTCCCCAGCACACACTTGCTGC
TAAAGGAGACCACTGTAGAGGGGGCAAGAAAGCAAAGCAGCGGTTGACAGCACTCTTTTGTTGCAATGCC
TCGGGGACTGAAAAAATGAGACCATTGATTGTTGGTAGGTCAGCCAGCCCACACTGCCTCAAGAACATTC
ATTCCCTCCCTTGTGATTACCGAGCCAACCAGTGGGCTTGGATGACAAGGGATCTGTTTAATGAGTGGCT
GATGCAAGTGGATGCCAGGATGAAGAGGGCGGAACGCCGGATCCTCTTGCTCATAGACAACTGCTCTGCT
CATAACATGCTTCCACACTTGGAAAGGATTCAGGTTGGGTATCTGCCCTCCAACTGTACTGCTGTCCTGC
AGCCACTGAATCTTGGCATAATTCACACCATGAAAGTACTGTACCAGAGCCACCTTCTAAAACAGATCCT
CCTCAAGCTCAACAGCAGTGAGGATCAAGAAGAGGTGGACATCAAGCAGGCCATCGACATGATTGCTGCA
GCGTGGTGGTCAGTCAAGCCATCCACAGTGGTGAAATGTTGGCAGAAGGCAGGCATCGTCCCTATGGAAT
TTGCAGAATGTGACACAGAATCAGCAGCCAGTGAACCAGACATTGCCATTGAAAAGTTGTGGCACACAGT
GGCTATTGCCACCTGTGTCCCAAATGAAGTAAATTTCCAGGACTTTGTTACTGCAGATGATGATCTCATT
ATCTCTCAGGACACAGACATCATCCAGGACATGGTGGCTGGCGAAAATACCAGTGAAGCAGGAAGTGAAG
ATGAAGGGGAGGTATCTTTACCAGAGCAACCAAAAGTCACCATCACAGAAGCCATATCAAGTGTACAGAA
ACTTAGACAGTTCCTTTCCACTTGTGTAGACATTCCTGATGCCATTTTTGGACAATTAAATGGCATAGAT
GAATATTTAATGAAAAGAGTGACACAAACCCTTATTGATTCCAAAATTACAGATTTCCTCCAAACAAAAT
AATGCAGGAATTTATTTCAGAAAATGTAGTTTACAAGAATAAAGATTTCTTTAGATAGGTTGTTGAGCCA
ATTTAAGTAAAGCAATGTTATTGTGACAACATTCCAGTACTCTGAAATAGCCAGGAAACTTCTTTGAATG
GAATTTGACTAATATGTGTGTTTTCTTTTCTTTTGTTTTGGCTGTCTCTGGTCCTTGATTCAAGATGTA
TTTTGATTCATCCAAGGGTTTCCAAACTTGTCTGAAATTAGGATCACTTGAGAATCCTTTAAAAATTCC
AAAGCTCAGGCCATATCCCAGGCCTATTAAATCACAATCTTTGGTGACGGGTCACAGGCATTGGTAGTTT
TGAAGCTCTCCAGGTGATTCCAATGTGCAGACAAATTTGAAAACTGAACCAACCACAGGAACATCAAGTA
CACTGTGGGCCTGGGTCCAGCTTCTTTCCAGTAAGTGTATCTCAGGGGCTTCCAAATTTAGCTTACATCA
GAATCACTTGGAAGGCTTGTTAAAACCCAAGGCTGCTAGGCCCACCCCCAGAGTTTGATACAGTAGACCT
CAGGTGGGACCCAAAAATTTGCATTTCTAACACATTCTCAGCTGATGCAGTCCAGGCTCCATGCTTTGAA
AACCACTGGTCTAGCTTTAGATAGGATATTGAGCCAATTTAAATAAAGCAATATACTGGTCTAGCTGAGT
TCTAGAACTTCTCTCTTTAGCTGGCCATCTGAATACTCCCCCATCACTAATTGTTAAAAAAGAATCAAC
TGTTCTTACTCTAGAGCTCTTTTTTCCTTTCTGCTGATTTGCTGGAAGCACTACAAGACTTCTGTTTGTT
CGTTCGTTTGTTTGTTTGTTTTTAAAGATGGGGTCTTGTTATATTGCCTAGGCTGGAATGCAGTGG
TTATTCACAGGCATGATTATAACACACTACTCTCTAACTCCTGGCCTCAAGCCATCCTCCCAAATAGA
TGGGACTACTGATGCACACTGCCATGCTGGCCTTACGAAATGTTTTAATAGGCATTTCACTAATAGGGAT
CTGGAGTACAAGGAAATACAGTGCATTTAAGACATAGGCTGGGCATGGTGGCTCATGCCTGTAATCCCAG
CACATTGGGAAGATCACTTGAGGCAAGGAGTTTGAGACCAGACTGGCCAACACAGCGAGACCCCATCTC
TAAAAAAAAAAAAAAATTAATAAGACATGGATACAACCAGGGAGGGAGGGTTATAATAATAGAGCATCCTGT
TAATCAGAATCATGGGGAGAACATACAGCCCAGCGTGCCTCTCACTTTCCAGAAAGGGTGAGAGGATCA
TTAGAGAGTTCATTAGAGAGTATTTATTCCTAATAAGTCAGATAAATGTCAGTTTCATTTTTAGAAGTTT
CACACAATACCTGCTAATGGTGTGATGTCATTTTTCCCCCTGCTTCAGGTTAATTTTTTGGATATTTCAG
AAACCCATAGCAATTCAGTGATTTTTCTTTTTGTAGTAGCTCAGTCAAAACAGGTAACAGCAGATTAATC
```

FIGURE 241 cont'd

```
ATAGAAAATGTTGCTTCCACATTAACAAAACAATCACTGAAAAACAGCAGATGTTTAAATAGATTATTTT
ATAGCTTATTTTGGATATTTTTTCTTTTAATAAACTAATATGATCATTTGAATCAAAAAAAAAAAAAAA
AAAG
```

FIGURE 242
SEQ ID NO: 234

```
Genbank ID       : D14134.1
Unigene ID(#167) : Hs.446554
Unigene name     :      RAD51   homolog   (RecA   homolog,   E.   coli)   (S.
cerevisiae) RAD51
>gi|285976|dbj|D14134.1|HUMRAD51 Human mRNA for RAD51, complete cds
CCGCGCGCAGCGGCCAGAGACCGAGCCCTAAGGAGAGTGCGGCGCTTCCCGAGGCGTGCAGCTGGGAACT
GCAACTCATCTGGGTTGTGCGCAGAAGGCTGGGGCAAGCGAGTAGAGAAGTGGAGCGTAAGCCAGGGGCG
TTGGGGGCCGTGCGGTCGGGCGCGTGCCACGCCCGCGGGGTGAAGTCGGAGCGCGGGGCCTGCTGGAGA
GAGGAGCGCTGCGGACCGAGTAATGGCAATGCAGATGCAGCTTGAAGCAAATGCAGATACTTCAGTGGAA
GAAGAAAGCTTTGGCCCACAACCCATTTCACGGTTAGAGCAGTGTGGCATAAATGCCAACGATGTGAAGA
AATTGGAAGAAGCTGGATTCCATACTGTGGAGGCTGTTGCCTATGCGCCAAAGAAGGAGCTAATAAATAT
TAAGGGAATTAGTGAAGCCAAAGCTGATAAAATTCTGGCTGAGGCAGCTAAATTAGTTCCAATGGGTTTC
ACCACTGCAACTGAATTCCACCAAAGGCGGTCAGAGATCATACAGATTACTACTGGCTCCAAAGAGCTTG
ACAAACTACTTCAAGGTGGAATTGAGACTGGATCTATCACAGAAATGTTTGGAGAATTCCGAACTGGGAA
GACCCAGATCTGTCATACGCTAGCTGTCACCTGCCAGCTTCCCATTGACCGGGGTGGAGGTGAAGGAAAG
GCCATGTACATTGACACTGAGGGTACCTTTAGGCCAGAACGGCTGCTGGCAGTGGCTGAGAGGTATGGTC
TCTCTGGCAGTGATGTCCTGGATAATGTAGCATATGCTCGAGCGTTCAACACAGACCACCAGACCCAGCT
CCTTTATCAAGCATCAGCCATGATGGTAGAATCTAGGTATGCACTGCTTATTGTAGACAGTGCCACCGCC
CTTTACAGAACAGACTACTCGGGTCGAGGTGAGCTTTCAGCCAGGCAGATGCACTTGGCCAGGTTTCTGC
GGATGCTTCTGCGACTCGCTGATGAGTTTGGTGTAGCAGTGGTAATCACTAATCAGGTGGTAGCTCAAGT
GGATGGAGCAGCGATGTTTGCTGCTGATCCCAAAAAACCTATTGGAGGAAATATCATCGCCCATGCATCA
ACAACCAGATTGTATCTGAGGAAAGGAAGAGGGAAACCAGAATCTGCAAAATCTACGACTCTCCCTGTC
TTCCTGAAGCTGAAGCTATGTTCGCCATTAATGCAGATGGAGTGGGAGATGCCAAAGACTGAATCATTGG
GTTTTTCCTCTGTTAAAAACCTTAAGTGCTGCAGCCTAATGAGAGTGCACTGCTCCCTGGGGTTCTCTAC
AGGCCTCTTCCTGTTGTGACTGCCAGGATAAAGCTTCCGGGAAAACAGCTATTATATCAGCTTTTCTGAT
GGTATAAACAGGAGACAGGTCAGTAGTCACAAACTGATCTAAAATGTTTATTCCTTCTGTAGTGTATTAA
TCTCTGTGTGTTTCTTTGGTTTTGGAGGAGGGGTATGAAGTATCTTTGACATGGTGCCTTAGGAATGAC
TTGGGTTTAACAAGCTGTCTACTGGACAATCTTATGTTTCCAAGAGAACTAAAGCTGGAGAGACCTGACC
CTTCTCTCACTTCTAAATTAATGGTAAAATAAAATGCCTCAGCTATGTAGCAAAGGGAATGGGTCTGCAC
AGATTCTTTTTTCTGTCAGTAAAACTCTCAAGCAGGTTTTTAAGTTGTCTGTCTGAATGATCTTGTGTA
AGGGTTTGGTTATGGAGTCTTGTGCCAAACCTACTAGGCCATTAGCCCTTCACCATCTACCTGCTTGGTC
TTTCATTGCTAAAGCTAACTCAAGATAATCCTAGAGTCTTAAAGCATTTCAGGCCAGTGTGGTCTTGC
GCCTGTACTCCCAGCACTTTGGGAGGCCGAGGCAGGTGGATCGCTTGAGCCAGGAGTTTTAAGTCCAGCT
TGGCCAAGATGGTGAAATCCCATCTCTACAAAAATGCAGAACTTAATCTGGACACACTGTTACACGTGC
CTGTAGTCCCAGCTACTCTATAGCCTGAGGTGGGAGAATCACTTAAGCCTGGAAGGTGGAAGTTGCAGTG
AGTCGAGATTGCACTGCTGCATTCCAGCCAGGGTGACAGAGTGAGACCATGTTTCAAACAAGAAACATTT
CAGAGGGCAAGTAAACAGATTTGATTGTGAGGCTTCTAATAAAGTAGTTATTAGTAGTG
```

FIGURE 243
SEQ ID NO: 235

```
Genbank ID       : AW451103
Unigene ID(#167) : Hs.71371
Unigene name     :      Clone IMAGE:4797878, mRNA, partial cds
>gi|6991879|gb|AW451103.1|AW451103 UI-H-BI3-alg-e-12-0-UI.s1 NCI_CGAP_Sub5
Homo
  sapiens cDNA clone IMAGE:2736862 3', mRNA sequence
TTTTTTTTTTTTTTTTTTCGATATTCAGCATTCATTCAACAAACATTTATTAGGCTCCTACTGTGCGTCGC
GCTGGAAAGGCAAGCAGAAGCTAGATTCCCAATCGATCCCGGGAGGCTGGACGATCCAGACACAAACACC
GTTCATGCGTCTATTCGAAAAGGCCCTCTTGGAATTTTGTGCACAGCATTTCCTTGGGGTGTCGATGGAT
CGGGGTCTGCAAACATTAGCACCTTTTCCGGTGGCCGCTGTCTTCTCAGACCTCAGACACCGGCGCCTCC
CCGTGAACTCCCGCAGGCGTCCCTAGCCCAGGGCTTGGCGGGCGCTGCCGGTTGTACCTGGCCTAAGCCA
CGCTGGGCCGCCAGCCCGGGGCGACACCTTCTTCGGACGGCGGGGATTTGCGGCTCGGGTGACCGGAGGT
```

FIGURE 243 cont'd

GCCCTCCCGCGGGTTTCGGAGCAGCTCCGCGGGCTCTCGCTCCCCTCGTGCCG

FIGURE 244
SEQ ID NO: 236
Genbank ID        : BF111780
Unigene ID(#167)  : Hs.440663
Unigene name      :        chromosome 1 open reading frame 19   C1orf19
>gi|10941470|gb|BF111780.1|BF111780   7l35e01.x1   Soares_NSF_F8_9W_OT_PA_P_S1 Homo
   sapiens cDNA clone IMAGE:3523297 3', mRNA sequence
TTTTTTTTTTGAAAGAAATCTTTTACTTTTTACTGGAGAGGAAAAAGTAAACAGAAGTGGGTGACAAGGT
ACATATAAAATGCCATTCTACGGTAGCTGCAGTGGCCAAAAGGCACTGGGGAGAGCTGAGTAAGAAAAAG
AAATGGCAGTCTCAACAATGAGCTGGCAGTGGCAGCAAGAAACAAAGAGACAACTTTGAGTGTGGGATGA
CAAAAGCAGCACACAGGTCCCACCCATCTGAATACATCCTAGGCATAAACCTGTATATAACTGTAATTAA
ACTGTCTCTAGATAACAAAGTTTTAAAGAAATCACCCTATATTTTTAAGAAGGAGAAAGTCTTCTACCT
GGGGAAGTTTTACTCTTCAGAATGAAAACCTTATGGAATGGGGAAGTCAACCCTCACTATGTACGTCAAC
CCTATTTCTGAGATAAAAGATGAAGCAGTCTGATGGGTCTCAAATCCAATCTTGTATGAATAAAACAAGC
ATCAGGAAACATGGATGTCATCTTCTAAGA

FIGURE 245
SEQ ID NO: 237
Genbank ID        : NM_014479.1
Unigene ID(#167)  : Hs.145296
Unigene name      :        ADAM-like, decysin 1     ADAMDEC1
>gi|7657318|ref|NM_014479.1|  Homo sapiens ADAM-like, decysin 1 (ADAMDEC1),
mRNA
CGCCCGGGCAGGTGAGAAATTGGAGAAGATAAAACTGGACACTGGGGAGACCACAACTTCATGCTGCGTG
GGATCTCCCAGCTACCTGCAGTGGCCACCATGTCTTGGGTCCTGCTGCCTGTACTTTGGCTCATTGTTCA
AACTCAAGCAATAGCCATAAAGCAAACACCTGAATTAACGCTCCATGAAATAGTTTGTCCTAAAAAACTT
CACATTTTACACAAAAGAGAGATCAAGAACAACCAGACAGAAAAGCATGGCAAAGAGGAAAGGTATGAAC
CTGAAGTTCAATATCAGATGATCTTAAATGGAGAAGAAATCATTCTCTCCCTACAAAAAACCAAGCACCT
CCTGGGGCCAGACTACACTGAAACATTGTACTCACCCAGAGGAGAGGAAATTACCACGAAACCTGAGAAC
ATGGAACACTGTTACTATAAAGGAAACATCCTAAATGAAAAGAATTCTGTTGCCAGCATCAGTACTTGTG
ACGGGTTGAGAGGATACTTCACACATCATCACCAAAGATACCAGATAAAACCTCTGAAAAGCACAGACGA
GAAAGAACATGCCGTCTTTACATCTAACCAGGAGGAACAAGACCCAGCTAACCACACATGTGGTGTGAAG
AGCACTGACGGGAAACAAGGCCCAATTCGAATCTCTAGATCACTCAAAAGCCCAGAGAAAGAAGACTTTC
TTCGGGCACAGAAATACATTGATCTCTATTTGGTGCTGAATAATGCCTTTTATAAGAACTATAATGAGAA
TCTAACTCTGATAAGAAGCTTTGTGTTTGATGTGATGAACCTACTCAATGTGATATATAACACCATAGAT
GTTCAAGTGGCCTTGGTAGGTATGGAAATCTGGTCTGATGGGGATAAGATAAAGGTGGTGCCCAGCGCAA
GCACCACGTTTGACAACTTCCTGAGATGGCACAGTTCTAACCTGGGGAAAAAGATCCACGACCATGCTCA
GCTTCTCAGCGGGATTAGCTTCAACAATCGACGTGTGGGACTGGCAGCTTCAAATTCCTTGTGTTCCCCA
TCTTCGGTTGCTGTTATTGAGGCTAAAAAAAAGAATAATGTGGCTCTTGTAGGAGTGATGTCACATGAGC
TGGGCCATGTCCTTGGTATGCCTGATGTTCCATTCAACACCAAGTGTCCCTCTGGCAGTTGTGTGATGAA
TCAGTATCTGAGTTCAAAATTCCCAAAGGATTTCAGTACATCTTGCCGTGCACATTTTGAAAGATACCTT
TTATCTCAGAAACCAAAGTGCCTGCTGCAAGCACCTATTCCTACAAATATAATGACAACACCAGTGTGTG
GGAACCACCTTCTAGAAGTGGGAGAAGACTGTGATTGTGGCTCTCCTAAGGAGTGTACCAATCTCTGCTG
TGAAGCCCTAACGTGTAAACTGAAGCCTGGAACTGATTGCGGAGGAGATGCTCCAAACCATACCACAGAG
TGAATCCAAAGTCTGCTTCACTGAGATGCTCCTTGCCAGGACAAGAACCAAGAACTCTAACTGTCCCAG
GAATCTTGTGAATTTTCACCCATAATGGTCTTTCACTTGTCATTCTACTTTCTATATTGTTATCAGTCCA
GGAAACAGGTAAACAGATGTAATTAGAGACATTGGCTCTTTGTTTAGGCCTAATCTTTCTTTTTACTTTT
TTTTTTCTTTTTTCTTTTTTTTTAAAGATCATGAATTTGTGACTTAGTTCTGCCCTTTGGAGAACAAAAG
AAAGCAGTCTTCCATCAAATCACCTTAAAATGCACGGCTAAACTATTCAGAGTTAACACTCCAGAATTGT
TAAATTACAAGTACTATGCTTTAATGCTTCTTTCATCTTACTAGTATGGCCTATAAAAAAAATAATACCA
CTTGATGGGTGAAGGCTTTGGCAATAGAAAGAAGAATAGAATTCAGGTTTTATGTTATTCCTCTGTGTTC
ACTTCGCCTTGCTCTTGAAAGTGCAGTATTTTTCTACATCATGTCGAGAATGATTCAATGTAAATATTTT
TCATTTTATCATGTATATCCTATACACACATCTCCTTCATCATCATATATGAAGTTTATTTTGAAGAGTC
TACATTGCTTACATTTTAATTGAGCCAGCAAAGAAGGCTTAATGATTTATTGAACCATAATGTCAATAAA
AACACAACTTTTGAGGC

FIGURE 246
SEQ ID NO: 238
Genbank ID       : NM_021052.1
Unigene ID(#167) : Hs.121017
Unigene name     :      histone 1, H2ae     HIST1H2AE
>gi|10645194|ref|NM_021052.1| Homo sapiens H2A histone family, member A (H2AFA)
, mRNA
ATGTCTGGACGTGGAAAGCAAGGCGGCAAAGCTCGGGCAAAAGCTAAAACGCGTTCTTCCAGGGCCGGTC
TTCAGTTTCCAGTTGGCCGTGTGCACCGCCTCCTCCGCAAAGGCAACTACTCCGAACGAGTCGGGGCCGG
CGCTCCAGTGTACCTGGCAGCGGTGCTGGAATATCTGACGGCCGAGATCTTAGAGCGTAGCTGGCAACGCG
GCTCGCGACAATAAGAAGACCCGCATCATCCCGCGCCACCTGCAGCTAGCCATCCGCAACGACGAGGAGC
TAAATAAGCTTCTAGGTCGCGTGACCATCGCGCAGGGCGGTGTCCTGCCCAACATCCAGGCCGTATTGCT
GCCTAAGAAGACGGAGAGCCACCATAAGGCCAAGGGCAAGTGA

FIGURE 247
SEQ ID NO: 239
Genbank ID       : NM_014669.1
Unigene ID(#167) : Hs.295014
Unigene name     :       KIAA0095 gene product     KIAA0095
>gi|7661901|ref|NM_014669.1| Homo sapiens KIAA0095 gene product (KIAA0095), mRN
A
CGGCCGCGTCCTCAAGCCGGCACCTGAGCGGCGGAGACGGCTGTAGCACAAGGATCTGCATCTCCAATGG
ATACTGAGGGGTTTGGTGAGCTCCTTCAGCAAGCTGAACAGCTTGCTGCTGAGACTGAGGGCATCTCAGA
GCTTCCCCATGTGGAACGGAACTTACAGGAGATCCAGCAGGCGGGAGAGCGCCTGCGTTCCCGTACCCTA
ACACGCACGTCCCAGGAGACGGCAGATGTCAAGGCGTCAGTTCTCCTCGGGTCTCGGGGACTTGACATAT
CCCACATCTCCCAGCGATTGGAGAGTCTGAGTGCAGCCACCACCTTTGAGCCTCTTGAGCCTGTGAAGGA
CACTGACATTCAGGGCTTCCTGAAGAATGAGAAGGACAATGCCCTGCTGTCTGCCATCGAAGAGTCCCGG
AAGAGGACCTTCGGCATGGCTGAGGAGTACCATCGGGAGTCAATGTTGGTTGAGTGGGAGCAAGTGAAAC
AGCGAATTCTGCACACACTGCTGGCATCAGGAGAAGACGCCCTTGACTTTACTCAAGAAAGCGAGCCAAG
CTACATCAGTGATGTGGGACCCCCTGGTCGAAGCTCTCTGGATAACATCGAGATGGCCTATGCGCGGCAA
ATTTATATCTATAATGAGAAAATTGTAAATGGACACCTGCAGCCTAACCTGGTGGACCTTTGTGCTTCCG
TCGCAGAGCTGGATGATAAGAGCATTTCCGACATGTGGACCATGGTAAAACAAATGACAGACGTGTTGTT
GACACCGGCAACGGATGCCCTGAAGAACCGCAGCAGCGTGGAAGTGCGCATGGAGTTTGTCAGGCAGGCC
TTGGCGTACCTTGAGCAGAGTTATAAGAATTACACCCTTGTGACTGTCTTTGGAAATTTGCATCAGGCCC
AGCTGGGCGGGGTGCCTGGGACTTACCAATTGGTTCGAAGTTTCCTGAACATTAAACTGCCAGCTCCCTT
GCCTGGACTACAGGATGGAGAGCTGGAAGGCCATCCTGTGTGGGCGCTAATTTACTACTGCATGCGCTGT
GGAGACCTGCTTGCCGCTTCACAGGTAGTTAATCGAGCCCAGCACCAGCTGGGAGAGTTTAAAACCTGGT
TCCAGGAGTACATGAACAGCAAGGACAGAAGATTGTCCCCAGCTACGGAAAACAAGCTCCGGCTGCATTA
CCGTAGGGCCCTCAGGAACAATACAGATCCCTACAAGCGGGCCGTGTACTGTATCATTGGCAGATGTGAC
GTCACCGACAACCAGAGTGAAGTGGCGGACAAAACTGAGGATTACCTGTGGCTGAAGTTGAACCAAGTGT
GTTTTGACGACGATGCCACCAGCTCCCCACAAGACAGGCTCACTCTCTCACAGTTCCAGAAGCAGTTGTT
GGAAGACTATGGCGAGTCCCACTTTACGGTGAACCAGCAACCCTTCCTCTACTTCCAAGTCCTGTTCCTG
ACAGCGCAGTTTGAAGCAGCAGTTGCCTTTCTTTTCCGCATGGAGCGGCTGCGCTGCCATGCTGTCCATG
TAGCACTGGTGCTGTTTGAGCTGAAGCTGCTTTTAAAGTCCTCTGGACAGAGTGCTCAGCTCCTCAGCCA
CGAGCCTGGTGACCCTCCTTGCTTGCGGCGGCTGAACTTCGTGCGGCTCCTCATGCTGTACACCCGGAAG
TTTGAGTCCACGGACCCAAGGGAGGCCCTCCAGTACTTCTATTTCCTCAGGGATGAGAAAGATAGTCAAG
GAGAAAACATGTTTCTGCGCTGTGTGAGTGAGCTTGTGATTGAAAGCCGAGAGTTCGATATGATTCTTGG
GAAACTAGAGAATGACGGAAGTAGAAAGCCTGGAGTCATAGATAAGTTTACTAGTGACACAAAGCCTATT
ATCAACAAAGTTGCTTCTGTGGCAGAAAATAAAGGACTGTTTGAAGAGGCAGCAAAGCTGTATGACCTTG
CCAAGAATGCTGACAAGGTACTGGAGCTGATGAACAAACTGCTGAGCCCTGTCGTCCCCAGATCAGTGC
CCCGCAATCCAACAAGGAGAGGCTGAAGAACATGGCACTCTCCATTGCCGAACGGTATAGGGCTCAAGGA
ATAAGCGCAAATAAATTTGTGGACTCCACGTTCTATCTTCTTTTGGACTTGATCACCTTTTTTGACGAGT
ATCATAGTGGTCATATTGATAGAGCTTTTGATATCATTGAGCGCTTGAAGCTGGTGCCCCTGAATCAGGA
AAGTGTGGAAGAGAGAGTGGCTGCTTTCAGAAATTTCAGTGATGAAATCAGGCACAACCTCTCAGAAGTG
CTTCTTGCCACCATGAACATCTTGTTCACACAGTTTAAGAGGCTCAAGGGGACAAGTCCATCCTCGTCAT

FIGURE 247 cont'd

```
CCAGGCCCCAGCGAGTCATCGAGGACCGCGACTCTCAACTCCGAAGTCAAGCCCGCACTCTGATTACCTT
TGCTGGAATGATACCATACCGAACGTCTGGGGACACCAATGCGAGGCTGGTGCAGATGGAGGTCCTCATG
AATTAAGTGCCATGCTTTGTGGGAGTCTGGGTCGGCACACTGTCAGTACATCAGGCACATGGGCCCACTA
GGCTGGGGTTTCTGGTTTTGTTTCTGTTGTGTTTTGTTTTGGTTTCTGTATTATGTATTTTTGTCAACGC
CAATAAATTTCTTTGATTTGT
```

FIGURE 248
SEQ ID NO: 240
Genbank ID       : U90065.1
Unigene ID(#167) : Hs.376874
Unigene name     :     potassium channel, subfamily K, member 1   KCNK1
>gi|1916294|gb|U90065.1|HSU90065   Human   potassium   channel   KCNO1   mRNA,
complete c
ds
```
GGGCAGGAAGACGGCGCTGCCCGGAGGAGCGGGGCGGGCGGGCGCGCGGGGGAGCGGGCGGCGGGCGGGA
GCCAGGCCCGGGCGGGGGCGGGGGCGGCGGGGCCAGAAGAGGCGGCGGGCCGCGCTCCGGCCGGTCTGCG
GCGTTGGCCTTGGCTTTGGCTTTGGCGGCGGCGGTGGAGAAGATGCTGCAGTCCCTGGCCGGCAGCTCGT
GCGTGCGCCTGGTGGAGCGGCACCGCTCGGCCTGGTGCTTCGGCTTCCTGGTGCTGGGCTACTTGCTCTA
CCTGGTCTTCGGCGCAGTGGTCTTCTCCTCGGTGGAGCTGCCCTATGAGGACCTGCTGCGCCAGGAGCTG
CGCAAGCTGAAGCGACGCTTCTTGGAGGAGCACGAGTGCCTGTCTGAGCAGCAGCTGGAGCAGTTCCTGG
GCCGGGTGCTGGAGGCCAGCAACTACGGCGTGTCGGTGCTCAGCAACGCCTCGGGCAACTGGAACTGGGA
CTTCACCTCCGCGCTCTTCTTCGCCAGCACCGTGCTCTCCACCACAGGTTATGGCCACACCGTGCCCTTG
TCAGATGGAGGTAAGGCCTTCTGCATCATCTACTCCGTCATTGGCATTCCCTTCACCCTCCTGTTCCTGA
CGGCTGGTCCAGCGCATCACCGTGCACGTCACCCGCAGGCCGGTCCTCTACTTCCACATCCGCTGGGG
CTTCTCCAAGCAGGTGGTGGCCATCGTCCATGCCGTGCTCCTTGGGTTTGTCACTGTGTCCTGCTTCTTC
TTCATCCCGGCCGCTGTCTTCTCAGTCCTGGAGGATGACTGGAACTTCCTGGAATCCTTTTATTTTTGTT
TTATTTCCCTGAGCACCATTGGCCTGGGGATTATGTGCCTGGGGAAGGCTACAATCAAAAATTCAGAGA
GCTCTATAAGATTGGGATCACGTGTTACCTGCTACTTGGCCTTATTGCCATGTTGGTAGTTCTGGAAACC
TTCTGTGAACTCCATGAGCTGAAAAAATTCAGAAAAATGTTCTATGTGAAGAAGGACAAGGACGAGGATC
AGGTGCACATCATAGAGCATGACCAACTGTCCTTCTCCTCGATCACAGACCAGGCAGCTGGCATGAAAGA
GGACCAGAAGCAAAATGAGCCTTTTGTGGCCACCCAGTCATCTGCCTGCGTGGATGGCCCTGCAAACCAT
TGAGCGTAGGATTTGTTGCATTATGCTAGAGCAC
```

FIGURE 249
SEQ ID NO: 241
Genbank ID       : AW243917
Unigene ID(#167) : Hs.196566
Unigene name     :     Transcribed sequences
>gi|6577757|gb|AW243917.1|AW243917   xo58e03.x1   NCI_CGAP_Ut4   Homo   sapiens
cDNA cl
one IMAGE:2708188 3', mRNA sequence
```
TTTAACAGAAATTTACTTTTATTTTCTGAAAAACTTAAACAGATAAATGACAAAACATGTTCATTAACAG
TCAACAATAAGGCAAGGAAGGAATTCACACTATTCCTCAGAGCAGCTCCGCAAGGCTTATCAAGTAAGCT
TCTGATATAGTTTATACTGTAGTTGAAGCTGGTTTCAGAAAAGCCCATGTTTTCTTTAGTCAGCATGCGG
GGTAAGAAAACTCCGTGAACTCTCTGGCAAAGTCTCTTTCTGGCCTTTCGTCTTCCTACCATTTTTGGTC
ATGGTTCCACCCAAATAAAATGGAGGGATTCAGATTTATCATTACATGTAATCTTTCATCTAAACACTGT
CTGCAAATGCCTAAGTCCCACCACGCCCTACAAGCTCACTCACATACACAGCATGTCATGCTCACATAAC
AGGAAACATGCCAAAGATAGACACCCAAAATTGTAAAAA
```

FIGURE 250
SEQ ID NO: 242
Genbank ID       : BC001131.1
Unigene ID(#167) : acc_BC001131.1
Unigene name     :
>gi|12654590|gb|BC001131.1|   Homo   sapiens   cDNA   clone   IMAGE:2989839,   with
apparen
t retained intron FIGURE 250 cont'd

```
GGCACGAGGCTCACTGCTGTTATTGTTTTCTGACAGCATGCCTGAACCAGCTAAGTCAGCTCCTGCTCCG
AAGAAGGGTTCCAAGAAGGCTGTGACCAAGGCGCAGAAGAAGGATGGCAAGAAGCGCAAGCGCAGTCGTA
AGGAGAGCTACTCCGTGTATGTGTACAAGGTGCTAAAACAGGTTCACCCCGATACTGGCATCTCATCCAA
GGCCATGGGCATCATGAATTCCTTCGTTAACGACATCTTCGAACGCATCGCAGGCGAGGCTTCCCGTCTG
GCCCACTACAACAAGCGCTCGACCATTACCTCCAGGGAGATCCAGACCGCCGTGCGTCTGCTGCTTCCCG
GAGAGCTGGCCAAGCACGCAGTGTCCGAAGGTACCAAGGCTGTCACCAAGTATACAAGCTCCAAGTAAAT
GTGTGCTTAGGTGCTTTAAAACTCAAAGGCTCTTTTCAGAGCCACTCAAGTCTCACATAAAGAGCTTTAA
TATTGAATTTCACCGTTTTCTAGGGAATAATTTTTCCGATTTTGTAATCCCAGCACTTTGGGAGGCCGAG
GCGTGCGGATCGAGACCAGTTTGGCTAACGTGGTTAAATCTCGTTTCTACTAAAAATACAAATATTAGCC
GGGCGTGGGGCAGTCGCGTGTCATCCCAGAGACTCGGGAGGCTGCCGCAGGAGAATCACTTAAACCCAGC
AAGCAAAGGTTGCAGTGAAAAGACATGGCGCTTTTGCATTCTAGCCTGGGCGACAAAGGCGAGGCTTCGT
CTCAAAAAAAATTGATCAGGAGATACTCCTGTTCTGTGTTGGCAAGATCCTGTAATCCTAGCACTTTGGG
AGGTCGATGCATGAGGCTTTCTTCAGCTCAGGAGTTAACAGATTTGCCTGGGCAACATAGAACTCGTCTC
TGCAAAAAATGAAGCTAACCAGGTGTGACGGCTTGCGTCTGTACTATCATTTACTCGGTAGGCTGAGGT
GGTAGGATAGCTTAAACTCTCGGGCTAGAGACTGCAGGAACATGTGAATACGCTAGTGCAATTCCAGCCT
GGGCAACACTGGAAAGGGTAGGAAGAGTAGTCTTTGGGTCCCTAAAGATCACCTGATAACAAGTTTGACT
TTTCTGAGCACTCTTGTGGAGTTTGTTGTGGAGGGAATACCATGGGCATTGGCAATGTAAAGTTGATCTA
AAAAATCTCGTTTTCCGCCGTGCGCGGTGGCTCACGCCTCTAATCCCATCACTTTGGGAGGCCGAGACGG
GCGGATCACGAGGTCAGGAGGTCGAGACCATCCTGGCTAACACTGTGAAACCCTGTCTCTACTAAAAAAA
TACAAACAAAATTAGCCGGGCGTGGTGGCACTCACCTGTAGTTTCAGCTACTCTGGAAGCTGAGGCTGGA
GAGTCACTTGAACCCGGGAGGCGGAGGTTGCAGTGATCAGAGATCGCGCCACTGCACTCCATCCTGGGCG
AAAGAGCTAGATTCCATCTCATAAAAAAAAAAAAAAAAAAAAAAAAAAAAAA
```

FIGURE 251
SEQ ID NO: 243
Genbank ID       : AF325503.1
Unigene ID(#167) : Hs.43125
Unigene name     :        esophageal cancer related gene 4 protein   ECRG4
>gi|11991655|gb|AF325503.1|AF325503 Homo sapiens esophageal cancer related gene
 4 protein (ECRG4) mRNA, complete cds
```
GGATAACCCGCGGCCGCGCCTGCCCGCTCGCACCCCTCTCCCGCGCCCGGTTCTCCCTCGCAGCACCTCG
AAGTGCGCCCCTCGCCCTCCTGCTCGCGCCCCGCCGCCATGGCTGCCTCCCCGCGCGGCCTGCTGTCCT
GGCCCTGACCGGGCTGGCGCTGCTCCTGCTCCTGTGCTGGGGCCCAGGTGGCATAAGTGGAAATAAACTC
AAGCTGATGCTTCAAAAACGAGAAGCACCTGTTCCAACTAAGACTAAAGTGGCCGTTGATGAGAATAAAG
CCAAAGAATTCCTTGGCAGCCTGAAGCGCCAGAAGCGGCAGCTGTGGGACCGGACTCGGCCCGAGGTGCA
GCAGTGGTACCAGCAGTTTCTCTACATGGGCTTTGACGAAGCGAAATTTGAAGATGACATCACCTATTGG
CTTAACAGAGATCGAAATGGACATGAATACTATGCGGATTACTACCAACGTCACTATGATGAAGACTCTG
CAATTGGTCCCCGGAGCCCCTACGGCTTTAGGCATGGAGCCAGCGTCAACTACGATGACTACTAACCATG
ACTTGCCACACGCTGTACAAGAAGCAAATAGCGATTCTCTTCATGTATCTCCTAATGCCTTACACTACTT
GGTTTCTGATTTGCTCTATTTCAGCAGATCTTTCTACCTACTTTGGTGATCAAAAAGAAGAGTTAAAAC
AACACATGTAAATGCCTTTTGATATTTCATGGGAATGTTTAAAAATAGAAATAAAGCATTTTGTTAAAAC
GA
```

FIGURE 252
SEQ ID NO: 244
Genbank ID       : N90191
Unigene ID(#167) : Hs.23960
Unigene name     :        cyclin B1   CCNB1
>gi|1443518|gb|N90191.1|N90191  zb19a10.s1  Soares_fetal_lung_NbHL19W  Homo sapien
s cDNA clone IMAGE:302490 3', mRNA sequence
```
GTATTTGAGTATTGTTTTATTANCCAAAACACAAAACCAAATGAAAACTGGCTTAGAATATAAAATTCT
CATTTTTCAAAGTGAAAGTTTGAAGATACTAGCTAAAGTTGATAACTTAAATAGTGGTAAAAGTAAATAA
CTTAGAATTATGGCAGCAATCACAAGAAGAAACAGAAAACAGGGGACTAGGGATTCGGTGGTAGACTTT
TACTTTAAAATAGAGCTATGCAGCAGATTCTCCATGACTTGGCTTACATGCAGTATGTCCTATGGNAGTA
AAATTTTCAAATACCTCCATCACCTTCAGTAACTCATATTAATAAAAGTAAAAGGCCAGGTATATAAAAC
CAGGAACCCCAGTATATAAACCATATTACCTCCAATTTGGATCCCCCAGGTAAACCCAAAGGAGTTTTTT
```

FIGURE 252 cont'd

AAAAAATTATNCCCCACCATACCCTTTTTAAGGACAACTTTTTCCGGCTACCCNACAAA

FIGURE 253
SEQ ID NO: 245
Genbank ID       : NM_002060.1
Unigene ID(#167) : Hs.296310
Unigene name     :     gap junction protein, alpha 4, 37kDa (connexin 37) GJA4
>gi|4504002|ref|NM_002060.1| Homo sapiens gap junction protein, alpha 4, 37kDa
(connexin 37) (GJA4), mRNA
CTCCGGCCATCGTCCCCACCTCCACCTGGGCCGCCCGCGAGGCAGCGGACGGAGGCCGGGAGCCATGGGT
GACTGGGGCTTCCTGGAGAAGTTGCTGGACCAGGTCCGAGAGCACTCGACCGTGGTGGGTAAGATCTGGC
TGACGGTGCTCTTCATCTTCCGCATCCTCATCCTGGGCCTGGCCGGCGAGTCAGTGTGGGGTGACGAGCA
GTCAGATTTCGAGTGTAACACGGCCCAGCCAGGCTGCACCAACGTCTGCTATGACCAGGCCTTCCCCATC
TCCCACATCCGCTACTGGGTGCTGCAGTTCCTCTTCGTCAGCACACCCACCCTGGTCTACCTGGGCCATG
TCATTTACCTGTCTCGGCGAGAAGAGCGGCTGGCGCAGAAGGAGGGGGAGCTGCGGGCACTGCCGGCCAA
GGACCCACAGGTGGAGCGGGCGCTGGCCGGCATAGAGCTTCAGATGGCCAAGATCTCGGTGGCAGAAGAT
GGTCGCCTGCGCATTCCGCGAGCACTGATGGGCACCTATGTCGCCAGTGTGCTCTGCAAGAGTGTGCTAG
AGGCAGGCTTCCTCTATGGCCAGTGGCGCCTGTACGGCTGGACCATGGAGCCCGTGTTTGTGTGCCAGCG
AGCACCCTGCCCCTACCTCGTGGACTGCTTTGTCTCTCGCCCCACGGAGAAGACCATCTTCATCATCTTC
ATGTTGGTGGTTGGACTCATCTCCCTGGTGCTTAACCTGCTGGAGTTGGTGCACCTGCTGTGTCGCTGCC
TCAGCCGGGGGATGAGGGCACGGCAAGGCCAAGACGCACCCCCGACCCAGGGCACCTCCTCAGACCCTTA
CACGGACCAGGGTCTTCTTCTACCTCCCCGTGGCCAGGGGCCCTCATCCCCACCATGCCCCACCTACAAT
GGGCTCTCATCCAGTGAGCAGAACTGGGCCAACCTGACCACAGAGGAGAGGCTGGCGTCTTCCAGGCCCC
CTCTCTTCCTGGACCCACCCCCTCAGAATGGCCAAAAACCCCCAAGTCGTCCCAGCAGCTCTGCTTCTAA
GAAGCAGTATGTATAGAGGCCTGTGGCTTATGTCACCCAACAGAGGGGTCCTGAGAAGTCTGGCTGCCTG
GGATGCCCCCTGCCCCCTCCTGGAAGGCTCTGCAGAGATGACTGGGCTGGGGAAGCAGATGCTTGCTGGC
CATGGAGCCTCATTGCAAGTTGTTCTTGAACACCTGAGGCCTTCCTGTGGCCCACCAGGCACTACGGCTT
CCTCTCCAGATGTGCTTTGCCTGAGCACAGACAGTCAGCATGGAATGCTCTTGGCCAAGGGTACTGGGGC
CCTCTGGCCTTTTGCAGCTGATCCAGAGGAACCCAGAGCCAACTTACCCCAACCTCACCCTATGGAACAG
TCACCTGTGCGCAGGTTGTCCTCAAACCCTCTCCTCACAGGAAAAGGCGGATTGAGGCTGCTGGGTCAGC
CTTGATCGCACAGACAGAGCTTGTGCCGGATTTGGCCCTGTCAAGGGGACTGGTGCCTTGTTTTCATCAC
TCCTTCCTAGTTCTACTGTTCAAGCTTCTGAAATAAACAGGACTTGATCACAAAAAAAAAA

FIGURE 254
SEQ ID NO: 246
Genbank ID       : BF433570
Unigene ID(#167) : Hs.144479
Unigene name     :     Transcribed sequences
>gi|11445742|gb|BF433570.1|BF433570 7q55c03.x1 NCI_CGAP_Lu24 Homo sapiens cDNA
clone IMAGE:3702148 3', mRNA sequence
TTTTTAAAAAACAAAGCATGATATATTGAACAATAGTAAAATTAATTTTAATCAATTGGCATTTTCAGAA
TAATAAAAGGGCAAAAAGTGAAAAAAGAGATATTTGTGACAAAAACTGACCAAGCACTCATATTTAAATA
TTCAAGGAATGTTTACAATTCAATAACAGATGACCCAATGTAAAATGGACAATAAGCACTTCAAAATAAA
GAAAATATCTAATAACAATAAACTTATGAAAATGTTATCAAAATTAGAGAAATGGATACTAATTTAATGT
AATTTTCCAAGATGAAAAATTACTACACACTCTCCAGAATGTCTAAAATTAAAAAAAAAAAAATACCAAG
TATTGGCACGAATTTGAGCAACTGGCAATCTCACATGCTGCTGCTGTAGAATACAGNAATCTGCTACAAT
CTGCTGCTGTAGAATACAGCAAACTGCTACAATCACTTGAAATTGNG

FIGURE 255
SEQ ID NO: 247
Genbank ID       : N93197
Unigene ID(#167) : Hs.49573
Unigene name     :     CDNA FLJ44606 fis, clone BRACE2005991

FIGURE 255 cont'd

>gi|1265506|gb|N93197.1|N93197  zb27g11.s1  Soares_parathyroid_tumor_NbHPA Homo s
apiens cDNA clone IMAGE:304868 3', mRNA sequence
TTTTTTTTTCTGAAATAAGAATTGATGAGTAAGTTTATTGAAGAGCTATAGGTTAAAACCAACATTAGGT
ATATGTAACCAATACTCTAAATATGGGATACCTTCAGAAAGCATCTTTCTGTCTCCCTCTATTCCTATAT
ATTTGGTGGATGAATTTTTCACTGTTTTAGGATAAAAACAACAGGTCATATCAGGACTCTTGAACATTCTC
AGGCAATAGAATGCCCCACAGTCACTTGAAATTGTTTTTGGTGCATCTAATCCCATGTCATAATCAAAAC
TTAAGACTTGGTTTAAAGTTAAGTTGTATCTTTTCCCCGACTGAGAAGCCATGTGGGGGTGGGAAGGTGA
GGAAGGGGAGCGTCTTCTCCTTGNTCCTGGCAGCTTCTGATCCTTGTAGGGTTGCCTGTTTTCATAAGGT
TGAGTACTTCCTTGGCTTCACACAAAGGGGGCATGGGNCAGTTCACATGGCTGGGG

FIGURE 256
SEQ ID NO: 248
Genbank ID        : AA600175
Unigene ID(#167)  : Hs.443169
Unigene name      :       hypothetical protein LOC253012        LOC253012
>gi|2433800|gb|AA600175.1|AA600175  ae50g05.s1  Stratagene  lung  carcinoma 937218
Homo sapiens cDNA clone IMAGE:950360 3', mRNA sequence
TATTTTTTTTTTTTTTTTTTTTTTTTTAAAAGCAAAAACAGAATAATTTATTTGAATCCATCTTTC
CTTGAAAAAAATAAAAATAAGACTTTAATAGTCATTTCCTTAAGTGTTCACAAGTCTTCTCAAAAATACT
ACTGGTGATTGAAAAAAAAGAGAAGGCATAGTTTTGTTTTTGTGACAACCATCCTTATTACTTTGTTGTA
CAAATAACAAGATAGAAATTTGGAAATAAAATTGAAACATAAATT

FIGURE 257
SEQ ID NO: 249
Genbank ID        : AL136755.1
Unigene ID(#167)  : Hs.298312
Unigene name      :       hypothetical protein DKFZp434A1315   DKFZP434A131
>gi|12053026|emb|AL136755.1|HSM801723 Homo sapiens mRNA; cDNA DKFZp434A1315 (fr
om clone DKFZp434A1315); complete cds
GGAAAGCGCATGCGCGTCGGGCACAGCGCGTGCAGCCTCGTGCAGCTCTTCTGGTCTCCGGCGCCCGCCC
CTCAGACGTAATGTTGAATTAAAGAAAATACTTTATCAGAAGAAGATGGCCACTGCCCAGTTGCAGAGGA
CTCCCATGAGTGCACTGGTATTTCCCAATAAGATATCAACTGAACACCAGTCTTTGGTGTTAGTGAAGAG
GCTTCTAGCAGTTTCAGTATCCTGTATCACGTATTTGAGGGGAATATTCCCAGAATGCGCTTATGGAACA
AGATATCTAGATGATCTTTGTGTCAAAATACTGAGAGAAGATAAAAATTGCCCAGGATCTACACAGTTAG
TGAAATGGATGCTAGGATGTTATGATGCTTTACAGAAAAATATGTATACACAAACCCAGAAGATCCTCA
GACAATTTCAGAATGTTACCAATTCAAATTCAAATACACCAATAATGGACCACTCATGGACTTCATAAGT
AAAAACCAAAGCAACGAATCTAGCATGTTGTCTACTGACACCAAGAAAGCAAGCATTCTCCTCATTCGCA
AGATTTATATCCTAATGCAAAATCTGGGGCCTTTACCTAATGATGTTTGTTTGACCATGAAACTTTTTA
CTATGATGAAGTTACACCCCCAGATTACCAGCCTCCCGGTTTTAAGGATGGTGATTGTGAAGGAGTTATA
TTTGAAGGGGAACCTATGTATTTAAATGTGGGAGAAGTCTCAACACCTTTTCACATCTTCAAAGTAAAAG
TGACCACTGAGAGAGAACGAATGGAAATATTGACTCAACTATACTATCACCAAAACAAATAAAAACACC
ATTTCAAAAAATCCTGAGGGACAAAGATGTAGAAGATGAACAGGAGCATTATACAAGTGATGATTTGGAC
ATTGAAACTAAAATGGAAGAACAGGAAAAAAAACCCTGCATCTTCTGAACTTGAAGAACCAAGTTTAGTTT
GTGAGGAAGATGAAATTATGAGGTCTAAAGAAAGTCCAGATCTTTCTATTTCTCATTCTCAGGTTGAGCA
GTTAGTCAATAAAACATCTGAACTTGATATGTCTGAAAGCAAAACAAGAAGTGGAAAAGTCTTTCAGAAT
AAAATGGCAAATGGAAATCAACCAGTAAAATCTTCCAAAGAAAATCGGAAGAGAAGTCAACATGAATCTG
GGAGAATAGTCCTCCATCACTTTGATTCTTCTAGTCAAGAGTCAGTGCCAAAAAGGAGAAAGTTTAGTGA
ACCAAAGGAACATATATAAAAATTATTTTTGTTCTGCAGGCTTGCAGAGTTCTTCTCACCATTTAAACTG
AAGGACCCTATATTATATTTCCCTAACTCTGAAGATGTATATGTAGTTTAAAGCAGTTTGTACACTAAAA
CTAAGTTTTTGGCTGACTGTCATATTGTGGTCCTTAATCTTGAGATAAATCCAATAGAACTTTTGAATAA
AAGCAAAAGTACAAATGTCATAATTGATTCGGTAATAAGTAAAATTTCAAAATTGATTTGTTCATTACC
TACTTAATATTTCCTTTAAATATATACTAACTGTTAAGGCCCTCTAATGCCATTTTCTAAACAGTAATG
TTTACTTTGGTATTAAAATTTGGTATGGATTCACTTTTTACTTATGTTAAAATTATACCATTTAACTGGC
TCTTTTGTCATTGTGCTGTTATTAAAACAATGTTCTTCAATATTTTGACATAATGTATTAACATTTAAT
ATATAATGTACAATTTAAAAAAAAAAAAAAAAAAAAAAAAAAAAAAGGGGCGGCCGCTCTAGAGGATC FIGURE 257 cont'd

CAAGCTTACGTACAAAAAAAAAAAAAGG

FIGURE 258
SEQ ID NO: 250
Genbank ID        : AI096375
Unigene ID(#167)  : Hs.173094
Unigene name      :      KIAA1750 protein   KIAA1750
>gi|3446286|gb|AI096375.1|AI096375   qb91e08.x1   Soares_fetal_heart_NbHH19W Homo s
apiens cDNA clone IMAGE:1707494 3', mRNA sequence
ATAACAGAGATACAGGTTTTTATTTTTCCATCATGCATGCAAACTTACAACTATTTATACTGTTTAAGAA
CACAGAAATAATTGCGTTATTAACAGGGTGTCAAATTACCAAGTAGAACAACCAGTTACTAATTATTTTG
GGGAGGTTATTTTCACAGAACACAGCAACAATTTCCAAATTATTCTTCCAAAACCAGAGTTATGAGACCA
GTACAAGCTGATAACAATGCTAATGGTCACACAAGTTTCCATGTTACACAGAAAAAAGATTGACATTCT
GGTGAAGGGTCTCAAGTACCTTACCATATCAGAATTTTTGAAAGAGTTTTACAACAGAACAGTCTCTCTC
TTGTTTTGTAGATGCAAGGGAAAGGAAGCATCCCTCTCATTTCTTTTTGAGACTCCTTGTTAATTCTTAA
AACACATTTCTAAGGCCCATCTCTGGAACTTCATTAGTTAACATTAAAAGCAAAAAGCAGACCTGATGTG
ATTATGATAGTGCACCCCATCACTATCACCATCAAAAGAGACTACCAATCTCCCAAAGTAGTCACGGTTG
CATTG

FIGURE 259
SEQ ID NO: 251
Genbank ID        : NM_003277.1
Unigene ID(#167)  : Hs.505337
Unigene name      :      claudin    5    (transmembrane    protein    deleted    in
velocardiofacial syndrome)    CLDN5
>gi|4502878|ref|NM_003277.1|   Homo sapiens claudin 5 (transmembrane protein dele
ted in velocardiofacial syndrome) (CLDN5), mRNA
AGGGGACTGGGGCCAAGAGCCGGGAGCGCGGGCGCAAAGGCACCAGGGCCCGCCCAGGGCGCCGCGCAGC
ACGGCCTTGGGGGTTCTGCGGGCCTTCGGGTGCGCGTCTCGCCTCTAGCCATGGGGTCCGCAGCGTTGGA
GATCCTGGGCCTGGTGCTGTGCCTGGTGGGCTGGGGGGTCTGATCCTGGCGTGCGGGCTGCCCATGTGG
CAGGTGACCGCCTTCCTGGACCACAACATCGTGACGGCGCAGACCACCTGGAAGGGCCTGTGGATGTCGT
GCGTGGTGCAGAGCACCGGGCACATGCAGTGCAAAGTGTACGACTCGGTGCTGGCTCTGAGCACCGAGGT
GCAGGCGGCGCGGGCGCTCACCGTGAGCGCCGTGCTGCTGGCGTTCGTTGCGCTCTTCGTGACCCTGGCG
GGCGCGCAGTGCACCACCTGCGTGGCCCCGGGCCCGGCCAAGGCGCGTGTGGCCCTCACGGGAGGCGTGC
TCTACCTGTTTTGCGGGCTGCTGGCGCTCGTGCCACTCTGCTGGTTCGCCAACATTGTCGTCCGCGAGTT
TTACGACCCGTCTGTGCCCGTGTCGCAGAAGTACGAGCTGGGCGCAGCGCTGTACATCGGCTGGGCGGCC
ACCGCGCTGCTCATGGTAGGCGGCTGCCTCTTGTGCTGCGGCGCCTGGGTCTGCACCGGCCGTCCCGACC
TCAGCTTCCCCGTGAAGTACTCAGCGCCGCGGCGGCCCACGGCCACCGGCGACTACGACAAGAAGAACTA
CGTCTGAGGGCGCTGGGCACGGCCGGGCCCCTCCTGCCAGCCACGCCTGCGAGGCGTTGGATAAGCCTGG
GGAGCCCCGCATGGACCGCGGCTTCCGCCGGGTAGCGCGGCGCGCAGGCTCCTCGGAACGTCCGGCTCTG
CGCCCCGACGCGGCTCCTGGATCCGCTCCTGCCTGCGCCCGCAGCTGACCTTCTCCTGCCACTAGCCCGG
CCCTGCCCTTAACAGACGGAATGAAGTTTCCTTTTCTGTGCGCGGCGCTGTTTCCATAGGCAGAGCGGGT
GTCAGACTGAGGATTTCGCTTCCCCTCCAAGACGCTGGGGGTCTTGGCTGCTGCCTTACTTCCCAGAGGC
TCCTGCTGACTTCGGAGGGGCGGATGCAGAGCCCGGGGCCCCCACCGGAAGATGTGTACAGCTGGTCTTT
ACTCCATCGGCAGGCCCGAGCCCAGGGACCAGTGACTTGGCCTGGACCTCCCGGTCTCACTCCAGCATCT
CCCCAGGCAAGGCTTGTGGGCACCGGAGCTTGAGAGAGGGCGGGAGTGGGAAGGCTAAGAATCTGCTTAG
TAAATGGTTTGAACTCTCAAAAAAAAAAAAAAAA

FIGURE 260
SEQ ID NO: 252
Genbank ID        : H10766
Unigene ID(#167)  : Hs.23406
Unigene name      :      potassium channel tetramerisation domain containing
4      KCTD4

FIGURE 260 cont'd

>gi|875586|gb|H10766.1|H10766 ym07g09.s1 Soares infant brain 1NIB Homo sapiens
cDNA clone IMAGE:47274 3', mRNA sequence
TTTTTTTTTTGCTTTTATTTACTTTTTATTGTCATCAAGCAGTTTTCTAGGAATTTTCAGCAAAATACC
AATTCAGCTATAAGTCTAATATGAAACACAGGAACTGTGAATATAAGCTTTTGGTGCTTGCTATGGAAAA
ATCAAATCAATAGCTTTAATGTCTTCTTACAATCTCATTTTGTTTCACTATAGCTCTGTTTTAGTTAGAT
CTGCACATCTGTTTTGCTCCAGGTAGTTAATTTTGCCAGTTCAGTTTCTCTGTAGATTTTTGCCATAGGT
AGGAAAAGGGATTTTAAATATTAATAGGCCCCTTAAAATATTNCATTACCATTTTACTTAAATGCANCGA
TAGGATAATGTACATGCTTTCTTTTTTGTGGCAAATACCCAGGGCAATCTGGACTTNGAAGGACAGCTTT
AGGGNCAAATTGATTNGGCAAAGG

FIGURE 261
SEQ ID NO: 253
Genbank ID           : AF043294.2
Unigene ID(#167)     : Hs.287472
Unigene name         :        BUB1   budding   uninhibited   by   benzimidazoles   1
homolog (yeast)   BUB1
>gi|6970210|gb|AF043294.2|AF043294 Homo sapiens putative mitotic checkpoint kin
ase mRNA, complete cds
GGTTTGCCGCTGCCGGCCAGCGTCCTCTGGCCATGGACACCCCGGAAAATGTCCTTCAGATGCTTGAAGC
CCACATGCAGAGCTACAAGGGCAATGACCCTCTTGGTGAATGGGAAAGATACATACAGTGGGTAGAAGAG
AATTTTCCTGAGAATAAAGAATACTTGATAACTTTACTAGAACATTTAATGAAGGAATTTTTAGATAAGA
AGAAATACCACAATGACCCAAGATTCATCAGTTATTGTTTAAAATTTGCTGAGTACAACAGTGACCTCCA
TCAATTTTTTGAGTTTCTGTACAACCATGGGATTGGAACCCTGTCATCCCCTCTGTACATTGCCTGGGCG
GGGCATCTGGAAGCCCAAGGAGAGCTGCAGCATGCCAGTGCTGTCCTTCAGAGAGGAATTCAAAACCAGG
CTGAACCCAGAGAGTTCCTGCAACAACAATACAGGTTATTTCAGACACGCCTCACTGAAACCCATTTGCC
AGCTCAAGCTAGAACCTCAGAACCTCTGCATAATGTTCAGGTTTTAAATCAAATGATAACATCAAAATCA
AATCCAGGAAATAACATGGCCTGCATTTCTAAGAATCAGGGTTCAGAGCTTTCTGGAGTGATATCTTCAG
CTTGTGATAAAGAGTCAAATATGGAACGAAGAGTGATCACGATTTCTAAATCAGAATATTCTGTGCACTC
ATCTTTGGCATCCAAAGTTGATGTTGAGCAGGTTGTTATGTATTGCAAGGAGAAGCTTATTCGTGGGGAA
TCAGAATTTTCCTTTGAAGAATTGAGAGCCCAGAAATACAATCAACGGAGAAAGCATGAGCAATGGGTAA
ATGAAGACAGACATTATATGAAAAGGAAAGAAGCAAATGCTTTTGAAGAACAGCTATTAAAACAGAAAAT
GGATGAACTTCATAAGAAGTTGCATCAGGTGGTGGAGACATCCCATGAGGATCTGCCCGCTTCCCAGGAA
AGGTCCGAGGTTAATCCAGCACGTATGGGGCCAAGTGTAGGCTCCCAGCAGGAACTGAGAGCGCCATGTC
TTCCAGTAACCTATCAGCAGACACCAGTGAACATGGAAAAGAACCCAAGAGAGGCACCTCCTGTTGTTCC
TCCTTTGGCAAATGCTATTTCTGCAGCTTTGGTGTCCCCAGCCACCAGCCAGAGCATTGCTCCTCCTGTT
CCTTTGAAAGCCCAGACAGTAACAGACTCCATGTTTGCAGTGGCCAGCAAAGATGCTGGATGTGTGAATA
AGAGTACTCATGAATTCAAGCCACAGAGTGGAGCAGAGATCAAAGAAGGGTGTGAAACACATAAGGTTGC
CAACACAAGTTCTTTTCACACAACTCCAAACACATCACTGGGAATGGTTCAGGCAACGCCATCCAAAGTG
CAGCCATCACCCACCGTGCACACAAAAAGAAGCATTAGGTTTCATCATGAATATGTTTCAGGCTCCTACAC
TTCCTGATATTTCTGATGACAAAGATGAATGGCAATCTCTAGATCAAAATGAAGATGCATTTGAAGCCCA
GTTTCAAAAAAATGTAAGGTCATCTGGGGCTTGGGGAGTCAATAAGATCATCTCTTCTTTGTCATCTGCT
TTTCATGTGTTTGAAGATGGAAACAAAGAAATTATGGATTACCACAGCCTAAAAATAAACCCACAGGAG
CCAGGACCTTTGGAGAACGCTCTGTCAGCAGACTTCCTTCAAAAACCAAAGGAGGAAGTGCCTCATGCTGA
AGAGTTTTTGGATGACTCAACTGTATGGGGTATTCGCTGCAACAAAACCCTGGCACCCAGTCCTAAGAGC
CCAGGAGACTTCACATCTGCTGCACAACTTGCGTCTACACCATTCCACAAGCTTCCAGTGGAGTCAGTGC
ACATTTTAGAAGATAAAGAAAATGTGGTAGCAAAACAGTGTACCCAGGCGACTTTGGATTCTTGTGAGGA
AAACATGGTGGTGCCTTCAAGGGATGGAAAATTCAGTCCAATTCAAGAGAAAAGCCCAAACAGGCCTTG
TCGTCTCACATGTATTCAGCATCCTTACTTCGTCTGAGCCAGCCTGCTGCAGGTGGGGTACTTACCTGTA
AGGCAGAGTTGGGCGTTGAGGCTTGCAGACTCACAGACACTGACGCTGCCATTGCAGAAGATCCACCAGA
TGCTATTGCTGGGCTCCAAGCAGAATGGATGCAGATGAGTTCACTTGGGACTGTTGATGCTCCAAACTTC
ATTGTTGGGAACATGGGATGATAAGCTGATTTTCAAACTTTTATCTGGGCTTTCTAAACCAGTGAGTT
CCTATCCAAATACTTTTGAATGGCAATGTAAACTTCCAGCCATCAAGCCCAAGACTGAATTTCAATTGGG
TTCTAAGCTGGTCTATGTCCATCACCTTCTTGGAGAAGGAGCCTTTGCCCAGGTGTACGAAGCTACCCAG
GGAGATCTGAATGATGCTAAAAATAAACAGAAATTTGTTTTAAAGGTCCAAAAGCCTGCCAACCCCTGGG
AATTCTACATTGGGACCCAGTTGATGGAAAGACTAAAGCCATCTATGCAGCACATGTTTATGAAGTTCTA
TTCTGCCCACTTATTCCAGAATGGCAGTGTATTAGTAGGAGAGCTCTACAGCTATGGAACATTATTAAAT
GCCATTAACCTCTATAAAAATACCCCTGAAAAAGTGATGCCTCAAGGTCTTGTCATCTCTTTTGCTATGA
GAATGCTTTACATGATTGAGCAAGTGCATGACTGTGAAATCATTCATGGAGACATTAAACCAGACAATTT

FIGURE 261 cont'd

CATACTTGGAAACGGATTTTTGGAACAGGATGATGAAGATGATTTATCTGCTGGCTTGGCACTGATTGAC
CTGGGTCAGAGTATAGATATGAAACTTTTTCCAAAAGGAACTATATTCACAGCAAAGTGTGAAACATCTG
GTTTTCAGTGTGTTGAGATGCTCAGCAACAAACCATGGAACTACCAGATCGATTACTTTGGGGTTGCTGC
AACAGTATATTGCATGCTCTTTGGCACTTACATGAAAGTGAAAAATGAAGGAGGAGAGTGTAAGCCTGAA
GGTCTTTTTAGAAGGCTTCCTCATTTGGATATGTGGAATGAATTTTTTCATGTTATGTTGAATATTCCAG
ATTGTCATCATCTTCCATCTTTGGATTTGTTAAGGCAAAAGCTGAAGAAAGTATTTCAACAACACTATAC
TAACAAGATTAGGGCCCTACGTAATAGGCTAATTGTACTGCTCTTAGAATGTAAGCGTTCACGAAAATAA
AATTTGGATATAGACAGTCCTTAAAAAAAAAAAAAAAAAAAA

FIGURE 262
SEQ ID NO: 254
Genbank ID         : AW006409
Unigene ID(#167)   : Hs.239458
Unigene name       :        histone 1, H3d      HIST1H3D
>gi|5855187|gb|AW006409.1|AW006409  wr16c05.x1  NCI_CGAP_Pr22  Homo  sapiens cDNA c
lone IMAGE:2481704 3', mRNA sequence
GAAGACACGAATGGAAGAATTTATATTTTAAATGAAAATCAAGAAGTTGTCCCTCTGAACTGTGAATCTC
TGAAAGTTGGAACTTTTGATAAAGGCCGAGGCTGCCTTAAGTAAAAACTAGAGAAGAAAATGTAAAGAT
CATAACACCGTAGCCGTTCCAGTTCATTGTAGAATAGAATTGGTGTGATTCCTCCTCAGGAAATTTAAAC
TATTTTGATTTTCTGAATTTTCCGCANACACAACTCAGAAACAGGGTTGAGACTAGGTTGCTGCCAAGCTG
AAAGACTGAGCTGGGAACCAATCAGCGCGCAGCGTGTCTGTGTGTGACACACACGTAATCACAGACACAC
TCGCAGCCTGACTTTTTTTTTTTTTAACTGTTAGATATCCAAACCTACAATCATGTCCGAAACTGTACAT
GCCGTGACTCCTGGTCTATCTCCCAAGTCAAAGACTGAAGTAAAGAAAAAGGTTGCAAGTCCGAAGTTGC
AGTGAAGTGCAAGATGTCCAGGCCC

FIGURE 263
SEQ ID NO: 255
Genbank ID         : BE045392
Unigene ID(#167)   : acc_BE045392
Unigene name       :
>gi|8362530|gb|BE045392.1|BE045392  hh21b02.x1  NCI_CGAP_Lu24  Homo  sapiens cDNA c
lone IMAGE:2955723 3', mRNA sequence
TGATGGTTTACATGTTTTATTTTTACCTGGCAAAAGGTAGCGTAGAAATAAGGGATTTAGGTTTTGACTA
GGATCAGATGAAACTGGGCAGCCTTCANTAATTCACTTCACAAACATGCAAATCCAACAAAAGTTCCTGG
AAATTCAGTCTTCAAGGAGCTTATTGTCTANTGGAAGACAAACAGTTAAAATCCCATATGGTAAATTCTA
TAAAAGTGGGAGGCAAAGGCTGCTGAAGGAGTGTGGAAAGGAAACACACAACACACAANCCCAAATAAGA
GAAGCAGCTTCCCAGAAGGTCATAATTATAATGTAATTATCCACTGAATCTCATCCTAAAGGAAAAGGG
TCTGTTGGGCAAAACAAANCTTGNTGATGGGGAACTATATTCTTAGCTAAAGAAGCACTACTATACATTC
AGAGAATCAAGAAAAAGCATAATAGATCTAAGAAATTACAAGTATTTCA

FIGURE 264
SEQ ID NO: 256
Genbank ID         : AB040812.1
Unigene ID(#167)   : Hs.32539
Unigene name       :        p21(CDKN1A)-activated kinase 7       PAK7
>gi|7649809|dbj|AB040812.1|  Homo  sapiens  mRNA  for  protein  kinase  PAK5, complete
 cds
GGCGCTGGGAGCGCTGTAGCAGCTGAGAAGGGGCTGAGGCACCGCCGCTTCGCTGACAGCCGGCCACCAG
GTTTCTGTCTCCCAGTATAATCATATCCAGCCCCATGGCTCTTACTGGGGCCTCTGAAATGTTTATCACC
AAATCTGTGTCTGCAGTTCCAACCTCTTCCCTGAGCATCAAAGCTGTATTTCAACTTTCGCTGGATGCT
TCTATCTGGAAATACACTGTGGTGAAATGCTTCCACCTCTTGCTAAAATGAACACTGAGGAAAAATGAAG
AAGACTGACAAGCACCAGCGAAAGTTGCAGAATAGAAATAGCCACACTCCTCTGGAGTCTTTAATTCAT
CCACAGCCATCATATAAAGGTTTTGGCATCATGTTTGGAAGAAAAGAAAAAGATTGAAATATCTGGCC
CGTCCAACTTTGAACACAGGGTTCATACTGGGTTTGATCCACAAGAGCAGAAGTTTACCGGCCTTCCCCA FIGURE 264 cont'd

```
GCAGTGGCACAGCCTGTTAGCAGATACGGCCAACAGGCCAAAGCCTATGGTGGACCCTTCATGCATCACA
CCCATCCAGCTGGCTCCTATGAAGACAATCGTTAGAGGAAACAAACCCTGCAAGGAAACCTCCATCAACG
GCCTGCTAGAGGATTTTGACAACATCTCGGTGACTCGCTCCAACTCCCTAAGGAAAGAAAGCCCACCCAC
CCCAGATCAGGGAGCCTCCAGCCACGGTCCAGGCCACGCGGAAGAAAATGGCTTCATCACCTTCTCCCAG
TATTCCAGCGAATCCGATACTACTGCTGACTACACGACCGAAAAGTACAGGGAGAAGAGTCTCTATGGAG
ATGATCTGGATCCGTATTATAGAGGCAGCCACGCAGCCAAGCAAAATGGGCACGTAATGAAAATGAAGCA
CGGGGAGGCCTACTATTCTGAGGTGAAGCCTTTGAAATCCGATTTTGCCAGATTTTCTGCCGATTATCAC
TCACATTTGGACTCACTGAGCAAACCAAGTGAATACAGTGACCTCAAGTGGGAGTATCAGAGAGCCTCGA
GTAGCTCCCCTCTGGATTATTCATTCCAATTCACACCTTCTAGAACTGCAGGGACCAGCGGGTGCTCCAA
GGAGAGCCTGGCGTACAGTGAAAGTGAATGGGGACCCAGCCTGGATGACTATGACAGGAGGCCAAAGTCT
TCGTACCTGAATCAGACAAGCCCTCAGCCCACCATGCGGCAGAGGTCCAGGTCAGGCTCGGGACTCCAGG
AACCGATGATGCCATTTGGAGCAAGTGCATTTAAAACCCATCCCCAAGGACACTCCTACAACTCCTACAC
CTACCCTCGCTTGTCCGAGCCCACAATGTGCATTCCAAAGGTGGATTACGATCGAGCACAGATGGTCCTC
AGCCCTCCACTGTCAGGGTCTGACACCTACCCCAGGGGCCCTGCCAAACTACCTCAAAGTCAAAGCAAAT
CGGGCTATTCCTCAAGCAGTCACCAGTACCGTCTGGGTACCACAAAGCCACCTTGTACCATCACCCCTC
CCTGCAGAGCAGTTCGCAGTACATCTCCACGGCTTCCTACCTGAGCTCCCTCAGCCTCTCATCCAGCACC
TACCCGCCGCCCAGCTGGGCTCCTCCTCCGACCAGCAGCCCTCCAGGGTGTCCCATGAACAGTTTCGGG
CGGCCCTGCAGCTGGTGGTCAGCCCAGGAGACCCCAGGGAATACTTGGCCAACTTTATCAAAATCGGGGA
AGGCTCAACCGGCATCGTATGCATCGCCACCGAGAAACACACAGGGAAACAAGTTGCAGTGAAGAAAATG
GACCTCCGGAAGCAACAGAGACGAGAACTGCTTTTCAATGAGGTCGTGATCATGCGGGATTACCACCATG
ACAATGTGGTTGACATGTACAGCAGCTACCTTGTCGGCGATGAGCTCTGGGTGGTCATGGAGTTTCTAGA
AGGTGGTGCCTTGACAGACATTGTGACTCACACCAGAATGAATGAAGAACAGATAGCTACTGTCTGCCTG
TCAGTTCTGAGAGCTCTCTCCTACCTTCATAACCAAGGAGTGATTCACAGGGACATAAAAGTGACTCCA
TCCTCCTGACAAGCGATGGCCGGATAAAGTTGTCTGATTTTGGTTTCTGTGCTCAAGTTCCAAAGAGGT
GCCGAAGAGGAAATCATTGGTTGGCACTCCCTACTGGATGGCCCCTGAGGTGATTTCTAGGCTACCTTAT
GGGACAGAGGTGGACATCTGGTCCCTCGGGATCATGGTGATAGAAATGATTGATGGCGAGCCCCCCTACT
TCAATGAGCCTCCCCTCCAGGCGATGCGGAGGATCCGGGACAGTTTACCTCCAAGAGTGAAGGACCTACA
CAAGGTTTCTTCAGTGCTCCGGGGATTCCTAGACTTGATGTTGGTGAGGGAGCCCTCTCAGAGAGCAACA
GCCCAGGAACTCCTCGGACATCCATTCTTAAAACTAGCAGGTCCACCGTCTTGCATCGTCCCCCTCATGA
GACAATACAGGCATCACTGAGCAGAGGATTCGTGTAGGTGGCAAAGCTAGATGAGGACATGAGAATAATT
CAGGAGAACAAAAGGAAACACAGAACATGCAAAAGGCCTGTGCATTCTAGACCAGCCAATTGGTGGGACA
GCGTGATGACCGGCAGGGTTCAACAGACCAGGGCATCTTCTTGTGTCTTAAACAGGCATCTCTCCACTGA
CAGCCGGTGTGGTCACTTGGAGCACGGCTTTAATAAGTCATTATTATATTTTTCAGCCCTTCATCCAGCA
AATCAGAAGGACTCAGTACAAACTCCGTTATGATATATCCTAGCCACATGCAGGGTAACATGTAGGATTT
TCTATATTGAAAGAATACTTTTCTGGCAAAAAAAAAAAAAAAGAAAGAAAGGAAAACAAAAAGCACTTT
TTTCTTAATGGTAGCAGTATAATGTATTTTGCAACGAATTTGTAATTTTTCTGTACGATAGTTTTGATAA
TTTATAGTACTTTGATGTCATGTAGCCATTGTATCAGTTGAAGTAATACTTGTTTACTAGAGGAGTTTGA
ACAAAGCCTTTCCTACTTTTTATCCCTTTAAGAGAACCAATGATTCTTTAGGAACTTTGAATACTGAAT
GACTCTCAATCACCGTCAGCTTTAGTAAAATCTCTTTCTTATCCTAACAAGTGTCTTATTGGTGGAAGA
AGAATTAAGAGTGATGGTGATGGTGTGCACGTTTCATTAATCCAACCAAAAATAATGAAATAAAATTTGA
GCCACAGTATACCACTCCTTGGGATAAAGTTAAATATTTTAAAGATCACATTTTCCATGAACGCCTCTA
GTAGCAAACCATTCTTTTGCACACCACAATGTTTCCCTCAGTGCCCTTTCTCAAATGGGTACAATGTTCC
CTTGTGGCCAAATTTCCCTCCCAGGGAGCAATTTCAGTGCTAGGATCATTGGATTCAGTTCCCAAAATAG
AATGTTTCAGTGAGACCATGAGAATTCCAGGCTCACAAAGGGAGAGGAGAGAACAGGGCAAGACGTTTGG
TTTCATTTGTCACCATTTTTAAAACTCTGTATGCTAGCACACCAAACTCTTGTCTATATTTACCTTTGTA
CCACAGTATTAATCGCTATTGTTCATGTATCGTGCTGGAAGTCTGAACTGACTCTAGAGGATGAATTAGC
AAGAGGGTATTTTACCAGGTATGATCTGACTTCAGTTGTGCCCATGTTATAATGTGTTTCCGACATAGGA
GAGTCGTGCTGCTGTCTAGATCTTCTTGAATGTTGATAAAAATGAATGACTACTACAATACATTTTGTGT
TGCTTGTTGGATGAATTTGCATGTTAACTGTAGGCCAATATAGATTTGCCTTTAAAACTCTGGAAGAGCT
ACATAGTCATCATTAGTTTCTATTAATTATGCATCAGACAAAAGCCATTTGTTACCAAACTGGGAAAACA
GAGGCTTTTCTTAACTATTTCACATACTGTAACAAATATGAATTTAAATTTGTGATAGCGCTCTGGTTGC
TCTAAGCATAATTAAGAATTTTTGTAATTAATAGGTTGCTAATTATTTATCACTGCTAAAAAGGAAAAAA
GGCATAAAATGACCTTCTACTGATTAGATTTTCAGTTTTCTTTCAAACTGGAAATGCCTCCATAAATATG
ATCTATGATTTTGCTTCATAAAACAGCAAATCAATGTTTTATGTAAAATATTAAAGCATTAATATAAATA
TGTGAGAATAAAAACAATCTAAATCCAGAAAATGGCAGTCCTAAATGTTCATGAGACAGATTGTATTAAT
TTAACCAGGACTATGTAGAAGTAGAAAGAAAAGAAAAAGAAATCTTTTTTAAACCAGAATAAACATTAA
AAACTATTGCAGAAAATAGTGGATTTTGGATTCCAAACATTTTCGACAGTGTAATGGAAATTTTTCTGTA
ATTTTCTTACCATCGGGTATTTTTAAAGTATTCATTGAGTTTACCAAAAGTTACTGTAGCTTAAAAGGT
TTTGTGAGCACTAACTATTGGCAGAAACTGCATTTGCAAATAAAAATAAATGTTTGCCTTTT
```

FIGURE 265
SEQ ID NO: 257
```
Genbank ID         : BF973178
Unigene ID(#167)   : Hs.122552
Unigene name       :       G-2 and S-phase expressed 1     GTSE1
>gi|12340304|gb|BF973178.1|BF973178   602241428F1   NIH_MGC_46   Homo   sapiens
cDNA cl
one IMAGE:4330015 5', mRNA sequence
GCTGGAGTGCAGTGGCACAATCACAGCCCACTGCAGCCTGCATCTCCTTGAGCTCAGGCCATCCTCCCAC
TTCAGCCTCCCAAGTAGCTGGGAGGCTTGAGCCCAGGACTATAAGACCAGACCAGCCTGGGCAACATAGG
GAAACCCTGTCTCTATATACAGTAGTTCGCCTGGAGCCACAGCTACCTGGGAGGCTGAGTTTGGGAGGAG
TGGGGAATCCACGTTCTCCTTGTCAGCCTCAGGGCTCAGCTGGATCAGAGGGGAGCTCAGGTCTATGAGC
TGTCCCACCACCGGTGAAGGTTTGGCCACATTTTTATTCATGTCTGGAGTGTTTGTCATGAGGTCGATCA
GAGGCCTGCTTTCAGATCCTACAGCCACGTGTGCTTCTGGGGTATCGCAGAAGTCGATGAGAGGAAGGTC
AATGAGGGGCTGGCTTGCAGCATCTGGAGTGACCGCGAGTGGTTCCAGTTTGATATCTACAAGAAGAGCC
TCACTAGGGGCTGCATCTCCACCCGGCTTGGCTTCCTCCCGAGCTACTTCTGTGGCAGTACTTTTGGAGA
ACAGTAGAATCGCTTTCCTCTGGAGAAAAGTTAAGTGCCTGAGGCACACGGGAAGGAGGAGAACCCCTGT
CAGGGAGACACATCCACCAGCCTGGCAATCTGTCTATCTGTGTGCTCTCCCCTTGTAGGTTCAGTACTCA
TTGCAGAGTACTTGCGGGGCTCAGAGGACCGTCTCCGAACTTGGACAACCCAGGGAGAAGCCACGACCTG
GGAATCGAACGGGGGCCATCGGGGAACGCAGAACACCGCGTGGGAATCATGATGAGGTCCGCGTATCCAG
ACCGGTGGACACACAGGTGGGAGACCCACGGAAAGCCCACGGAGTTAAACTGTGCTCAAAGTGCCCCCTA
TCCCTTGTGGTGTGCACCCCAGGAGGGTTCCAACCGGCGGCCTTCAACCCGCCAGGCTGTGAACAACAG
AAAACGACATGACACCCCGAGGGCCCAAGATTCACAGTGTTGTAGATGGCCCCCGAGCATACCACCATTC
AAAGGCAACACTGCTATGAGAGAACCACGAAAAGGGCGGCACCACGGCTGGAGAACAACAGCGA
```

FIGURE 266
SEQ ID NO: 258
```
Genbank ID         : AA918317
Unigene ID(#167)   : Hs.57987
Unigene name       :     B-cell   CLL/lymphoma   11B    (zinc   finger   protein)
      BCL11B
>gi|3058207|gb|AA918317.1|AA918317    ol42c06.s1    Soares_NFL_T_GBC_S1   Homo
sapiens
cDNA clone IMAGE:1526122 3', mRNA sequence
TACTTAAAGTAAATGTGGCTTTGTTAGTTTCTAAAGAATGTACTTTTCTTGTTTTACTTTTTTAAAAAGT
CTTTTCATTTCAAAAAAAAAGTTTTGCATTTGTCTCAAGAGACTCAAATAGGAAGATCAGTTTTCAAGGC
ACTCACATCAAATTGAATGGCAGTAGAAAAACTGTCCTATAAATTATTATTTTATTTTGTTCTTTATAGT
GCCAGTATTGTGAATGCCACGCTTAGCAATACTGACACTCAATCTCAGCTGTCCCTTACAGTTTAACCCA
CCTCTGGGCCAAAGAGAAGAATATGCTGCAATTTCTTGTTTAGAAGCCATTTAATTTAAATGCAAACAAA
AGCTTTAAAGTGCGGGTCAACAGAATTCAAATGTCTAATCTTAACAGTTCAATATTTAGTACCTTCCAAC
CTAATGAGATACGAAAAAAAAAATAAAAACCTGGGAAGTAGCGCTGGGCACCTTCTGATGGAACTCATCC
CCTGCTTTTTCAGT
```

FIGURE 267
SEQ ID NO: 259
```
Genbank ID         : NM_002600.1
Unigene ID(#167)   : Hs.188
Unigene name       :      phosphodiesterase        4B,        cAMP-specific
(phosphodiesterase E4 dunce homolog, Drosophila)      PDE4B
>gi|4505662|ref|NM_002600.1|   Homo   sapiens   phosphodiesterase   4B,   cAMP-
specific (
phosphodiesterase E4 dunce homolog, Drosophila) (PDE4B), mRNA
GAATTCCTCCTCTCTTCACCCCGTTAGCTGTTTTCAATGTAATGCTGCCGTCCTTCTCTTGCACTGCCTT
CTGCGCTAACACCTCCATTCCTGTTTATAACCGTGTATTTATTACTTAATGTATATAATGTAATGTTTTG
TAAGTTATTAATTTATATATCTAACATTGCCTGCCAATGGTGGTGTTAAATTTGTGTAGAAAACTCTGCC
TAAGAGTTACGACTTTTTCTTGTAATGTTTTGTATTGTGTATTATATAACCCAAACGTCACTTAGTAGAG
ACATATGGCCCCCTTGGCAGAGAGGACAGGGGTGGGCTTTTGTTCAAAGGGTCTGCCCTTTCCCTGCCTG
AGTTGCTACTTCTGCACAACCCCTTTATGAACCAGTTTTCACCCGAATTTTGACTGTTTCATTTAGAAGA
```

FIGURE 267 cont'd

```
AAAGCAAAATGAGAAAAAGCTTTCCTCATTTCTCCTTGAGATGGCAAAGCACTCAGAAATGACATCACAT
ACCCTAAAGAACCCTGGGATGACTAAGGCAGAGAGAGTCTGAGAAAACTCTTTGGTGCTTCTGCCTTTAG
TTTTAGGACACATTTATGCAGATGAGCTTATAAGAGACCGTTCCCTCCGCCTTCTTCCTCAGAGGAAGTT
TCTTGGTAGATCACCGACACCTCATCCAGGCGGGGGGTTGGGGGGAAACTTGGCACCAGCCATCCCAGGC
AGAGCACCACTGTGATTTGTTCTCCTGGTGGAGAGAGCTGGAAGGAAGGAGCCAGCGTGCAAATAATGAA
GGAGCACGGGGGCACCTTCAGTAGCACCGGAATCAGCGGTGGTAGCGGTGACTCTGCTATGGACAGCCTG
CAGCCGCTCCAGCCTAACTACATGCCTGTGTGTTTGTTTGCAGAAGAATCTTATCAAAATTAGCAATGG
AAACGCTGGAGGAATTAGACTGGTGTTTAGACCAGCTAGAGACCATACAGACCTACCGGTCTGTCAGTGA
GATGGCTTCTAACAAGTTCAAAAGAATGCTGAACCGGGAGCTGACACACCTCTCAGAGATGAGCCGATCA
GGGAACCAGGTGTCTGAATACATTTCAAATACTTTCTTAGACAAGCAGAATGATGTGGAGATCCATCTC
CTACCCAGAAAGACAGGGAGAAAAGAAAAAGCAGCAGCTCATGACCCAGATAAGTGGAGTGAAGAAATT
AATGCATAGTTCAAGCCTAAACAATACAAGCATCTCACGCTTTGGAGTCAACACTGAAAATGAAGATCAC
CTGGCCAAGGAGCTGGAAGACCTGAACAAATGGGGTCTTAACATCTTTAATGTGGCTGGATATTCTCACA
ATAGACCCCTAACATGCATCATGTATGCTATATTCCAGGAAAGAGACCTCCTAAAGACATTCAGAATCTC
ATCTGACACATTTATAACCTACATGATGACTTTAGAAGACCATTACCATTCTGACGTGGCATATCACAAC
AGCCTGCACGCTGCTGATGTAGCCCAGTCGACCCATGTTCTCCTTTCTACACCAGCATTAGACGCTGTCT
TCACAGATTTGGAGATCCTGGCTGCCATTTTTGCAGCTGCCATCCATGACGTTGATCATCCTGGAGTCTC
CAATCAGTTTCTCATCAACACAAATTCAGAACTTGCTTTGATGTATAATGATGAATCTGTTGGAAAAT
CATCACCTTGCTGTGGGTTTCAAACTGCTGCAAGAAGAACACTGTGACATCTTCATGAATCTCACCAAGA
AGCAGCGTCAGACACTCAGGAAGATGGTTATTGACATGGTGTTAGCAACTGATATGTCTAAACATATGAG
CCTGCTGGCAGACCTGAAGACAATGGTAGAAACGAAGAAAGTTACAAGTTCAGGCGTTCTTCTCCTAGAC
AACTATACCGATCGCATTCAGGTCCTTCGCAACATGGTACACTGTGCAGACCTGAGCAACCCCACCAAGT
CCTTGGAATTGTATCGGCAATGGACAGACCGCATCATGGAGGAATTTTTCCAGCAGGGAGACAAAGAGCG
GGAGAGGGGAATGGAAATTAGCCCAATGTGTGATAAACACACAGCTTCTGTGGAAAAATCCCAGGTTGGT
TTCATCGACTACATTGTCCATCCATTGTGGGAGACATGGGCAGATTTGGTACAGCCTGATGCTCAGGACA
TTCTCGATACCTTAGAAGATAACAGGAACTGGTATCAGAGCATGATACCTCAAAGTCCCTCACCACCACT
GGACGAGCAGAACAGGGACTGCCAGGGTCTGATGGAGAAGTTTCAGTTTGAACTGACTCTCGATGAGGAA
GATTCTGAAGGACCTGAGAAGGAGGGAGAGGGACACAGCTATTTCAGCAGCACAAAGACGCTTTGTGTGA
TTGATCCAGAAAACAGAGATTCCCTGGGAGAGACTGACATAGACATTGCAACAGAAGACAAGTCCCCCGT
GGATACATAATCCCCCTCTCCCTGTGGAGATGAACATTCTATCCTTGATGAGCATGCCAGCTATGTGGTA
GGGCCAGCCCACCATGGGGGCCAAGACCTGCACAGGACAAGGGCCACCTGGCCTTTCAGTTACTTGAGTT
TGGAGTCAGAAAGCAAGACCAGGAAGCAAATAGCAGCTCAGGAAATCCCACGGTTGACTTGCCTTGATGG
CAAGCTTGGTGGAGAGGGCTGAAGCTGTTGCTGGGGGCCGATTCTGATCAAGACACATGGCTTGAAAATG
GAAGACACAAAACTGAGAGATCATTCTGCACTAAGTTTCGGGAACTTATCCCCGACAGTGACTGAACTCA
CTGACTAATAACTTCATTTATGAATCTTCTCACTTGTCCCTTTGTCTGCCAACCTGTGTGCCTTTTTGT
AAAACATTTTCATGTCTTTAAAATGCCTGTTGAATACCTGGAGTTTAGTATCAACTTCTACACAGATAAG
CTTTCAAAGTTGACAAACTTTTTTGACTCTTTCTGGAAAAGGGAAAGAAAATAGTCTTCCTTCTTTCTTG
GGCAATATCCTTCACTTTACTACAGTTACTTTTGCAAACAGACAGAAAGGATACACTTCTAACCACATTT
TACTTCCTTCCCCTGTTGTCCAGTCCAACTCCACAGTCACTCTTAAAACTTCTCTCTGTTTGCCTGCCTC
CAACAGTACTTTTAACTTTTTGCTGTAAACAGAATAAAATTGAACAAATTAGGGGGTAGAAAGGAGCAGT
GGTGTCGTTCACCGTGAGAGTCTGCATAGAACTCAGCAGTGTGCCCTGCTGTGTCTTGGACCCTGCCCCC
CACAGGAGTTGCTACAGTCCCTGGCCCTGCTTCCCATCCTCCTCTCTTCACCCCGTTAGCTGTTTTCAAT
GTAATGCTGCCGTCCTTCTCTTGCACTGCCTTCTGCGCTAACACCTCCATTCCTGTTTATAACCGTGTAT
TTATTACTTAATGTATATAATGTAATGTTTTGTAAGTTATTAATTTATATATCTAACATTGCCTGCCAAT
GGTGGTGTTAAATTTGTGTAGAAAACTCTGCCTAAGAGTTACGACTTTTTCTTGTAATGTTTTGTATTGT
GTATTATATAACCCAAACGTCACTTAGTAGAGACATATGGCCCCCTTGGCAGAGAGGACAGGGGTGGGCT
TTTGTTCAAAGGGTCTGCCCTTTCCCTGCCTGAGTTGCTACTTCTGCACAACCCCTTTATGAACCAGTTT
TGGAAACAATATTCTCACATTAGATACTAAATGGTTTATACTGAGTCTTTTACTTTTGTATAGCTTGATA
GGGGCAGGGGCAATGGGATGTAGTTTTTACCCAGGTTCTATCCAAATCTATGTGGGCATGAGTTGGGTTA
TAACTGGATCCTACTATCATTGTGGCTTTGGTTCAAAAGGGAAACACTACATTTGCTCACAGATGATTCTT
CTGATTCTTCTGAATGCTCCCGAACTACTGACTTTGAAGAGGTAGCCTCCTGCCTGCCATTAAGCAGGAA
TGTCATGTTCCAGTTCATTACAAAAGAAAACAATAAAACAATGTGAATTTTTATAATAAAAAAAAAAAAA
AGGAATTC
```

FIGURE 268
SEQ ID NO: 260
Genbank ID       : AL120674
Unigene ID(#167) : acc_AL120674
Unigene name     :

FIGURE 268 cont'd

>gi|5926573|gb|AL120674.1|AL120674 DKFZp762A0410_r1 762 (synonym: hme12)
Homo s
apiens cDNA clone DKFZp762A0410 5', mRNA sequence
CTTATTTCTTTTAAATATTTTATTTAAAATTTTTAATTAACATTTTGTTTGCTTAATGCTTTTGTTATGA
ATCAATTAAAATTCTTTATTTTATACAACTAAATCTGATTTTAATTATTTTATTATGAAAATAGTATATG
TTAAATAAAATTCAGATAATACAGAAATAGAGATTGCCAAAAGAAGAGGCTTCCCGGCCGGGCGCGGTGG
CTTACGCCTGTAATCCCAGCACTTTGGGAGGCCGAGGCGGGTGGATCATGAGGTCAGGAGATCGAGACCA
TCCTGGCTAACAAGGTGAAACCCCGTCTCTACTAAAAATACAAAAAATTAGCCGGGCGCGGTGGCGGGCG
CCTGTGGTCCCAGCTACTCGGGAGGCTGAGGCAGGAAAATGGCGTGAACCCGGGAGGCGGAGCTTGCAGT
GAGCCGAGATTGCGCCACTGCAGTCCGCAGTCCGGCCTGGGCGACAGAGCGAGACTCCGT

FIGURE 269
SEQ ID NO: 261
Genbank ID      : AI949827
Unigene ID(#167) : Hs.404741
Unigene name    :       nuclear    factor    (erythroid-derived    2)-like    3
        NFE2L3
>gi|5742137|gb|AI949827.1|AI949827 wq14c11.x1 NCI_CGAP_Kid12 Homo sapiens
cDNA
clone IMAGE:2471252 3', mRNA sequence
TTTTTTTTAACAGTTCTTGGGAAACTTTATTATAAAAATCCAACGGTATATATAAACTGCATTTCTCTAG
CCCAAGATACTTATGTGATACTCTACACTGTAGCTCCTATGGCAGAAATAATATCTGAGAAACTTCATTT
TGAAAATTTGGACATATATTAAGCATTATAGTACCCGTCAAAATCTTGATGTTCCCCAAACTTGAGTCATCT
AGGTGAGGTCATTGCTGTCTTCAAAAAATTCAGCAATCTCCTGTTTACTGTTCTAGTGAACTTAAGTGAG
GTTTTCATTTCAAATGCTATTATTTCTAGAATTTACCTTACCCTGGTTTATTTTCAAATTCACCTGTTTT
TTTTCCCTTAATCGCTTTTGCCCATTTTAAACAGATGGTTTCACTGTTGCTGACTCTTTCCCTACTGTTT
ATATGGCTTACAGTGTTCTGGTGAGATCTCAGTATTCTAAGATGGTGAGGCCATCCCTTCAGGCTGGCTT
TAC

FIGURE 270
SEQ ID NO: 262
Genbank ID      : NM_020956.1
Unigene ID(#167) : Hs.205457
Unigene name    :       periaxin    PRX
>gi|13491171|ref|NM_020956.1| Homo sapiens periaxin (PRX), mRNA
GCTCTCGAGGTGTCTGGAGGCTCAGCGAGCGCCGGACCCAGGAGGCCCAAGGAGCTGGAGGTGACCCTCA
GGCAGCAAGAACCCCACGGAAGGGCGTGAGCCCTGCAGACAGCTGTGCGGCACCTCGGGCTGGGCTCCTG
TTAGGAGGAAGTGCCTGCACCCAGGCAGCGGCTCAGAGGCAGCTGCTCCATGCAGAACTGAAGCTGGTTC
TGCAGCAGAAAGGGGAGAGGACACAGGAGCCTGGGGTGCAGGTGCCTCCAGCAACGCCATGGAGGCCAG
GAGCCGGAGTGCCGAGGAGCTGAGGCGGGCGGAGTTGGTGGAAATTATCGTGGAGACGGAGGCGCAGACC
GGGGTCAGCGGCATCAACGTAGCGGGCGGCGGCAAAGAGGGAATCTTCGTTCGGGAGCTGCGCGAGGACT
CACCCGCCGCCAGGAGCCTCAGCCTGCAGGAAGGGGACCAGCTGCTGAGTGCCCGAGTGTTCTTCGAGAA
CTTCAAGTACGAGGACGCACTACGCCTGCTGCAATGCGCCGAGCCTTACAAAGTCTCCTTCTGCCTGAAG
CGCACTGTGCCCACCGGGGACCTGGCTCTGCGGCCCGGGACCGTGTCTGGCTACGAGATCAAGGGCCCGC
GGGCCAAGGTGGCCAAGCTGGTACGCGTGCTTAGCCCGGCCCCGGCCCTGGACTGCCCCAGCGATCCGGT
CTCTGCGCCGTGAGCCCCATTCCCCGCCATCGTGGGCCAGCCTTGCCCTCTGTCTTGTCACTAACCCAAG
CTAATTCCACCCTCTGCCCCTTCCTCTCTGCCCCAAACTCTTCCCCGGGAAGGGGGACAGACCCACCCCA
GCCCAGGGCCCTCACCCACCTCGGAGAGGCGTCCCCACCATCGGATCCAGGCTTGCTAGGGGTCCTGAAC
CAGGCTACTTCGAACCAGGAAAGCCAGATTCCAGCCTGAGTGCTGGCCCAATTACTGCTGAGTGGCCCTG
GACAAAGTTGTTTCTCTCCCTGGGCCTCAGTTTCCCCATCTCTAGAATGAGGATGTTGGGGAAAATCCCG
GATCAGGATCTAGAAGTCTTGGGTCCCCGTCCCTACACTCCTTGACTCATTTGGAGATCCTAGATGGC
TGCCTGCTTTCCTGGGCACTCATGGTGAAATGACAGGCAAGAAGTGGGGATGATGTTTGGGGAACAAGAT
ACTTGACCCAGCACATCCCCCGCCTGGTCCAATACCAGGTGGGGCTCTTCCTGTCCACTCCCAGCCTCCC
ACTGTCCCACCGCCTCCTGCCTCTCTCCTCTCTCCCCAGAACATCCAGAGTCTGTCCCCTGTGAAGAAGA
AGAAGATGGTGCCTGGGGCTCTGGGGGTCCCCGCTGACCTGGCCCCTGTTGACGTCGAGTTCTCCTTTCC
CAAGTTCTCCCGCCTGCGTCGGGGCCTCAAAGCCGAGGCTGTCAAGGGTCCTGTCCCGGCTGCCCCTGCC
CGCCGGCGCCTCCAGCTGCCTCGGCTGCGTGTACGAGAAGTGGCCGAAGAGGCTCAGGCAGCCCGGCTGG
CCGCCGCCGCTCCTCCCCCCAGGAAAGCCAAGGTGGAGGCTGAGGTGGCTGCAGGAGCTCGTTTCACAGC FIGURE 270 cont'd

```
CCCTCAGGTGGAGCTGGTTGGGCCGCGGCTGCCAGGGGCGGAGGTGGGTGTCCCCAGGTCTCAGCCCCC
AAGGCTGCCCCCTCAGCAGAGGCAGCTGGTGGCTTTGCCCTCCACCTGCCAACCCTTGGGCTCGGAGCCC
CGGCTCCGCCTGCTGTGGAGGCCCCAGCCGTGGGAATCCAGGTCCCCCAGGTGGAGCTGCCTGCCTTGCC
CTCACTGCCCACTCTGCCCACACTTCCCTGCCTAGAGACCCGGGAAGGGGCTGTGTCGGTAGTGGTGCCC
ACCCTGGATGTGGCAGCACCGACTGTGGGGGTGGACCTGGCCTTGCCGGGTGCAGAGGTGGAGGCCCGGG
GAGAGGCACCTGAGGTGGCCCTGAAGATGCCCCGCCTTAGTTTTCCCCGATTTGGGGCTCGAGCAAAGGA
AGTTGCTGAGGCCAAGGTAGCCAAGGTCAGCCCTGAGGCCAGGGTGAAAGGTCCCAGACTTCGAATGCCC
ACCTTTGGGCTTTCCCTCTTGGAGCCCCGGCCCGCTGCTCCTGAAGTTGTAGAGAGCAAGCTGAAGCTGC
CCACCATCAAGATGCCCTCCCTTGGCATCGGAGTGTCAGGGCCCGAGGTCAAGGTGCCCAAGGGACCTGA
AGTGAAGCTCCCCAAGGCTCCTGAGGTCAAGCTTCCAAAAGTGCCCGAGGCAGCCCTTCCAGAGGTTCGA
CTCCCAGAGGTGGAGCTCCCCAAGGTGTCAGAGATGAAACTCCCAAAGGTGCCAGAGATGGCTGTGCCGG
AGGTGCGGCTTCCAGAGGTAGAGCTGCCCAAAGTGTCAGAGATGAAACTCCCAAAGGTGCCAGAGATGGC
TGTGCCGGAGGTGCGGCTTCCAGAGGTACAGCTGCTGAAAGTGTCGGAGATGAAACTCCCAAAGGTGCCA
GAGATGGCTGTGCCGGAGGTGCGGCTTCCAGAGGTACAGCTGCCGAAAGTGTCAGAGATGAAACTCCCAG
AGGTGTCAGAGGTGGCTGTGCCAGAGGTGCGGCTTCCAGAGGTGCAGCTGCCGAAAGTGCCAGAGATGAA
AGTCCCTGAGATGAAGCTTCCAAAGGTGCCTGAGATGAAACTTCCTGAGATGAAACTCCCTGAAGTGCAA
CTCCCGAAGGTGCCCGAGATGGCCGTGCCCGATGTGCACCTCCCAGAAGTGCAGCTTCCAAAAGTCCCAG
AGATGAAGCTCCCTGAGATGAAACTCCCTGAGGTGAAACTCCCGAAGGTGCCCGAGATGGCTGTGCCCGA
TGTGCACCTCCCGGAAGTGCAGCTCCCGAAAGTCCCAGAGATGAAACTCCCTAAAATGCCTGAGATGGCT
GTGCCAGAGGTTCGACTCCCCGAGGTGCAGCTGCCAAAAGTCTCAGAGATGAAACTCCCAAGGTGCCTG
AAATGGCCGTGCCCGATGTGCACCTCCCAGAGGTGCAGCTGCCCAAAGTCTGTGAAATGAAAGTCCCTGA
CATGAAGCTCCCAGAGATAAAACTCCCCAAGGTGCCTGAGATGGCTGTGCCCGATGTGCACCTCCCCGAG
GTGCAGCTGCCGAAAGTGTCAGAGATTCGGCTGCCGGAAATGCAAGTGCCGAAGGTTCCCGACGTGCATC
TTCCGAAGGCACCAGAGGTGAAGCTGCCCAGGGCTCCGGAGGTGCAGCTAAAGGCCACCAAGGCAGAACA
GGCAGAAGGGATGGAATTTGGCTTCAAGATGCCCAAGATGACCATGCCCAAGCTAGGGAGGGCAGAGTCC
CCATCACGTGGCAAGCCAGGCGAGGCGGGTGCTGAGGTCTCAGGGAAGCTGGTAACACTTCCCTGTCTGC
AGCCAGAGGTGGATGGTGAGGCTCATGTGGGTGTCCCCTCTCTCACTCTGCCTTCAGTGGAGCTAGACCT
GCCAGGAGCACTTGGCCTGCAGGGCAGGTCCCAGCCGCTAAAATGGGCAAGGGAGAGCGGGTGGAGGGC
CCTGAGGTGGCAGCAGGGGTCAGGGAAGTGGGCTTCCGAGTGCCCTCTGTTGAAATTGTCACCCCACAGC
TGCCCGCCGTGGAAATTGAGGAAGGCGGCTGGAGATGATAGAGACAAAAGTCAAGCCCTCTTCCAAGTT
CTCCTTACCTAAGTTTGGACTCTCGGGGCCAAAGGTGGCTAAGGCAGAGGCTGAGGGGGCTGGGCGAGCT
ACCAAGCTGAAGGTATCCAAATTTGCCATCTCACTCCCCAAGGCTCGGGTGGGGCTGAGGCTGAGGCCA
AAGGGGCTGGGGAGGCAGGCCTGCTGCCTGCCCTCGATCTGTCCATCCCACAGCTCAGCCTGGATGCCCA
CCTGCCCTCAGGCAAGGTAGAGGTGGCAGGGGCCGACCTCAAGTTCAAGGGGCCCAGGTTTGCTCTCCCC
AAGTTTGGGGTCAGAGGCCGGACACTGAGGCAGCAGAACTAGTGCCAGGGGTGGCTGAGTTGGAGGGCA
AGGGCTGGGGCTGGGATGGGAGGGTGAAGATGCCCAAGCTGAAGATGCCTTCCTTTGGGCTGGCTCGAGG
GAAGGAAGCAGAAGTTCAAGGTGATCGTGCCAGCCCGGGGGAAAAGGCTGAGTCCACCGCTGTGCAGCTT
AAGATCCCCGAGGTGGAGCTGGTCACGCTGGGCGCCCAGGAGGAAGGGAGGGCAGAGGGGGCTGTGGCCG
TCAGTGGAATGCAGCTGTCAGGCCTGAAGGTGTCCACAGCCAGGCAGGTGGTCACTGAGGGCCATGACGC
GGGGCTGAGGATGCCTCCGCTGGGCATCTCCCTGCCACAGGTGGAGCTGACCGGCTTTGGGGAGGCAGGT
ACCCCAGGGCAGCAGGCTCAGAGTACAGTCCCTTCAGCAGAGGGCACAGCAGGCTACAGGGTTCAGGTGC
CCCAGGTGACCCTGTCTCTGCCTGGAGCCCAGGTTGCAGGTGGTGAGCTGCTGGTGGGTGAGGGTGTCTT
TAAGATGCCCACCGTGACAGTGCCCCAGCTTGAGCTGGACGTGGGCTAAGCCGAGAGGCACAGGCGGGC
GAGGCGGCCACAGGCGAGGGTGGGCTGAGGCTGAAGTTGCCCACACTGGGGGCCAGAGCTAGGGTGGGGG
GCGAGGGTGCTGAGGAGCAGCCCCAGGGGCCGAGCGTACCTTCTGCCCTCTCACTGCCCGACGTGGAGCT
CTCGCCATCCGGGGCAACCATGCCGAGTACCAGGTGGCAGAGGGGAGGGAGAGGCCGGACACAAGCTC
AAGGTACGGCTGCCCCGGTTTGGCCTGGTGCGGGCCAAGGAGGGGGCCGAGGAGGGTGAGAAGGCCAAGA
GCCCCAAACTCAGGCTGCCCCGAGTGGGCTTCAGCCAAAGTGAGATGGTCACTGGGGAAGGGTCCCCCAG
CCCCGAGGAGGAGGAGGAGGAGGAGGAAGAGGGCAGTGGGGAAGGGCCTCGGGTCGCCGGGGCCGGGTC
CGGGTCCGCTTGCCACGTGTAGGCCTGGCGGCCCCTTCTAAAGCCTCTCGGGGGCAGGAGGGCGATGCAG
CCCCCAAGTCCCCCGTCAGAGAGAAGTCACCCAAGTTCCGCTTCCCCAGGGTGTCCCTAAGCCCCAAGGC
CCGGAGTGGGAGTGGGGACCAGGAAGAGGGTGGATTGCGGGTGCGGCTGCCCAGCGTGGGGTTTTCAGAG
ACAGGGGCTCCAGGCCCGGCCAGGATGGAGGGGCTCAGGCTGCGGCTGTCTGAAGCCCCTAGTCAGATG
GGGATCCCTTCTTGCCTTCCTTTCTCTACCCCCTCGCTGTTGTGTGTGATAACTAGCACTAACCCTAA
GAGGGCCGGGAGGTGGGTGACTGACCAGGGCTGGCAGGGAGGCCTGCTCCTGTCTCTCTGGCAGGAGTGC
CTGTACCCCACCAAGCCATGTGAATAAATAATCTGGAAGTA
```

FIGURE 271
SEQ ID NO: 263
Genbank ID : NM_002281.1

FIGURE 271 cont'd

```
Unigene ID(#167) : Hs.170925
Unigene name     :         keratin, hair, basic, 1 KRTHB1
>gi|4504930|ref|NM_002281.1| Homo sapiens keratin, hair, basic, 1 (KRTHB1),
mRN
A
ATGACCTGCGGATCAGGATTTGGTGGGCGCGCCTTCAGCTGCATCTCGGCCTGCGGCCGCGCCCCGGCC
GCTGCTGCATCACCGCCGCCCCCTACCGTGGCATCTCCTGCTACCGCGGCCTCACCGGGGGCTTCGGCAG
CCACAGCGTGTGCGGAGGCTTTCGGGCCGGCTCCTGCGGACGCAGCTTCGGCTACCGCTCCGGGGGCGTG
TGCGGGCCCAGTCCCCCATGCATCACCACCGTGTCGGTCAACGAGAGCCTCCTCACGCCCCTCAACCTGG
AGATCGACCCCAACGCGCAGTGCGTGAAGCAGGAGGAGAAGGAGCAGATCAAGTCCCTCAACAGCAGGTT
CGCGGCCTTCATCGACAAGGTGCGCTTCCTGGAGCAGCAGAACAAACTGCTGGAGACAAAGCTGCAGTTC
TACCAGAACCGCGAGTGTTGCCAGAGCAACCTGGAGCCCCTGTTTGAGGGCTACATCGAGACTCTGCGGC
GGGAGGCCGAGTGCGTGGAGGCCGACAGCGGGAGGCTGGCCTCAGAGCTTAACCACGTGCAGGAGGTGCT
GGAGGGCTACAAGAAGAAGTATGAGGAGGAGGTTTCTCTGAGAGCAACAGCTGAGAACGAGTTTGTGGCT
CTGAAGAAGGATGTGGACTGCGCCTACCTCCGCAAGTCAGACCTGGAGGCCAACGTGGAGGCCCTGATCC
AGGAGATCGACTTCCTGAGGCGGCTGTATGAGGAGGAGATCCGCATTCTCCAGTCGCACATCTCAGACAC
CTCCGTGGTTGTCAAGCTGGACAACAGCCGGGACCTGAACATGGACTGCATCATTGCCGAGATTAAGGCA
CAGTATGACGACATTGTCACCCGCAGCCGGGCCGAGGCCGAGTCCTGGTACCGCAGCAAGTGTGAGGAGA
TGAAGGCCACGGTGATCAGGCACGGGGAGACCCTGCGCCGCACCAAGGAGGAGATCAATGAGCTGAACCG
CATGATCCAAAGGCTGACGGCCGAGGTGGAGAATGCCAAGTGCCAGAACTCCAAGCTGGAGGCCGCGGTG
GCTCAGTCTGAGCAGCAGGGTGAGGCAGCCCTCAGTGATGCCCGCTGCAAGCTGGCCGAGCTGGAGGGCG
CCCTGCAGAAGGCCAAGCAGGACATGGCCTGCCTGATCAGGGAGTACCAGGAGGTGATGAACTCCAAGCT
GGGCCTGGACATCGAGATCGCCACCTACAGGCGCCTGCTGGAGGGCGAGGAGCAGAGGCTATGTGAAGGC
ATTGGGGCTGTGAATGTCTGTGTCAGCAGCTCCCGGGGCGGGGTCGTGTGCGGGGACCTCTGCGTGTCAG
GCTCCCGGCCAGTGACTGGCAGTGTCTGCAGCGCTCCGTGCAACGGGAACGTGGCGGTGAGCACCGGCCT
GTGTGCGCCCTGCGGCCAATTGAACACCACCTGCGGAGGGGGTTCCTGCGGCGTGGGCTCCTGTGGTATC
AGCTCCCTGGGTGTGGGTCTTGCGGCAGCAGCTGCCGGAAATGTTAG
```

FIGURE 272
SEQ ID NO: 264
```
Genbank ID       : NM_002452.1
Unigene ID(#167) : Hs.413078
Unigene name     :         nudix (nucleoside diphosphate linked moiety X)-type
motif 1    NUDT1
>gi|4505274|ref|NM_002452.1| Homo sapiens nudix (nucleoside diphosphate
linked
moiety X)-type motif 1 (NUDT1), mRNA
GAGCGGCGGTGCAGAACCCAGGGACCATGGGCGCCTCCAGGCTCTATACCCTGGTGCTGGTCCTGCAGCC
TCAGCGAGTTCTCCTGGGCATGAAAAAGCGAGGCTTCGGGGCCGGCCGGTGGAATGGCTTTGGGGGCAAA
GTGCAAGAAGGAGAGACCATCGAGGATGGGCTAGGAGGGAGCTGCAGGAGGAGAGCGGTCTGACAGTGG
ACGCCCTGCACAAGGTGGGCCAGATCGTGTTTGAGTTCGTGGGCGAGCCTGAGCTCATGGACGTGCATGT
CTTCTGCACAGACACCATCCAGGGGACCCCGTGGAGAGCGACGAAATGCGCCCATGCTGGTTCCAGCTG
GATCAGATCCCCTTCAAGGACATGTGGCCCGACGACAGCTACTGGTTTCCACTCCTGCTTCAGAAGAAGA
AATTCCACGGGTACTTCAAGTTCCAGGGTCAGGACACCATCCTGGACTACACACTCCGCGAGGTGGACAC
GGTCTAGCGGGAGCCCAGGGCAGCCCCTGGGCAGGAGACGTGGCTGCTGAACAGCTGCAAACCATCTTCA
CCTGGGGGCATTGAGTGGCGCAGAGCCGGGTTTCATCTGGAATTAACTGGATGGAAGGGAAAATAAAGCT
ATCTAGCGGTGAA
```

FIGURE 273
SEQ ID NO: 265
```
Genbank ID       : AW966474
Unigene ID(#167) : Hs.88417
Unigene name     :         sushi domain containing 3      SUSD3
>gi|8156310|gb|AW966474.1|AW966474 EST378548 MAGE resequences, MAGI Homo
sapien
s cDNA, mRNA sequence
ACAACCACAGCTTCACCACAGACCATGGTGAGAGCACCAGCAAGCTGGCCAGTGTGACCCGCAGCGTGGA
CAAGGACCCTGGGATCCCCAGAGCTCTAAGCCTCAGTGGCTCCTCCAGCTCACCCCAAGCCCAGGTGATG
```

FIGURE 273 cont'd

```
GTGCACATGGCAAACCCCAGACAGCCCCTGCCTGCCTCTGGGCTGGCCACAGGAATGCCACAACAGCCCG
CAGCATATGCCCTAGGGTGACCACGCAGTGAGGCTGGTGCCCATGCTCCACACTGGGAGGCCAGGCTGAC
CCCACCAGCCAGTCAGCTACAACTCCACATCAACTCCACATGCGCCCAGCTCGAGACTGATGAGTGGAAT
CAGCTTCCAGGTGTAGGGACCCCTTGAGGGGCCGAGCTGACATCCAAGGCTTGAGGACCCCAGTGGGGAG
TGTTCTGTTCCCGCATATCCTGGCCGTAACGATTTTTTATTGTTATGGACTACTTGAAACCCCTTCCTGA
GGGTATTTTACTAGTTGGGGGCTCCCCATAATTAGCTTTCTTTAAAAGAGCTGGGGATTTGTTTCACCCA
TATCTTTTTTTGTCATATAAAAAAAAAATATTAATTTTTTTTTT
```

FIGURE 274
SEQ ID NO: 266

```
Genbank ID        : NM_017888.1
Unigene ID(#167)  : Hs.122939
Unigene name      :         hypothetical protein FLJ20581 FLJ20581
>gi|8923542|ref|NM_017888.1| Homo sapiens hypothetical protein FLJ20581
(FLJ205
81), mRNA
TTTGGGGCTGAAGTTCCCTGTGGGAGGCTGTTTTCTGAGGGAGCTGAGTGTTTACAGCCACTCAGCCCTG
CTCTGCTCAGCTGAAGCAGAAAACAGAGACCTTTTGCATTACTTTGGTTCAAGAGCAAGACAGGAGGCGA
CTGCATGAGACCATGGCTGAGACACCTAGTCCTCCAGGCACTGAGGAACTCCAGGGCATTCTGTGGGTCT
CATGGGAAGCCAGCACCTCTACCTGTTCCTCAGAAGATCGTGGCCACCTGGGAAGCCATCAGCCTGGGAA
GGCAGCTGGTGCCTGAGTACTTCAACTTCGCCCATGATGTGCTGGATGTGTGGAGTCGGCTGGAAGAGGC
TGGACACCGCCCCCCAAATCCTGCCTTCTGGTGGGTCAATGGCACAGGAGCAGAGATCAAGTGGAGCTTT
GAGGAGCTGGGGAAGCAGTCCAGGAAGGCAGCCAATGTGCTGGGGGGTGCATGCGGCCTGCAGCCTGGGG
ACAGAATGATGCTGGTACTCCCACGGCTCCCGGAGTGGTGGCTGGTCAGTGTGGCTTGCATGCGGACAGG
GACTGTGATGATTCCGGGTGTGACTCAGCTGACAGGAAGGACCTCAAGTACCGGCTGCAGGCGTCCAGG
GCCAAGTCCATTATCACCAGTGACTCCCTAGCTCCAAGGGTGGATGCCATCAGTGCCGAATGCCCCTCCC
TCCAGACCAAGCTGCTGGTGTCAGACAGCAGTCGGCCAGGCTGGTTGAACTTCAGGGAACTCCTCCGGGA
GGCTTCTACAGAGCACAACTGCATGAGGACAAAGAGTCGAGACCCGCTGGCCATCTACTTTACCAAGCGG
GAACCACCGGGGGCCCCCAAGATGGTCGAGCACTCCCAGAGCAGCTACGGACTGGGTTTTGTGGCCAGCG
GAAGACGGTGGGTGGCCTTGACCGAATCTGACATCTTCTGGAACACGACTGACACTGGCTGGGTGAAGGC
AGCCTGGACTCTCTTCTCTGCCTGGCCTAATGGATCTTGCATTTTTGTGCATGAGCTGCCCCGAGTTGAT
GCCAAAGTTATCCTGAATACTCTCTCCAAATTCCGATAACCACCCTCTGCTGTGTCCCAACCATCTTTC
GGCTGCTTGTGCAGGAGGATCTGACCAGGTACCAGTTTCAGAGCTTGAGGCACTGTCTGACCGGAGGAGA
GGCCCTCAACCCTGACGTGAGGGAGAAGTGGAAACACCAGACTGGTGTGGAGCTGTACGAAGGCTATGGC
CAGTCTGAAACGGTTGTCATCTGTGCCAATCCAAAAGGCATGAAAATCAAGTCTGGATCCATGGGGAAGG
CGTCCCCACCCTACGATGTGCAGATTGTGGATGATGAGGGCAACGTCCTGCCTCCTGGAGAAGAGGGGAA
TGTTGCTGTCCGTATCAGACCCACTCGGCCCTTCTGTTTCTTCAATTGCTATTTGGACAATCCTGAGAAG
ACAGCTGCATCAGCAAGGGACTTTTACATCACAGGGGACCGAGCTCGCATGGACAAGGATGGCTACT
TTTGGTTCATGGGAAGAAACGACGATGTGATCAATTCTTCAAGCTACCGGATCGGGCCTGTTGAAGTGGA
AAGTGCCCTGGCAGAGCATCCTGCTGTCCTGGAGTCGGCTGTGGTCAGCAGCCCAGACCCCATCAGGGGA
GAGGTGGTAAAGGCATTTATAGTCCTTACTCCAGCCTACTCCTCTCATGACCCAGAGGCACTAACGCGGG
AACTCCAGGAGCATGTGAAAAGGGTGACTGCTCCATACAAATACCCCAGGAAGGTGGCCTTTGTTTCAGA
ACTTGCCAAAGACGGTTTCTGGAAAGATCCAAAGGAGTAAATTGCAAGTCAGGAGTGGGGAAATGAGG
TGCACCCCAGGAAGGCCCCGTAGACCTCCGAAGACTCCACAAGAAACTAATGGATCACTGGTCAGTCCCC
ATGGGGAGCATCATCTCTTCGACCCTAAAGATGTCAAGGGTGTGCAGCTTCCAAACGGCATCCCCAGGAT
CACTGGGCAATGCTGGAAAGAGCAAAAGAATATCATTGGCCCTGATCACATAGATGCTGCGCCGCCTAGC
AAATGCTTGGTGGTTCGACTTCTCCCTCTGTCTGGGGGCAGGCTCAGCATCTGCCCACTGGTCTCACTAA
GAGCTTTCAGATTTCCCTCCATAGGACAGGTTACCATAGACTTGGGGCACTTGTGGGTACTCATTTTCTG
CCAGTGGGAATGTAAAGGCTTCATCCTTTGTATGTAACCATTTGGCAAAAGTATGCAGGAACATAAAATA
AAATATCCTTTAGCTCAGAAATTCTATCTTCGGGAGTCACCACAAAAGAAAAAAATCAAATGCAGAAAA
TGTGTGGTGCACTAAGATGATCACACAGCATTAAAACTAGAA
```

FIGURE 275
SEQ ID NO: 267

```
Genbank ID        : NM_024697.1
Unigene ID(#167)  : Hs.99256
Unigene name      :        hypothetical protein FLJ22419 FLJ22419
```

FIGURE 275 cont'd

>gi|13375980|ref|NM_024697.1| Homo sapiens hypothetical protein FLJ22419
(FLJ22
419), mRNA
AAAGCTTCCCGAGAGCCATGGTTGGTCCAGGCAGGCAGTCGGAGCACCTCGTGGAGCGGCTGCTAACCCA
GGGTGGGGTGGGGTGGGGTGGAGGGGTCTGCTTGTAGTACTCTCAGTCCTGATGTCACAGGCGCGGCAAG
GACATCGCAAGGAGGAGTCGGATTACAGTAAGGATGGGCAGTGCAGCAGGCAGCCCGAGCGCACTCTCCA
GCCGCCGGGGATCTTAGCCCTGGAAAGGCAGCCTGCAAGGCGCTCATCCCGCGGAGGAGGCACGCTCTCG
GCGCTCACTGCTCTCCACGCCGGGGACATTTCCACCGAATGTAGCATGAAAGGGCTCTGCTCTACGTGCC
AGCCTTGGGTGAGAGCTGATGCTGAAGACACCGCGGTGGGATTCCAGCTGTCTGATTAATGAGAAACATA
ATGTATTTTGGTGGTACATGCCAGAGTCCTGCTCTCCCGGCCCTTGTCCGTCCACCAGCCCCTCCTTTGC
AACCATCGCTGGATATTAAACCATTTCTTCCCTTTCCTCTTGACACTGCAGCTGCAGTCAACCTCTTCCC
CAATTTCAATGCGATGGACCCGATTCAGAAAGCTGTAATAAACCATACATTCGGGGTTCCTCTTCCCCAC
CGAAGAAAGCAAATCATATCATGCAACATTTGCCAGTTGAGATTTAATTCTGATAGCCAGGCTGCGGCCC
ACTACAAAGGCACGAAACATGCCAAGAAGCTCAAAGCACTGGAAGCCATGAAAAATAAGCAGAAATCTGT
AACTGCCAAGGACAGCGCAAAGACTACCTTCACCTCCATCACTACCAATACCATCAATACCAGCTCTGAC
AAAACAGACGGTACTGCAGGGACACCAGCAATATCAACGACGACAACTGTGGAAATCCGCAAAAGCAGTG
TTATGACAACTGAGATCACCTCTAAAGTGGAAAAAAGCCCAACGACAGCCACTGGCAATAGCTCATGTCC
TTCTACTGAGACCGAGGAAGAAAAGGCAAAACGGCTTCTTTACTGTTCGCTATGCAAGGTTGCTGTCAAC
TCTGCCTCGCAGCTGGAGGCGCACAACAGTGGTACTAAGCACAAAACCATGTTAGAAGCCCGGAATGGAA
GTGGCACTATCAAAGCCTTTCCTAGGGCAGGAGTGAAAGGCAAAGGACCTGTTAATAAAGGAAACACAGG
CCTCCAAAATAAAACATTTCACTGTGAAATCTGTGATGTGCACGTCAACTCGGAAACGCAACTTAAACAG
CACATTAGCAGTAGAAGGCACAAAGACAGAGCTGCTGGGAAGCCCCCGAAACCTAAATACAGTCCTTACA
ACAAACTACAGAAGACAGCACATCCACTGGGGGTAAAATTAGTATTTTCAAAAGAACCTTCAAAGCCATT
GGCTCCACGAATTCTACCAAACCCTCTAGCAGCTGCAGCAGCCGCAGCAGCAGTGGCAGTGAGTTCCCCC
TTCAGTCTTCGAACTGCTCCAGCAGCAACACTGTTCCAGACTTCTGCGCTTCCTCCGGCACTCCTGCGGC
CAGCTCCCGGACCCATTCGGACCGCCCACACTCCTGTGCTGTTTGCTCCTTACTAAATTCCAAATAGGAG
TAATTGTACTGCAATAATTTTTCAAAAAACAAAAAACAAAACAAAAAAAAAAAAAAAAAAAAAAA

FIGURE 276
SEQ ID NO: 268
Genbank ID        : AV700083
Unigene ID(#167)  : Hs.176588
Unigene name      :        cytochrome P450 4Z1      CYP4Z1
>gi|10302054|gb|AV700083.1|AV700083 AV700083 GKC Homo sapiens cDNA clone
GKCABF
04 3', mRNA sequence
GGAAAGATAACTGAGAATAAAGCTATCATGCAGATATTTGCAGAGATAAAAGTAATGCAGATACTGAGTG
GAGTTTTGATCAAACTATGCTTGAAAGCCACTCTACCACTAGTTACACAAACCAATAATTTCCCTTCGCA
GTGGAAGTCAGCTTGAGTTTTTTCAGGTGTTTTTGTGGGTTTCACCAGATACAGCAAAGAAATTAAAATT
ACTGTTAATGGATGTCAAAACCAGTCAGAAGTATCCTAAGTTATATAATTTGTCAAACAACCATATACAT
ATATTTTGTATTATATTTATCCTTTTGTTCTTCCTTTGGTAGGAAAATTGTCTCATTAATTCTTTATACGA
AAGGACTTAAAATTAGCAAACTTTTTTTTGCAAACACATGGATTCCATTCTTGGACTTGAGGACAACTTGA
CGAACAGGCTGGGGAGGCCTTGAGTGGTCTGGAGCCAGCTTGAAGCGGAGCGAGTTAATGCCACTGCCA
CTTTACACTCAATTATGGCAAAATGCTGCCCAATGCAGTTCCTTAATCCAGCTGAGAATGGTATGAAGGC
ATAAGGATGTATTTTTCAGATTTTCCCTTGAGAATCTCAAGCGTTAAAGACCTGAGGGGTCTCCCAGAAA
TAGGGGTTTGGGTGAAGAGCCCACATATTGATAACACAGTATTCCTGCCCGTACGAGCGTCCATCTGGAA
AAGGAATGGGTTTGCGAGTACACGGATATTGTTACTTACCGTGCGTANAAGCGGAGGATA

FIGURE 277
SEQ ID NO: 269
Genbank ID        : BE222344
Unigene ID(#167)  : Hs.346735
Unigene name      :        Clone IMAGE:3881549, mRNA
>gi|8909662|gb|BE222344.1|BE222344 hu10g08.x1 NCI_CGAP_Lu24 Homo sapiens
cDNA c
lone IMAGE:3166238 3', mRNA sequence
TTTTTTTGGTTGAAAAGTATTTATTTTTTTCAAATGATCTTTTTCAAGCAATAAATAAAACCAGACATAT
TGACTTCTAAAAAACAAAACCAAACAAAAAAAAAATCCCCTAAACTATATACATCCTACAGGAATACAGG FIGURE 277 cont'd CATTATCAAATGTAGAAATGGTATCACTCTGAAAGATGGGGCTATTTACACAAGTTACAAGAATTGCGTT
GCTGTCTTTAAGAAGTCTCCTCCTTGAATAACTCATAAACTCTAAGGGAGAGAGAGTACCTGGTGGGGAA
GCGGGGTTCAAAGAGGAGACATCCTCCATCTTTATTGATGGACAAGACAGTCTCAAGGAAAAACATCAAT
ATCCAAACACCGTATTGAGTCCCTTAACAAGGCTCCACAGATCAGCTGGCTTTCAAAAAGCCTGGAAGGG
TGCTCCACTCAGGAACTCCCAAGAGAAACCATCTTGTCCCTCAGCCAGGCTGGGACTGGCAGTGAGGCCA
TGCTGAGCCAGTGGCAAACCCGTG

FIGURE 278
SEQ ID NO: 270
Genbank ID      : NM_004694.1
Unigene ID(#167) : Hs.42645
Unigene name    :       solute    carrier   family   16   (monocarboxylic   acid
transporters), member 6 SLC16A6
>gi|4759117|ref|NM_004694.1|   Homo    sapiens   solute   carrier    family   16
(monocarboxy
lic acid transporters), member 6 (SLC16A6), mRNA
TTGGGGGTTTATTCTCTTCCCTTCTAACTTGACAGGGTCTTGCTCTGTCATTCAGGCAAGAGTGCAGTAG
TGTGATCACTTCTTACTGCCGCCTCAAGCTTCCAGCCTCAACTCAAGCAATCCTCCCACCTCAGCCACCC
AAGTGGCTGGGACTACAGATTAAGAATGACCCAAAATAAATTAAAGCTTTGTTCCAAAGCCAATGTGTAT
ACTGAAGTGCCTGATGGAGGATGGGGCTGGGCGGTAGCTGTTTCATTTTTCTTCGTTGAAGTCTTCACCT
ACGGCATCATCAAGACATTTGGTGTCTTCTTTAATGACTTAATGGACAGTTTTAATGAATCCAATAGCAG
GATCTCATGGATAATCTCAATCTGTGTGTTTGTCTTAACATTTTCAGCTCCCCTCGCCACAGTCCTGAGC
AATCGTTTCGGACACCGTCTGGTAGTGATGTTGGGGGGGCTACTTGTCAGCACCGGGATGGTGGCCGCCT
CCTTCTCACAAGAGGTTTCTCATATGTACGTCGCCATCGGCATCATCTCTGGTCTGGGATACTGCTTTAG
TTTTCTCCCAACTGTAACCATCCTATCACAATATTTTGGCAAAAGACGTTCCATAGTCACTGCAGTTGCT
TCCACAGGAGAATGTTTCGCTGTGTTTGCTTTCGCACCAGCAATCATGGCTCTGAAGGAGCGCATTGGCT
GGAGATACAGCCTCCTCTTCGTGGGCCTACTACAGTTAAACATTGTCATCTTCGGAGCACTGCTCAGACC
CATCATTATCAGAGGACCAGCGTCACCGAAAATAGTCATCCAGGAAAATCGGAAAGAAGCGCAGTATATG
CTTGAAAATGAGAAAACACGAACCTCAATAGACTCCATTGACTCAGGAGTAGAACTAACTACCTCACCTA
AAAATGTGCCTACTCACACTAACCTGGAACTGGAGCCGAAGGCCGACATGCAGCAGGTCCTGGTGAAGAC
CAGCCCCAGGCCAAGCGAAAAGAAAGCCCCGCTATTAGACTTCTCCATTTTGAAAGAGAAAAGTTTTATT
TGTTATGCATTATTTGGTCTCTTTGCAACACTGGGATTCTTTGCACCTTCCTTGTACATCATTCCTCTGG
GCATTAGTCTGGGCATTGACCAGGACCGCGCTGCTTTTTATTATCTACGATGGCCATTGCAGAAGTTTT
CGGAAGGATCGGAGCTGGTTTTGTCCTCAACAGGGAGCCCATTCGTAAGATTTACATTGAGCTCATCTGC
GTCATCTTATTGACTGTGTCTCTGTTTGCCTTTACTTTTGCTACTGAATTCTGGGGTCTAATGTCATGCA
GCATATTTTTTGGGTTTATGGTTGGAACAATAGGAGGACTCACATTCCACTGCTTGCTGAAGATGATGTC
GTGGGCATTGCAGAAGATGTCTTCTGCAGCTGGGGTCTACATCTTCATTCAGAGCATAGCAGGACTGGCT
GGACCGCCCCTTGCAGGTTTGTTGGTGGACCAAAGTAAGATCTACAGCAGGGCCTTCTACTCCTGCGCAG
CTGGCATGGCCCTGGCTGCTGTGTGCCTCGCCCTGGTGAGACCGTGTAAGATGGGACTGTGCCAGCGTCA
TCACTCAGGTGAAACAAAGGTAGTGAGCCATCGTGGGAAGACTTTACAGGACATACCTGAAGACTTTCTG
GAAATGGATCTTGCAAAAAATGAGCACAGAGTTCACGTGCAAATGGAGCCGGTATGACACACTTTCTTAC
AACAACAGCCACTGTGTTGGCTGGAGAGGGATGGGGTGGGCCCAACGGGGACACAAGGAGGCAGAGGAGC
TAACCCCTCTACTCCACTTTCAAAACTACATTTTAAAGGGAATGTGTATGTGAAGAGCACTACCAACATC
GCTTTTGTTTTGTTTTGTTTTGTTTTAAGCTTTTTTTTTTTGCTTGTTTTTAAAGCCAAAACAAAAAACA
ACCAAGCACTCTTCCATATATAAATCTGGCTGTATTCAGTAGCAATACAAGAGATATGTAGAAAGACTCT
TTGGTTCACATTCCGATATTAAAATAGTGACATGAACTGGCAAAGTGGTTTTAAAAGCTTTCACGTGGGA
TAAATGATTTTCTTTTTTTCTTTTCTTTCTTCCTATGGTCTTGTCTGAATAAACTACTCTCCTGAATAAA
ACAACATCCAACCCAGGTCATTGAAATGAAATTGGCCAGTC

FIGURE 279
SEQ ID NO: 271
Genbank ID      : BE544855
Unigene ID(#167) : Hs.526668
Unigene name    :       Transcribed sequences
>gi|9773500|gb|BE544855.1|BE544855 601078854F1 NIH_MGC_12 Homo sapiens cDNA
clo
ne IMAGE:3464604 5', mRNA sequence
CCCTGCATGGCGCGGGCGGCGCCGAACGGTGCTCAGCAATCACCCGGACAGGGCCAGGCCGTTTTCTCCC

FIGURE 279 cont'd

```
GCTCAGTGCATTAGTCGTTGGCTGTGGGCCGCCGCGGGAAGTTGAGGCCTACCACGGAGGAGGCTGCTGA
GGTGGATCTCAGGGTGATCCGCAAGGGCTCCCTCACCCTTGCCGGGACCCTGGGAACCCGAAACAAAATC
CTACGCCACCAGCCCGCCGAATGCGCCCCCTCGGCCGGGGTCCTGGGTCTTCAGAGAAGAACTCGGCCG
AATGCGGTCAGAAAGCCCGCGAACCGCCTGGACCTGCAGGCCCCGCCGCTTGGAGCTCCCGCCTTTCCG
ACCGAGCCCGTGTCTGCTCGTGTGTCTCACTGATGTCTTAGGTCTCAAAAAAAAAAGAACAGAAAAGGTT
TACAGTAGACAGAAGAGAACTGGGGCCGTGGGTTCGTGGTCCCAGGGGGAAACTGACGTCGCATTGAGGT
CGTCGTCCCTCAGCTTGAGCTCAGCGGAACATAAGCTTGCAGCAGGTGGAAACCACGGAAGGTCGGGGTG
TCTTGGAGCTCTCTGGACACCGAAGGCCAGGACACAGTCCCGAGGTCCGAACCGCCTGTGACCTGTGCCG
GGCACCGCGGGTTGGGCGTTACTCAAGTTGCTGCACAGAATAAGTGGACTCGGGAAACTACCTGAGCCG
CGAAAGATGGCAACCAGAACACAGACAGGGCCGAGTGAACCACCGACGCAAGAGGACGCACTATACACT
GGTGAGACGCAAATACACGTCCACAGAACCCCTTTAATAACATTGTGGTCCACACTATGAGTACCGGGGA
GATACATAGAGAGACCACACAGGGACCTTGAACGTCGG
```

FIGURE 280
SEQ ID NO: 272
Genbank ID       : NM_012301.1
Unigene ID(#167) : Hs.22599
Unigene name     :     atrophin-1 interacting protein 1     AIP1
>gi|6912461|ref|NM_012301.1| Homo sapiens atrophin-1 interacting protein 1;
act
ivin receptor interacting protein 1 (KIAA0705), mRNA

```
AGCCTTGAGTGTCATTCAAGGGACAGCACAACCTCATCCAAGCTCTCCTACCTCTGCCCAGCCGTCCCTC
TCATCCTCCCCATTCCTCGTCCACACTCCATCCAAAGAAGAGGGAAAGCACCGAATAGAGGGGGCGAAG
GCAAAGTCTGCTGTTCTTCCCCCTGGGCCCCCTTGCTCCTCCATCCTCATTCTCTCACCACCAGCCCCCC
TAACCCCAAGGAGCCCAGGAACTGAGGCGACTCGCCCCACTGCCATGTCCAAAAGCTTGAAAAAGAAAAG
CCACTGGACTAGCAAAGTCCATGAGAGTGTCATTGGCAGGAACCCGGAGGGCCAGCTGGGCTTTGAACTG
AAGGGGGGCGCCGAGAATGGACAGTTCCCCTACCTGGGGGAGGTGAAGCCCGGCAAGGTGGCCTATGAGA
GCGGCAGCAAATTGGTGTCGGAGGAGCTGCTGCTGGAGGTGAACGAGACCCCCGTGGCGGGCTCACCAT
CAGGGACGTGCTGGCCGTGATCAAACACTGCAAGGACCCCCTCCGGCTCAAGTGTGTCAAGCAAGGAGGA
ATTGTTGATAAAGACCTTCGTCACTACCTCAACTTACGATTTCAAAAGGGTTCTGTGGACCATGAGCTTC
AGCAAATCATTCGTGACAACCTCTACCTCCGCACGGTGCCATGCACCACAAGGCCACATAAGGAGGGTGA
GGTCCCTGGAGTGGATTATATTTTCATCACTGTTGAAGATTTTATGGAATTGGAGAAAAGTGGTGCTCTC
CTAGAAAGTGGGACTTATGAAGACAATTACTACGGTACCCCAAAGCCGCCAGCAGAACCAGCACCATTAT
TGTTAAATGTAACAGACCAGATACTTCCAGGAGCCACTCCAAGTGCTGAAGGAAAACGGAAGAGGAATAA
ATCAGTGAGCAACATGGAGAAAGCCAGTATAGAGCCTCCTGAGGAGGAAGAGGAAGAGAGGCCTGTGGTC
AATGGAAATGGAGTAGTAGTAACACCAGAATCCAGTGAACATGAAGACAAAAGTGCAGGTGCCTCAGGGG
AGATGCCCTCCCAGCCTTATCCTGCACCAGTGTACAGTCAGCCTGAGGAGCTGAAGGAGCAGATGGATGA
CACAAAGCCAACTAAACCTGAAGACAATGAGGAACCAGACCCATTGCCTGATAACTGGGAAATGGCCTAT
ACAGAGAAGGGCGAAGTCTACTTCATTGACCATAACCAAAGACAACATCATGGCTGGATCCACGACTTG
CGAAAAAAGCTAAACCTCCAGAAGAGTGCAAAGAAAATGAGCTTCCATATGGCTGGGAAAAAATCGATGA
TCCCATTTATGGCACTTATTATGTTGACCACATAAATAGAAGAACACAGTTTGAAAATCCTGTCCTGGAA
GCAAAAAGGAAGCTACAGCAACATAACATGCCCCACACAGAACTTGGAACAAAGCCCCTGCAGGCCCCAG
GTTTCCGAGAAAAACCACTCTTCACCCGGGATGCATCCCAGTTGAAGGGAACATTCCTCAGCACCACCCT
AAAAAAGAGCAACATGGGCTTTGGATTTACCATCATTGGTGGAGACGAGCCTGATGAGTTTCTGCAGGTG
AAAAGTGTGATTCCGGATGGGCCTGCAGCACAGGATGGAAAAATGGAAACAGGTGATGTCATTGTCTATA
TTAATGAAGTTTGTGTCCTTGGACACACTCATGCAGATGTTGTCAAACTTTTCCAGTCTGTTCCTATTGG
TCAGAGTGTCAACCTGGTGTTGTGTCGTGGCTACCCTTTGCCCTTTGATCCTGAAGACCCTGCTAACAGC
ATGGTGCCACCCCTTGCAATAATGGAGAGGCCACCTCCAGTGATGGTCAATGGAAGACACAACTATGAAA
CATATTTGGAGTACATTTCTCGGACCTCACAGTCAGTTCCAGATATAACAGATCGGCCGCCTCATTCTCT
GCACTCCATGCCAACTGATGGTCAGCTAGACGGCACGTATCCACCGCCGTCCATGATGACAATGTGTCT
ATGGCTTCATCTGGGCGCCACCCAAGCTGAACTTATGACCTTAACCATTGTGAAAGGTGCCCAGGGCTTCG
GCTTCACTATTGCCGACAGTCCTACAGGACAGCGGGTGAAACAAATACTTGACATTCAGGGATGCCCTGG
CCTGTGTGAAGGCGACCTCATTGTTGAGATCAACCAGCAGAATGTACAGAACCTGAGCCATACAGAAGTA
GTGGATATACTTAAGGACTGTCCCATTGGAAGTGAAACTTCTTTGATTATCCATCGAGGAGGTTTCTTTT
CTCCATGGAAAACTCCAAAGCCTATAATGGACCGATGGGAGAATCAAGGCAGTCCTCAAACGAGTTTATC
TGCTCCGGCCATACCGCAGAACCTGCCCTTCCCACCTGCCCTTCACAGGAGCTCCTTTCCTGACTCAACA
GAGGCCTTTGACCCACGGAAGCCTGATCCATATGAGCTCTACGAGAAATCTAGGGCCATTTATGAAGTA
GGCAACAAGTGCCACCCAGGACCAGTTTTCGAATGGATTCCTCTGGTCCAGATTATAAGGAATTGGATGT
TCATCTTCGGAGGATGGAGTCTGGATTTGGCTTCAGAATCCTCGGGGGAGATGAGCCTGGACAGCCTATT
TTGATTGGAGCTGTCATTGCCATGGGCTCAGCCGACAGAGATGGCCGCCTTCACCCAGGAGATGAGCTTG
```

FIGURE 280 cont'd

```
TGTATGTTGATGGGATTCCAGTAGCCGGCAAAACCCACCGCTATGTCATCGACCTCATGCACCACGCAGC
CCGCAATGGGCAGGTCAACCTCACTGTGAGAAGAAAGGTGCTATGTGGAGGGGAGCCCTGCCCAGAGAAC
GGGAGAAGTCCAGGCTCTGTATCCACCCACCACAGCTCTCCACGCAGTGACTACGCAACCTACACCAACA
GCAACCACGCTGCCCCCAGTAGCAATGCCTCTCCCCCTGAAGGCTTCGCCTCCCACAGCCTGCAGACCAG
TGATGTGGTCATTCACCGCAAAGAGAATGAGGGCTTCGGCTTTGTCATCATCAGCTCCCTGAACAGGCCT
GAGTCTGGATCCACTATAACTGTGYCCCATAAAATCGGACGCATCATTGATGGGAGTCCTGCAGATCGCT
GTGCAAAACTAAAAGTGGGAGACCGGATCCTAGCAGTGAATGGCCAGTCTATCATCAACATGCCTCACGC
TGACATCGTGAAGCTCATCAAGGATGCAGGTCTTAGTGTCACCCTTCGCATCATTCCTCAGGAGGAGCTC
AACAGCCCCACCTCGGCACCCAGCTCAGAGAAGCAGAGTCCCATGGCGCAGCAGAGTCCCCTGGCACAGC
AGAGTCCCCTGGCCCAGCCAAGCCCAGCCACCCCAACAGCCCCATCGCCCAGCCAGCACCACCTCAACC
ACTTCAGCTGCAAGGACACGAAAATAGTTACAGGTCAGAAGTGAAAGCAAGGCAAGATGTGAAACCAGAC
ATCCGACAGCCTCCATTCACAGACTACAGGCAGCCCCCGCTGGATTACAGGCAACCCCAGGAGGGGACT
ACCAGCAGCCCCCACCCTTGGACTACAGGCAGCCTCCCCTGCTGGACTACAGGCAGCACTCCCCCGACAC
CAGGCAGTACCCTCTGTCGGACTACAGACAACCCCAGGATTTTGATTATTTCACTGTGGACATGGAGAAA
GGAGCCAAAGGATTTGGATTCAGCATTCGTGGAGGAAGGGAATACAAAATGGATTTGTATGTGTTGAGAC
TGGCAGAAGATGGACCAGCAATAAGGAATGGGAGGATGAGGGTAGGAGATCAAATCATTGAAATCAATGG
GGAAAGCACAAGGGACATGACACATGCCAGAGCAATAGAACTCATCAAATCTGGAGGAAGACGAGTGAGG
CTGCTGCTCAAGAGAGGCACGGGACAGGTCCCACAATATGACGAACCCGCCCCCTGGAGTTCTCCCGCTG
CCGCCGCCCCATGTCTGCCGGAAGTAGGCGTCTCCCTGGACGACGGCCTCGCTCCATTCTCTCCATCACA
TCCAGCCCCACCCTCCGACCCTTCCCACCAGATAAGCCCAGGCCCAACTTGGGATATCAAACGGAAACAC
GACGTTAGGAAACCAAAGGAGCTTTCAGCCTGCGGCCAGAAGAAGCAGCGCCTCGGGGAGCAGAGGGAGC
GCTCGGCGAGTCCGCAGAGGGCCGCGCGGCCGAGGCTCGAGGAGGCGCCCGGCGGCCAGGGGCGGCCCGA
GGCCGGCAGGCCCGCCTCGGAGGCCAGGGCGCCCGGGCTCGCGGCGGCAGACGCGGCGGACGCGGCGCGG
GCGGGCGGGAAGGAGGCGCCCCGTGCGGCGGCGGGCTCCGAGCTCTGCCGGCGCGAAGGCCTGGGGCTG
CGCCGGCGAGTGCTGACCCGGCAGACGGCGGCAGCGGCGCTGGCGGCCGAGGGCAGGGCGGGTGCGCG
CGCGGCACCCCGATCGGTGCCGCGACCGCCGGCGGGCGCCGCCGCGCAGGGCGGCCGGCGCGCCGGGG
YCCTGGAAGGTGCGGGGTTCTGACAAGCTGCCGAGCGTCCTCAAACCCGGCGCCTCGGCCGCCAGCAGAT
GAGCCGCGCGGCCACGGCCAACCCGCCCGCCCCGGCGCAGGCAGTTCTTCTTAGGTTCCGTCTCACGGCG
TTTTAATTTATTTTCACTGTCACACGCATAGATCCACGAGGCACCAAGGCCTGGGAGCATGGACGTGGAG
TCCCACGTGTCCGGTGTGCTTGGGCGGCATCGCATCAACGCGCAGACCTAAACTGATCCTAAAGCCCCCG
GTTCCCTTGTGGGGGCTTTGGCAGCTATGGAAGAACCAAAATAACGTGAAGAACATCACAGAGAGACAGT
GCAGTGTAGCTTTAGTTTAAGAAAAAAAA
```

FIGURE 281
SEQ ID NO: 273
```
Genbank ID        : AW006352
Unigene ID(#167)  : Hs.159643
Unigene name      :         chromosome 14 open reading frame 66 C14orf66
>gi|5855130|gb|AW006352.1|AW006352  wt04d12.x1  NCI_CGAP_Co3  Homo  sapiens
cDNA cl
one IMAGE:2506487 3' similar to TR:O15121 O15121 PUTATIVE FATTY ACID
DESATURASE
 MLD. ;contains MER22.t2 MER22 MER22 repetitive element ;, mRNA sequence
TGAAACAAACGCCGGGTTTAATGTAGGGCACAGGCACCCCGGAGAAGTCAGCTCCGTGGGAACCGTGGGC
TCAGAGCACCCAGGTCATGGTGGGGCAGGGCCAGGCCTCACCTGGGGAGGCCCAGAAAGGGAGGGCCACA
CTCAAGGTCCAGGGCAAGTCCACGTGCAGACGGAGCCCTGCAGCCCACACTGCTGTTGCCAGGTGTGGCT
GCGCGGGACACTCCTCGGNGACAAGGGCAGCAGTCCAGAGCACAGGAAGGAAATGTAGCTTCTCAGTGCT
GGGGTGCAAGGCTGAGGGGCCGATGGGGACAATGGCCACCACCAGGAGGCAGCCCGGGCTCACAGACCA
TCTTTTGCCAGCCTGTACACCCGCTTCACCCTGGCATAGGGCCCCAGGGAGTCCTCAAACACAAATCCC
AGAGCACCTTCACCCAGGAGTGGTGCTGCGGCAGGTGGTCGTAGTACTCGGGCGCGATCTTCCGCACCAG
CGGGAGGTTGTAGCCCCGGATGCTGGGGAAGTCGTGGTGCTCACGTGTAGCCCACATTGAAGGGATCAGT
TGGAGGCCCATAGTAGGAGTGGTCTGTGGCCCTGAGGAACATGTA
```

FIGURE 282
SEQ ID NO: 274
```
Genbank ID        : AK022172.1
Unigene ID(#167)  : Hs.396595
Unigene name      :         flavin containing monooxygenase 5    FMO5
```

FIGURE 282 cont'd

>gi|10433507|dbj|AK022172.1| Homo sapiens cDNA FLJ12110 fis, clone MAMMA1000020
, highly similar to H.sapiens mRNA for flavin-containing monooxygenase 5 (FMO5)
AAGTTAAAAGTGGATGCAGAAGCGAGCACAGACGGGGCTAGGGGTTTCAGAGAAAGTAATTGAGAGTGCT
GGCAACAGCAGCTGAAATATAGAGAAGTTGTAGGATTAGCTTTTTCGCCCAAAGCAGCTTCAGCCCACGT
TTTATTCCCATCGAGGGAGGGAGAATGGGTGCCGCTGAGTGGGCGGGGGAGTGGTCCCTGAAAGGAGGTG
GAGTGCTACAGCCCCTCCCCGTTGGCTCTCGCTGTTTGTCCGTTGTTGGTTTATACTAATTTGACAACAG
CCGCCTGTTGAGTCTCCTCCAGATCGCAGCTGAAGGATCTGTTGAGCGCTTCAGGAAAGGCGGTGAGATC
CGGTACCGCAGCAGAGCACTCTCAGCTCTGGGTCTTGCAGGCGCAGGGCTCCCCCATGCCAGCAGAAAGA
TTTCCTCTGGTGAAGAGGACCGTCGAATCTGTCCTCCTCAAGACACCTCTTGTACAGAATTTATTCGAAT
GCCACGGCCAAGGTCTTCCTTGAAAAATGTTAACCGATGTGTGCTTTTTGTCTTTTGTCATCCTTTCTTT
AGGACAGGCGACACTAACAGGTGAAGATCTCGGGAGACCATGACTAAGAAAAGAATTGCTGTGATTGGGG
GAGGAGTGAGCGGGCTCTCTTCCATCAAGTGCTGCGTAGAAGAAGGCTTGGAACCTGTCTGCTTTGAAAG
GACTGATGACATCGGAGGGCTCTGGAGGTTCCAGGAAAATCCTGAAGAAGGAAGGCCAGTATTTACAAA
TCAGTGATCATCAATACTTCTAAAGAGATGATGTGCTTCAGTGACTATCCAATCCCAGATCATTATCCCA
ACTTCATGCATAATGCCCAGGTCCTGGAGTATTTCAGGATGTATGCCAAAGAATTTGACCTTCTAAAGTA
TATTCGATTTAAGACCACTGTGTGCAGTGTGAAGAAGCAGCCTGATTTTGCCACTTCAGGCCAATGGGAA
GTGGTCACTGAATCTGAGGGGAAAAAGGAGATGAATGTCTTTGATGGAGTCATGGTTTGCACTGGCCATC
ACACCAATGCTCATCTACCTCTGGAAAGCTTCCCTGGAATTGAGAAGTTCAAAGGGCAGTACTTCCACAG
TCGAGACTATAAGAACCCAGAGGGATTCACTGGAAAGAGAGTCATTATAATTGGCATTGGGAATTCTGGA
GGGGATCTGGCTGTAGAGATTAGCCAAACAGCCAAGCAGGTTTTCCTCAGCACCAGGAGAGGGGCTTGGA
TCCTGAATCGTGTAGGGGACTACGGATATCCTGCTGATGTGTTTTCTCTTCTCGACTTACACATTTTAT
ATGGAAGATCTGTGGCCAATCATTAGCAAACAAATATTTGGAAAAAAAGATAAACCAAAGGTTTGACCAT
GAAATGTTTGGCCTGAAGCCTAAACACAGGTATGTTCCCAGGATGGGAGTGCAGGGATAGTGGCCAAAGC
ACAAGAATAAGGACTCTTCACACTGGCTAATAGTAAAGCCACCTCTACCCATACATTAAGAAAACCCACA
GTGGCTGGGCATGGTGGCTCACGCCTGTAATCCCAGCACTCTGGGAGGCGGAGGCGGGTGGATCACCTGA
GCTCAGGAGTTTGAGACCATCCTGGCCAACACGGTGAAACCCCATCTCTACTAAAAACACAAAATTAGCC
AGGTGTGGTGGCACCTGTCTGTAGTCCCAGCTATTCAGGAGGCTGAGGCAGGAGAATCACCTGAGCCCTG
GAGGCAGAGGTTGCAGTGAGCTGAGATTGCACCACTGCACTCCAGCCTGGGCAACAGACTCTGTCTCAAA
AAGAAAAAAAAAAAAAAAAAAAG FIGURE 283
SEQ ID NO: 275
Genbank ID         : NM_024780.1
Unigene ID(#167)   : Hs.145807
Unigene name       : transmembrane channel-like 5  TMC5
>gi|13376137|ref|NM_024780.1| Homo sapiens hypothetical protein FLJ13593 (FLJ13
593), mRNA
ATTAATCTGGCCGTGCCATGCATCTACTCCATGTTCAGGCTTGTGGAGAGGTACGAGATGCCACGGCACG
AAGTCTACGTTCTCCTGATCCGAAACATCTTTTTGAAAATATCAATCATTGGCATTCTTTGTTACTATTG
GCTCAACACCGTGGCCCTGTCTGGTGAAGAGTGTTGGGAAACCCTCATTGGCCAGGACATCTACCGGCTC
CTTCTGATGGATTTTGTGTTCTCTTTAGTCAATTCCTTCCTGGGGGAGTTTCTGAGGAGAATCATTGGGA
TGCAACTGATCACAAGTCTTGGCCTTCAGGAGTTTGACATTGCCAGGAACGTTCTAGAACTGATCTATGC
ACAAACTCTGGTGTGGATTGGCATCTTCTTCTGCCCCTGCTGCCCTTTATCCAAATGATTATGCTTTTC
ATCATGTTCTACTCCAAAAATATCAGCCTGATGATGAATTTCCAGCCTCCGAGCAAAGCCTGGCGGGCCT
CACAGATGATGACTTTCTTCATCTTCTTGCTCTTTTTCCCATCCTTCACCGGGGTCTTGTGCACCCTGGC
CATCACCATCTGGAGATTGAAGCCTTCAGCTGACTGTGGCCCTTTTCGAGGTCTGCCTCTCTTCATTCAC
TCCATCTACAGCTGGATCGACACCCTAAGTACACGGCCTGGCTACCTGTGGGTTGTTTGGATCTATCGGA
ACCTCATTGGAAGTGTGCACTTCTTTTTCATCCTCACCCTCATTGTGCTAATCATCACCTATCTTTACTG
GCAGATCACAGAGGGAAGGAAGATTATGATAAGGCTGCTCCATGAGCAGATCATTAATGAGGGCAAAGAT
AAAATGTTCCTGATAGAAAAATTGATCAAGCTGCAGGATATGGAGAAGAAAGCAAACCCCAGCTCACTTG
TTCTGGAAAGGAGAGAGGTGGAGCAACAAGGCTTTTTGCATTTGGGGGAACATGATGGCAGTCTTGACTT
GCGATCTAGAAGATCAGTTCAAGAAGGTAATCCAAGGGCCTGATGACTCTTTTGGTAACCAGACACCAAT
CAAATAAGGGGAGGAGACGAAAATGGAATGATTTCTTCCATGCCACCTGTGCCTTTAGGAACTGCCCAGA
AGAAAATCCAAGGCTTTAGCCAGGAGCGGAAACTGACTACCATGTAATTATCAAAGTAAAATTGGGCATT
CCATGCTATTTTTAATACCTGGATTGCTGATTTTTCAAGACAAAATACTTGGGGTTTTCCAATAAAGATT
GTTGTAATATTGAAATGAGCCTACAAAAACCTAGGAAGAGATAACTAGGGAATAATGTATATTATCTTCA
AGAAGTGTGTGCAGGAATGATTGGTTCTTAGAAATCTCTCCTGCCAGACTTCCCAGACCTGGCAAAGGTT FIGURE 283 cont'd TAGAAACTGTTGCTAAGAAAAGTGGTCCATCCTGAATAAACATGTAATACTCCAGCAGGGATATGAAGCC
TCTGAATTGTAGAACCTGCATTTATTTGTGACTTTGAACTAAAGACATCCCCCATGTCCCAAAGGTGGAA
TACAACCAGAGGTCTCATCTCTGAACTTTCTTGCGTACTGATTACATGAGTCTTTGGAGTCGGGGATGGA
GGAGGTTCTGCCCCTGTGAGGTGTTATACATGACCATCAAAGTCCTACGTCAAGCTAGCTTTGCAGTGGC
AGTACCGTAGCCAATGAGATTTATCCGAGACGCGATTATTGCTAATTGGAAATTTTCCCAATACCCCACC
GTGATGACTTGAAATATAATCAGCGCTGGCAATTTTTGACAGTCTCTACGGAGACTGAATAAG

FIGURE 284
SEQ ID NO: 276
Genbank ID         : AW665138
Unigene ID(#167)   : Hs.58559
Unigene name       :      pleckstrin homology domain containing, family K
member 1    PLEKHK1
>gi|7457683|gb|AW665138.1|AW665138  hi87c11.x1   Soares_NFL_T_GBC_S1   Homo sapiens
cDNA clone IMAGE:2979284 3', mRNA sequence
CATTTTCAACAAAACAATTTATTTTGATATCTTGAACCATCTGACATAATTATGTATATACAAGATCTTT
TCAATCTACCTCTCCTTTAGTAGTTACATTAAGAGATTACCATGTCTCAAGAGCAAACTGCTGGAATTTA
AAACACAATTTTCCATAAGATCTGGAATGATCTTTTCTAATTATTAAACGTGTCAGCATTAGTATTTTCT
CCCATACTCAGATAAAGAAAAATGTTTGTTAAAATTTCTGTAACTTTTTTTGTTGTTAATTGAATGTAAA
GGTAGTTTGTTTCTCTAAGCACATTGATTAGTAGGCCTCTCTCTGTAAAGTATTTTTTTAATTTTAAATA
TTTCTGATCACACTACAGATTTAGAAATAAAATGCTGAAATAATCCAACTGAGCCAGGATTGCTCATTTC
TCTCCCCCACTCTGAGGCGCTCTGCAGGAATAAAGTACTGAGGGAGGTACATTAAAATAAGGAGACTCCT
TGTGGCTAGTAGTGACTGAATATCCTACGTACCTAATTTACTGCAG

FIGURE 285
SEQ ID NO: 277
Genbank ID         : AI042373
Unigene ID(#167)   : Hs.132917
Unigene name       :      Transcribed sequences
>gi|3281567|gb|AI042373.1|AI042373 ox62b11.x1 Soares_NhHMPu_S1 Homo sapiens cDN
A clone IMAGE:1660893 3', mRNA sequence
AATGGGAAATCTACAAGTAAAAATAGGAACAATAATAAAAGAAAATGCTCTATAATGGATATTCTACTCA
GCACACAGGATCGCATGAGACTGTCTTTGCTTTTATTTAACATGAGGCGAAATGAGTATATGCTGTAATT
CTGCACCTGTTCTATGTATCTTGCCTGCGGGGAGATACTCTCTATAAAACTATGCACTCCATAGCTCCTG
TGATGAACAGCATTCAAATTCTGCCTGTTATGAGGTGTAATTCAATAAGCACCTTTTGCTGAGCAGCTCT
TTGCAGGATACGTGAAGGGCTGAGCTAAGAATAAAAGCCCTTTTGGCAATCTGATACTTCGCCTTCTCTT
CCACTCAGTTCTCAGTCGATCTCACCATCAGATACCCTGCCAAAGGCATCACTCTCTCACCAGTCACTTG
CTCACATATTTATGCCAGTA

FIGURE 286
SEQ ID NO: 278
Genbank ID         : NM_014750.1
Unigene ID(#167)   : Hs.77695
Unigene name       :      discs, large homolog 7 (Drosophila) DLG7
>gi|7661851|ref|NM_014750.1| Homo sapiens KIAA0008 gene product (KIAA0008), mRN
A
AAATAGACACTTTGGTTTGAAAGATGTAAACATTCCAACCTTGGAAGGTAGAATTCTTGTTGAATTAGAT
GAGACATCTCAAGAGCTTGTTCCAGAAAAGACCAATGTTAAGCCAAGGGCAATGAAAACTATTCTAGGTG
ATCAACGAAAACAGATGCTCCAAAAATACAAAGAAGAAAAGCAACTTCAAAAATTGAAAGAGCAGAGAGA
GAAAGCTAAACGAGGAATATTTAAAGTGGGTCGTTATAGACCTGATATGCCTTGTTTTCTTTTATCAAAC
CAGAATGCTGTGAAAGCTGAGCCAAAAAAGGCTATTCCATCTTCTGTACGGATTACAAGGTCAAAGGCCA
AAGACCAAATGGAGCAGACTAAGATTGATAACGAGAGTGATGTTCGAGCAATCCGACCTGGTCCAACACA
AACTTCTGAAAAGAAAGTGTCAGACAAAGAGAAAAAAGTTGTGCAGCCTGTAATGCCCACGTCGTTGAGA
ATGACTCGATCAGCTACTCAAGCAGCAAAGCAGGTTCCAGAACAGTCTCATCTACCACAGCAAGAAAGC

FIGURE 286 cont'd

CAGTCACAAGAGCTGCTAATGAAAACGAACCAGAAGGAAAGGTGCCAAGTAAAGGAAGACCTGCCAAAAA
TGTAGAAACAAAACCCGACAAGGGTATTTCTTGTAAAGTCGATAGTGAAGAAAATACTTTGAATTCACAA
ACTAATGCAACAAGTGGAATGAATCCAGATGGAGTCTTATCAAAAATGGAAAACTTACCTGAGATAAATA
CTGCAAAAATAAAAGGGAAGAATTCCTTCGCACCTAAGGATTTTATGTTTCAGCCACTGGATGGTCTGAA
GACCTATCAAGTAACACCTATGACTCCCAGAAGTGCCAATGCTTTTTTGACACCCAGTTACACCTGGACT
CCTTTAAAAACAGAAGTTGATGAGTCTCAAGCAACAAAAGAAATTTTGGCACAAAAATGTAAAACTTACT
CTACCAAGACAATACAGCAAGATTCAAATAAATTGCCATGTCCTTTGGGTCCTCTAACTGTTTGGCATGA
AGAACATGTTTTAAATAAAAATGAAGCTACTACTAAAAATTTAAATGGCCTTCCAATAAAAGAAGTCCCA
TCACTTGAAAGAAATGAAGGTCGAATTGCTCAGCCCCACCATGGTGTGCCATATTTCAGAAATATCCTCC
AGTCAGAAACTGAGAAATTAACTTCACATTGCTTCGAGTGGGACAGGAAACTTGAATTGGACATTCCAGA
TGATGCTAAAGATCTTATTCGCACAGCAGTTGGTCAAACAAGACTCCTTATGAAGGAAAGGTTTAAACAG
TTTGAAGGACTGGTTGATGATTGTGAATATAAACGAGGTATAAAGGAGACTACCTGTACAGATCTGGATG
GATTTTGGGATATGGTTAGTTTTCAGATAGAAGATGTAATCCACAAATTCAACAATCTGATCAAACTTGA
GGAATCTGGGTGGCAAGTCAATAATAATATGAATCATAATATGAACAAAAATGTCTTTAGGAAAAAAGTT
GTCTCAGGTATAGCAAGTAAACCAAAACAGGATGATGCTGGAAGAATTGCAGCGAGAAATCGCCTAGCTG
CCATAAAAAATGCAATGAGAGAGAGAATTAGGCAGGAAGAATGTGCTGAAACAGCAGTTTCTGTGATACC
AAAGGAAGTTGATAAAATAGTGTTCGATGCTGGATTTTTCAGAGTTGAAAGTCCTGTTAAATTATTCTCA
GGACTTTCTGTCTCTTCTGAAGGCCCTTCTCAAAGACTTGGAACACCTAAGTCTGTCAACAAAGCTGTAT
CTCAGAGTAGAAATGAGATGGGCATTCCACAACAAACTACATCACCAGAAAATGCCGGTCCTCAGAATAC
GAAAAGTGAACATGTGAAGAAGACTTTGTTTTTGAGTATTCCTGAAAGCAGGAGCAGCATAGAAGATGCT
CAGTGTCCTGGATTACCAGATTTAATTGAAGAAACCATGTTGTAAATAAGACAGACTTGAAGGTGGATT
GTTTATCCAGTGAGAGAATGAGTTTGCCTCTTCTTGCTGGTGGAGTAGCAGATGATATTAATACTAACAA
AAAAGAAGGAATTTCAGATGTTGTGGAAGGAATGGAACTGAATTCTTCAATTACATCACAGGATGTTTTG
ATGAGTAGCCCTGAAAAAAATACAGCTTCACAAAATAGCATCTTAGAAGAAGGGGAAACTAAAATTTCTC
AGTCAGAACTATTTGATAATAAAAGTCTCACTACTGAATGCCACCTTCTTGATTCACCAGGTCTAAACTG
CAGTAATCCATTTACTCAGCTGGAGAGGAGACATCAAGAACATGCCAGACACATTTCTTTTGGTGGTAAC
CTGATTACTTTTTCACCTCTACAACCAGGAGAATTTTGAATTTAAAAATAAATCCAAACATTTTCCTTCA
TATTATCAATGCTTATATATTCCTTAGACTATTGAAATTTTGGAGAAAATGTATTTGTGTTCACTTCTAT
AGCATATAATGTTTTAATATTCTGTGTTCATCAAAGTGTATTTTAGATATACTCTTTCTCAAGGGAAGTG
GGGATATTTTGTACATTTTCAACACAGAATAAAAAATGTACTGTGCCTTG

FIGURE 287
SEQ ID NO: 279
Genbank ID        : AF107493.1
Unigene ID(#167)  : Hs.439480
Unigene name      :       RNA binding motif protein 5    RBM5
>gi|9801844|gb|AF107493.1|AF107493   Homo   sapiens   LUCA-15   protein   mRNA,
splice va
riant, complete cds
GAATTCGGCACGAGCCTTGTTGGAGGTTCTGGGGCGCAGAACCGCTACTGCTGCTTCGGTCTCTCCTTGG
GAAAAAATAAAATTTGAACCTTTTGGAGCTGTGTGCTAAATCTTCAGTGGGACAATGGGTTCAGACAAAA
GAGTGAGTAGAACAGAGCGTAGTGGAAGATACGGTTCCATCATAGACAGGGATGACCGTGATGAGCGTGA
ATCCCGAAGCAGGCGGAGGGACTCAGATTACAAAAGATCTAGTGATGATCGGAGGGGTGATAGATATGAT
GACTACCGAGACTATGACAGTCCAGAGAGAGAGCGTGAAAGAAGGAACAGTGACCGATCCGAAGATGGCT
ACCATTCAGATGGTGACTATGGTGAGCACGACTATAGGCATGACATCAGTGACGAGAGGGAGAGCAAGAC
CATCATGCTGCGCGGCCTTCCCATCACCATCACAGAGAGCGATATTCGAGAAATGATGGAGTCCTTCGAA
GGCCCTCAGCCTGCGGATGTGAGGCTGATGAAGAGGAAAACAGGTGAGAGCTTGCTTAGTTCCTGATATT
ATTGTTCTCTTCCCCATTCCCACCTCAGTCCCTAAAGAACATCCTGATTCCCCCAGTCTTCAAGCACATG
AATTCAGAATGAAAGGTTTGCCATGGCTAAGGAATGTGACTCTTTGAAAACCATGTTAGCATCTGAGGAA
CTTTTTTAAACTTTGTTTTAGGGACTTTTTTTTCCTTAGGTAAGTAATGATTTATAAACTCCTTTTTTTT
TTTGACTATAGTCGGTTGCATGGTTACTTTAAGCGTGGAATCAAATGGAGTGGCATTTAGTTCAGGCGGC
TTGTTCCTTGCCATGGCAAAGTATCAAGAAGATCCCAAGTCAAGTCACATTTGTAAAGCTGCTTCCCAA
TTGGCTTTGTCACGCAGTGTTGAAGCAGTGGGAGAGAGATTCACCTGTTATAAAGGAACTGACTAACACA
AGTATCCCGTCTATATCTGAATGCTGTCTCTAGGTGTAAGCCGTGGTTTCGCCTTCGTGGAGTTTTATCA
CTTGCAAGATGCTACCAGCTGGATGGAAGCCAATCAGGTTGCTTCACTCACCAAGTCTAGATATTCATGA
AAATGGAACAAGTCTGTACAATTTTAAAAAAAGGTTGAAGGAGTGGTTTGTTCCAAAGGAGTGACTTTTT
TTTAAAAAAAAAGCTTTGTATATATTAAAATTGATGTTACTAGAATAAGTACAGTACCAAGGACTTCATT
ATAGAATTTGTTCTGCCTTTAAACATGGCTACCTACCTGGCAGGGCTTTGTTAACTACTGAATACCTGTC

FIGURE 287 cont'd

```
TGGTAATCACTAAAACATCTTTATGTTTCCCTTTTTTCTAGTTTGTTATATTCCTATTATGTCCATTGAG
AGTAAGCTTAGTATATCAAACTCTCCATTTGACAGTGAAGAGAACATAGTGAAAGTCTGTGGCGGCATTT
TTATAAGTAATTCCTTATTTCTGCCTGAAGACCACAAAGCCTCCTGGAGGCGTAACTGCTCAGACCGGTC
TTCAGGGAATATTTAAGGACTTAGTGGAATTTATGAACAATAAGTCTGATGAGATTAGCCTGGGAGTGGT
GTCCTGCAGCTGTCTAATCTAGAGTGGCATTAACATTCTAATCTCCTTGAGAATGCCTTTTATAGTCTGT
TCAAAGCAAGTCATTGATGGTTCTTCGAGGTAGTGTTAACTGAAGTGTTCTTCAGTTTGTCAAGATAATG
TTCAGTGCTTGGCACTTAAATAACATTTTTTGCAAGAACTCCAAGGCACATTATTGAATGCCTTTAACCA
AGTGCATTCTGGGAAGTTTGCTTGACTCATTATCTTGCTTTTCTGCAGCATTCTGTGATTTGAGTCATCC
ATGAATCCATGAATAAAAGTTACATTCTTTGATTGGTAATATTGCCATTTATAACAAGACTCACTAATGA
GGGTATCACTTTGACTGACTGATTTGTTAAAGTTTTTAAGCCTCTCATTTTCCTAACCCAGAAATCACAG
CCTGATTTTATTAAAAGTAGAGCTTCATTCATTTCATACCATAGATACCATCCTAGTAAATCCAGAACAT
ATACAAGGTTCATGTGAGTCTGCTTTCTTGACATGATAGCATTGTTTGATGCAGTGGATATGTCAGAATG
ACTAACCTAGGAGTTTGAAACTCCTAAGAAACTAAAACCTGTAAGACATTTAAAAGTCTCCACAATTTTA
ATGTATACAAAGCTATGTTACTGTGTAACACATTACAGTTCAAATTCACTCCAGAAATAAAAGGCCAGTA
GGATTAGGGACTCACTGGTAGTTTGGAGTCTCCCAGCACACATCCCTCCTAGTGGGATGATCTATTCACA
TATCTCCCAGCTTTTTTATTTTTGCTTCTGTATATCACAGTGAGTGGATGGCCCTTCAGCTTTTTCTCTC
CTGGCCAGACATGCAGTCTTGCCTTTAGATATCGCAGAGACAAAATTCACAGCATGTCTTAAATCTTCCA
GGATTTGCAAGAACCAAATTGCTCAACAGTATGTATGTTTAGAGGGGTTAGACTCCTTTTTAAAATCTGG
ATATCTAACCACCTACTTAAATCTGTTTGATAGTGTCAAACCACCCCCACCCTTGATCCTCCCACCCCCA
AAAAAAAAAAAAAA
```

FIGURE 288
SEQ ID NO: 280
```
Genbank ID       : NM_022870.1
Unigene ID(#167) : acc_NM_022870.1
Unigene name     :
>gi|13124876|ref|NM_022870.1| Homo sapiens myosin, heavy polypeptide 11,
smooth
 muscle (MYH11), transcript variant SM3, mRNA
GCCTGGGAGGTGCGTCAGATCCGAGCTCGCCATCCAGTTTCCTCTCCACTAGTCCCCCCAGTTGGAGATC
TGGGACCAACAAGGCACCATGGCGCAGAAGGGCCAACTCAGTGACGATGAGAAGTTCCTCTTTGTGGACA
AAAACTTCATCAACAGCCCAGTGGCCCAGGCTGACTGGGCCGCCAAGAGACTCGTCTGGGTCCCCTCGGA
GAAGCAGGGCTTCGAGGCAGCCAGCATTAAGGAGGAGAAGGGGGATGAGGTGGTTGTGGAGCTGGTCGAG
AATGGCAAGAAGGTCACGGTTGGGAAAGATGACATCCAGAAGATGAACCCACCCAAGTTCTCCAAGGTGG
AGGACATGGCGGAGCTGACGTGCCTCAACGAAGCCTCCGTGCTACACAACCTGAGGGAGCGGTACTTCTC
AGGGCTAATATATACGTACTCTGGCCTCTTCTGCGTGGTGGTCAACCCCTATAAACACCTGCCCATCTAC
TCGGAGAAGATCGTCGACATGTACAAGGGCAAGAAGAGGCACGAGATGCCGCCTCACATCTACGCCATCG
CAGACACGGCCTACCGGAGCATGCTTCAAGATCGGGAGGACCAGTCCATTCTATGCACAGGCGAGTCTGG
AGCCGGGAAAACCGAAAACACCAAGAAGGTCATTCAGTACCTGGCCGTGGTGGCCTCCTCCCACAAGGGC
AAGAAAGACACAAGTATCACGGGAGAGCTGGAAAAGCAGCTTCTACAAGCAAACCCGATTCTGGAGGCTT
TCGGCAACGCCAAAACAGTGAAGAACGACAACTCCTCACGATTCGGCAAATTCATCCGCATCAACTTCGA
CGTCACGGGTTACATCGTGGGAGCCAACATTGAGACCTATCTGCTAGAAAAATCACGGGCAATTCGCCAA
GCCAGAGACGAGAGGACATTCCACATCTTTTACTACATGATTGCTGGAGCCAAGGAGAAGATGAGAAGTG
ACTTGCTTTTGGAGGGCTTCAACAACTACACCTTCCTCTCCAATGGCTTTGTGCCCATCCCAGCAGCCCA
GGATGATGAGATGTTCCAGGAAACCGTGGAGGCCATGGCAATCATGGGTTTCAGCGAGGAGGAGCAGCTA
TCCATATTGAAGGTGGTATCATCGGTCCTGCAGCTTGGAAATATCGTCTTCAAGAAGGAAAGAAACACAG
ACCAGGCGTCCATGCCAGATAACACAGCTGCTCAGAAAGTTTGCCACCTCATGGGAATTAATGTGACAGA
TTTCACCAGATCCATCCTCACTCCTCGTATCAAGGTTGGGCGAGATGTGGTACAGAAAGCTCAGACAAAA
GAACAGGCTGACTTTGCTGTAGAGGCTTTGGCCAAGGCAACATATGAGCGCCTTTTCCGCTGGATACTCA
CCCGCGTGAACAAGGCCCTGGACAAGACCCATCGGCAAGGGGCTTCCTTCCTGGGGATCCTGGATATAGC
TGGATTTGAGATCTTTGAGGTGAACTCCTTCGAGCAGCTGTGCATCAACTACACCAACGAGAAGCTGCAG
CAGCTCTTCAACCACACCATGTTCATCCTGGAGCAGGAGGAGTACCAGCGCGAGGGCATCGAGTGGAACT
TCATCGACTTTGGCTGGACCTACAGCCCTGCATCGAGCTCATCGAGCGACCGAACAACCCTCCAGGTGT
GCTGGCCCTGCTGGACGAGGAATGCTGGTTCCCCAAAGCCACGGACAAGTCTTTCGTGGAGAAGCTGTGC
ACGGAGCAGGGCAGCCACCCCAAGTTCCAGAAGCCCAAGCAGCTCAAGGACAAGACTGAGTTCTCCATCA
TCCATTATGCTGGGAAGGTGGACTATAATGCGAGTGCCTGGCTGACCAAGAATATGGACCCGCTGAATGA
CAACGTGACTTCCCTGCTCAATGCCTCCTCCGACAAGTTTGTGGCCGACCTGTGGAAGGACGTGGACCGC
ATCGTGGGCCTGGACCAGATGGCCAAGATGACGGAGAGCTCGCTGCCCAGCGCCTCCAAGACCAAGAAGG
GCATGTTCCGCACAGTGGGGCAGCTGTACAAGGAGCAGCTGGGCAAGCTGATGACCACGCTACGCAACAC
CACGCCCAACTTCGTGCGCTGCATCATCCCCAACCACGAGAAGAGGTCCGGCAAGCTGGATGCGTTCCTG
```

FIGURE 288 cont'd

```
GTGCTGGAGCAGCTGCGGTGCAATGGGGTGCTGGAAGGCATTCGCATCTGCCGGCAGGGCTTCCCCAACC
GGATCGTCTTCCAGGAGTTCCGCCAACGCTACGAGATCCTGGCGGCGAATGCCATCCCCAAAGGCTTCAT
GGACGGGAAGCAGGCCTGCATTCTCATGATCAAAGCCCTGGAACTTGACCCCAACTTATACAGGATAGGG
CAGAGCAAAATCTTCTTCCGAACTGGCGTCCTGGCCCACCTAGAGGAGGAGCGAGATTTGAAGATCACCG
ATGTCATCATGGCCTTCCAGGCGATGTGTCGTGGCTACTTGGCCAGAAAGGCTTTTGCCAAGAGGCAGCA
GCAGCTGACCGCCATGAAGGTGATTCAGAGGAACTGCGCCGCCTACCTCAAGCTGCGGAACTGGCAGTGG
TGGAGGCTTTTCACCAAAGTGAAGCCACTGCTGCAGGTGACACGGCAGGAGGAGGAGATGCAGGCCAAGG
AGGATGAACTGCAGAAGACCAAGGAGCGGCAGCAGAAGGCAGAGAATGAGCTTAAGGAGCTGGAACAGAA
GCACTCGCAGCTGACCGAGGAGAAGAACCTGCTACAGGAACAGCTGCAGGCAGAGACAGAGCTGTATGCA
GAGGCTGAGGAGATGCGGGTGCGGCTGGCGGCCAAGAAGCAGGAGCTGGAGGAGATACTGCATGAGATGG
AGGCCCGCCTGGAGGAGGAGGAAGACAGGGCCAGCAGCTACAGGCTGAAAGGAAGAAGATGGCCCAGCA
GATGCTGGACCTTGAAGAACAGCTGGAGGAGGAGGAAGCTGCCAGGCAGAAGCTGCAACTTGAGAAGGTC
ACGGCTGAGGCCAAGATCAAGAAACTGGAGGATGAGATCCTGGTCATGGATGATCAGAACAATAAACTAT
CAAAAGAACGAAAACTCCTTGAGGAGAGGATTAGTGACTTAACGACAAATCTTGCAGAAGAGGAAGAAAA
GGCCAAGAATCTTACCAAGCTGAAAAACAAGCATGAATCTATGATTTCAGAACTGGAAGTGCGGCTAAAG
AAGGAAGAGAAGAGCCGACAGGAGCTGGAGAAGCTGAAACGGAAGCTGGAGGGTGATGCCAGCGACTTCC
ACGAGCAGATCGCTGACCTCCAGGCGCAGATCGCAGAGCTCAAGATGCAGCTGGCCAAGAAGGAGGAGGA
GCTGCAGGCGGCCCTGGCCAGGCTTGACGATGAAATCGCTCAGAAGAACAATGCCCTGAAGAAGATCCGG
GAGCTGGAGGGCCACATCTCAGACCTCCAGGAGGACCTGGACTCAGAGCGGGCCGCCAGGAACAAGGCTG
AAAAGCAGAAGCGAGACCTCGGCGAGGAGCTGGAGGCCCTAAAGACAGAGCTGGAAGACACACTGGACAG
CACAGCCACTCAGCAGGAGCTCAGGGCCAAGAGGGAGCAGGAGGTGACGGTGCTGAAGAAGGCCCTGGAT
GAAGAGACGCGGTCCCATGAGGCTCAGGTCCAGGAGATGAGGCAGAAACACGCACAGGCGGTGGAGGAGC
TCACAGAGCAGCTTGAGCAGTTCAAGAGGGCCAAGGCGAACCTAGACAAGAATAAGCAGACGCTGGAGAA
AGAGAACGCAGACCTGGCCGGGGAGCTGCGGGTCCTGGGCCAGGCCAAGCAGGAGGTGGAACATAAGAAG
AAGAAGCTGGAGGCGCAGGTGCAGACACTGAGTTTTTAGAAAAACATATCCACGGTAACCGGTCCCTGGC
AATTCTGTTTACATGAAATGGGGAGAAAGTCACCGAAATGGGTGCCGCCGGCCCCCACTCCCAATTCATT
CCCTAACCTGCAAACCTTTCCAACTTCTCACGTCAGGCCTTTGAGAATTCTTTCCCCCTCTCCTGGTTTC
CACACCTCAGACACGCACAGTTCACCAAGTGCCTTCTGTAGTCACATGAATTGAAAAGGAGACGCTGCTC
CCACGGAGGGGAGCAGGAATGCTGCACTGTTTACACCCTGACTGTGCTTAAAAACACTTTCACTAATAAA
TGGTTATAAATC
```

FIGURE 289
SEQ ID NO: 281
Genbank ID       : AK026384.1
Unigene ID(#167) : Hs.199776
Unigene name     :      potassium inwardly-rectifying channel, subfamily J, member 3    KCNJ3
>gi|10439234|dbj|AK026384.1|   Homo   sapiens   cDNA:   FLJ22731   fis,   clone HSI15841
```
CCTATAAAACTTCTTTAAGTATTGTAATTCCAGTCTGCCCCAACTTTAAAAAAAATTCTTATTAATATGT
CAGTCATTAATTGCTAGTTTGGGCTCTCATTATTTCCTGTTTTTAACAATTTTGTGATAATTTTATTAT
TGGCAAATTAATACATCAACACTTAAATCATTGACTATAATAATACCTTCTGGCTACCTCTGTATCAACC
AAATTCTGTAGGTGCAAACATATACCAGGGAATTCTTACTGGCAAAATGATCAATCTGGAGTGTGCATCC
ACTGTGAATGGAGCAAATTGCCCTATACCCATTGATAACCTAGCTTTCTTAGTTTGTAGATGTAGGAAAC
AAAATAGTGACAGAGAGAGAAGGGGGTCCACAGGGCATGGTATATTTATCAGCAGTGGAAAAAAGTGCG
TAGATCATTTAGTCCAAGAACTTAAAACTAAATAGAGCCATAATTTACTTTGGAGAGTCATTTTAATTTG
TCTTTGGTACCAAGGAGAAGACGGAACCAAAACAAACTCTCCAAGTATATTCACACATTCAACAAAATT
TTTGCATGCCTTCTATGTCGTAGGCATTTTTAGTTCCTGGGATTTGGACATGGCTAAGTCAGAGAAGGC
CATTGCTCACCATGAACACTGTATACCAGAAGGAGAGTGGGGAGGAGACAAAAAACAAATAAGACCACTT
CAGACAATCAAAGTATCAGTTAAGAGAATGAAAACAGGCCTGACTCAGTGGCTCACGCCTGTAATCCCAG
TACTTTGGGAGGCGGAGGTTGGGGATCACCTGAGGTCAGGAGATCGAGACCAGCCTGGACAACATGGTG
AAAACCCGTCTCTACTAAAAATACAAAAATTAACTGGGCATGGTGGCAGGCACCTGTAATCCCAGCTACT
GGGGAAGCTGAGGCAGGAGAATCGCTTGAACCTGGGAGGCGGAGGTTGCAGTGAGCCAAGATTCTGCCAC
TGCACTTCAGCCTGGGTGACAGTGCGAGACTCCATCTCAACATCAAAAAAAAAAAAAAAAAGAATAAAA
ACAGGGTAACATAATGCAAAGTAACTGTGTGGAATTAAAAATTGATTATTTTAGAAAATGTGACTGGCTT
AGGACGGGGATAATATGTGAACAGAAATCTATCTCATGAGAAAGTGCTACTGTTGTCAAAATTACCTTAT
CTGAGTGAATGGTATTTTTTTATCTTTTCCACACATGCGTGGGAAAGGTATGATTTCTGCATGTAATTG
```

FIGURE 289 cont'd

CAGTTTAACCCTTATTTCTAGGTTGATCATAGGTCCCAGTTTACCCAGGAAAATTCCAGTTTATACCTGT
TGTACCTGTGTAATTATTGGTAGCACTCCCTTTCACTCTTACAATGTCTTGGTTTGGATGATATATGGTG
AAGTTTTTGTTGAAACTAAATTATGAAGTCTGATATATTTGGATAAAAATAAAGAATTGCTTTTCTTCAA
AAAAAAAAAAAAAAAA

FIGURE 290
SEQ ID NO: 282
Genbank ID          : AI129381
Unigene ID(#167)    : Hs.354740
Unigene name        :     potassium    large    conductance    calcium-activated
channel, subfamily M, alpha member 1       KCNMA1
>gi|3597895|gb|AI129381.1|AI129381   qc34d02.x1  Soares_pregnant_uterus_NbHPU
Homo
  sapiens  cDNA  clone  IMAGE:1711491  3'  similar  to  TR:Q12791  Q12791  CALCIUM-
ACTIVA
TED POTASSIUM CHANNEL ;contains Alu repetitive element;, mRNA sequence
TTTTTTTTGGGATCTGTGATGTCATCATGACAGGCCTTGCAGTAAAAAAATGCCCTTTTAACTTCTTTGG
CATCACTTGCGATGAAAAATCCTAAAGTACCTTCTTGGATCTTAAGATGGTTTCCAGGATTAATTAATAT
ACGGCTCTCTCGGTTGGCAGACTTGTACTCAATGGCTATCATTAGGAGCTTGAGCTTCACAAAACACAGC
TCACAAACAGTAGGGAAGGACAGACCCACGAAGGCACTGGAGAGATATTCTGTGTACATTTCATTTGAGA
CTCCTTCCAAGTAGTATTTCTGCCATGTGTCTTCCTCAATCTTTATGAATGACCTCATGGAGAAGAGGTT
GGCAAGCATGGTGGAGAGGCCTTGAGCCAGGCAGCTCTGGGCTATGAAGCCCAACTTCAACTCTGCGAGG
CAGATTGCGTCATCACCTTCTTTCCAATTCCAGCTCGGGATGTTAGCAGATGGGCCTTGTTGTGATACT
GCAGCATTTGAGTGATGAT

FIGURE 291
SEQ ID NO: 283
Genbank ID          : AW151924
Unigene ID(#167)    : Hs.159142
Unigene name        :     lunatic fringe homolog (Drosophila) LFNG
>gi|6199744|gb|AW151924.1|AW151924  xf70d01.x1  NCI_CGAP_Gas4  Homo  sapiens
cDNA c
lone IMAGE:2623393 3', mRNA sequence
GCTGCAAAGAGCACCTTTATTCACAGCAAAAGGACGTCACCATAGCAACAACACTTCAATTCCCTGAGAA
CTTTTCCCTTATCATTCGCTTTCTAGCTATGTCTTTGCAAAGAGAAAAACAACAAGAAACACAGCCCAC
GGGACAGGTGAGCCATGCTGGGCCCAGCGGGGAGGTGGCAGCTACACAGGAGGAGGGCAGGGATGGGAGG
TTCCAGATGCTGGAACGCATAAATACACAGAGTGCCAGACAGTCCCACTTCAGCTTTAAAAACAAAGATG
ACCCCGAGTTTGGCTTCTGTTTTTTCTGATCCACAGAAAAGATAAGATAAAATAAGACCCTCCCCAACCC
CCACCCTCCCAAGCAAAAAACAAGAACACCCTACTTTTTACCCATCCCCTTTCAAAAAAAAACAGCACAGT
AAAAAAATACTGTCACAATATTTACAGACACGCCCACTGTGGGCGACTTGCTCTCTACTTTGGAGAGGAG
A

FIGURE 292
SEQ ID NO: 284
Genbank ID          : NM_020659.1
Unigene ID(#167)    : Hs.268728
Unigene name        :     tweety homolog 1 (Drosophila) TTYH1
>gi|10257436|ref|NM_020659.1|  Homo  sapiens  tweety  homolog  1  (Drosophila)
(TTYH1
), mRNA
CCGGCGTCCGCCCCGCTGCCCCCTCCCCCGGGGGCCATGGGGGCGCCCCGGGCTACCGGCCCTCAGCTT
GGGTGCATCTCCTCCACCAACTGCCCCGCGCCGACTTCCAGCTCCGCCCGGTGCCCAGCGTTTTCGCGCC
CCAAGAGCAGGAATACCAGCAGGCCTTGTTGCTGGTGGCGGCCTTGGCGGGCCTGGGCTTGGGCCTGAGC
CTCATTTTCATCGCTGTCTACCTCATCCGCTTCTGCTGCTGCCGGCCCCCGAGCCCCCGGGTCCAAGA
TCCCCTCGCCCGGGGGAGGCTGCGTCACCTGGAGCTGCATTGTCGCCCTTCTCGCCGGCTGCACTGGCAT
TGGCATCGGTTTCTATGGCAACAGTGAGACCAGTGATGGGGTGTCCCAGCTCAGCTCTGCGCTGCTGCAC
GCCAACCACACACTCAGCACCATTGACCACCTGGTGTTGGAGACGGTGGAGAGGCTGGGCGAGGCGGTGA FIGURE 292 cont'd

```
GGACAGAGCTGACCACCCTGGAGGAGGTGCTCGAGCCGCGCACGGAGCTGGTGGCTGCCGCCCGAGGGGC
TCGACGGCAGGCGGAGGCTGCGGCCCAGCAGCTGCAGGGGCTGGCCTTCTGGCAGGGAGTGCCCCTGAGC
CCCCTGCAGGTGGCTGAAAATGTGTCCTTTGTGGAGGAGTACAGGTGGCTGGCCTACGTCCTCCTGCTGC
TCCTGGAGCTGCTGGTCTGCCTCTTCACCCTCCTGGGCCTGGCGAAGCAGAGCAAGTGGCTGGTGATCGT
GATGACAGTCATGAGTCTCCTGGTTCTCGTCCTGAGCTGGGGCTCCATGGGCCTGGAGGCAGCCACGGCC
GTGGGCCTCAGTGACTTCTGCTCCAATCCAGACCCTTATGTTCTGAACCTGACCCAGGAGGAGACAGGGC
TCAGCTCAGACATCCTGAGCTATTATCTCCTCTGCAACCGGGCCGTCTCCAACCCCTTCCAACAGAGGCT
GACTCTGTCCCAGCGAGCTCTGGCCAACATCCACTCCCAGCTGCTGGGCCTGGAGCGAGAAGCTGTGCCT
CAGTTCCCTTCAGCGCAGAAGCCTCTGCTGTCCTTGGAGGAGACTCTGAATGTGACAGAAGGAAATTTCC
ACCAGTTGGTGGCACTGCTACACTGCCGCAGCCTGCACAAGGACTATGGTGCAGCCCTGCGGGCCTGTG
CGAAGACGCCCTGGAAGGCCTGCTCTTCCTGCTACTCTTCTCCCTGCTGTCTGCAGGAGCGCTGGCCACT
GCCCTCTGCAGCCTGCCCCGAGCCTGGGCCCTCTTCCCACCCAGTGACGACTACGATGACACAGACGATG
ACGACCCTTTCAACCCTCAGGAATCCAAGCGCTTTGTGCAGTGGCAGTCGTCTATCTGAGCCCCTCCTCC
CGGCTGGACTGGAGCCTGGCTCCCCTCTTCGTTCCTTCCCTGGCTGCCGGAGGAGACCCCACTAACCCAG
CCTGCCTGGGCTCTGACCACTAACACTCTTGGCCATGGACAGCCTGCACAGGACCGCCTCCCTGCTCTTG
GCCACTGTGCTCCCATTTCTGTCCTTGGCCTTGGGAGTAGCTGAGGGGGCAGACTAGGGAGTAGGGCTGG
CAGGGGAGGGGGCAGACAGCCTCGCCTCGCACCCTTCATCCCTGGCTGCCGGTCCCATCCTTGGAGGGAC
TAAGCTGGGGGTGGGGACATGAGTCCCCCTGCTGCCCCTGCCACATCCCAGTGGGCTCTGACCCCCTGAT
CTCAACTCGTGGCACTAACTTGGAAAAGGGTTGATTTAAAATAAAAGGGAAGACTATTTTACAAGC
```

FIGURE 293
SEQ ID NO: 285
Genbank ID      : BF063271
Unigene ID(#167) : Hs.278611
Unigene name    :    UDP-N-acetyl-alpha-D-galactosamine:polypeptide    N-acetylgalactosaminyltransferase 3 (GalNAc-T3)    GALNT3
>gi|10822181|gb|BF063271.1|BF063271  7h87d05.x1  NCI_CGAP_Co16  Homo  sapiens cDNA
clone IMAGE:3322953 3', mRNA sequence
```
TAGTCGCCTGAGGATTTTTTATTGTGTTTTCCACATAGATAAAAAAATAAGGCTTTTTGATGAAAAGAAT
CCATTACAAAGTCAAAAATCCATTACAATTATAATTGAATCAGTAACAAAATTTAGCTTTAAATGAGTCA
AGTATTCTGCATTTGAAATTTAATATCACAAACATTCAAGATTAGTGAATTTTGGTAAGAAAAAAATACT
AGAAGAAAGGAAAAGGACACCTTTTCAACAGATAGTAATTTATAAAAATTTTTTTAAAAGTGCTTTGGGA
AAACACACAGTATCATTACTTAAGAAAAGTCATTTAAGGAAGACTTAAGTGCTTCAAGTGGAGTGTATTA
CAGACTAAAAAATGTTTTAAAATTTGCCAAGAAATTTAAGTGTTAAAAATACTCTTCTCCTTATTCAGTT
TCATGTTTAAGGAAACATTTGACAGACAAGTAAACCAAACGCAAAAAAAGTTCACCTGCATTTTAAACT
AATAAATTCTGGATCTGTAAAAGCTCTTGGTTTGTACACAGAGGCCAATGCTGACATTTATTGATCTATT
TTTATGTAGTTAA
```

FIGURE 294
SEQ ID NO: 286
Genbank ID      : NM_002381.2
Unigene ID(#167) : Hs.278461
Unigene name    :     matrilin 3   MATN3
>gi|13518040|ref|NM_002381.2| Homo sapiens matrilin 3 (MATN3), mRNA
```
AAATCCGAGCCTCGCGTGGGCTCCTGGCCCCGACGGACACCACCAGGCCCACGGAGCCCACCATGCCGC
GCCCGGCCCCCGCGCCGCGCCTCCCGGGACTCCTCCTGGCCGCCCTGCTGCTGCTGCTGCCCTGCTCCGC
CGCCCCGACCCGTGGCCGCCGCCGGGCTTCCGAGGCTGGAGACCCGAGGTCCCGGGGGCAGCCCTGGA
CGCCGCCCCTCTCCTGCGGCTCCCGACGGCGCGCCCGCTTCCGGGACCAGCGAGCCTGGCCGCGCCCGCG
GTGCAGGTGTTTGCAAGAGCAGACCCTTGGACCTGGTGTTTATCATTGATAGTTCTCGTAGCGTACGGCC
CCTGGAATTCACCAAAGTGAAAACTTTTGTCTCCCGGATAATCGACACTCTGGACATTGGGCCAGCCGAC
ACGCGGGTGGCAGTGGTGAACTATGCTAGCACTGTGAAGATCGAGTTCCAACTCCAGGCCTACACAGATA
AGCAGTCCCTGAAGCAGGCTGTGGGTCGAATCACACCCTTGTCAACAGGCACCATGTCAGGCCTAGCCAT
CCAGACAGCAATGGACGAAGCCTTCACAGTGGAGGCAGGGGCTCGAGAGCCCTCTTCTAACATCCCTAAG
GTGGCCATCATTGTTACAGATGGGAGGCCCAGGACCAGGTGAATGAAGTGGCGGCTCGGGCCCAAGCAT
CTGGTATTGAGCTCTATGCTGTGGGCGTGGACCGGGCAGACATGGCGTCCCTCAAGATGATGGCCAGTGA
GCCCCTAGAGGAGCATGTTTTCTACGTGGAGACCTATGGGGTCATTGAGAAACTTTCCTCTAGATTCCAG
GAAACCTTCTGTGCGCTGGACCCCTGTGTGCTTGGAACACACCAGTGCCAGCACGTCTGCATCAGTGATG
```

FIGURE 294 cont'd

```
GGGAAGGCAAGCACCACTGTGAGTGTAGCCAAGGATACACCTTGAATGCCGACAAGAAAACGTGTTCAGC
TCTTGATAGGTGTGCTCTTAACACCCACGGATGTGAGCACATCTGTGTGAATGACAGAAGTGGCTCTTAT
CATTGTGAGTGCTATGAAGGTTATACCTTGAATGAAGACAGGAAAACTTGTTCAGCTCAAGATAAATGTG
CTTTGGGTACCCATGGGTGTCAGCACATTTGTGTGAATGACAGAACAGGGTCCCATCATTGTGAATGCTA
TGAGGGCTACACTCTGAATGCAGATAAAAAAACATGTTCAGTCCGTGACAAGTGTGCCCTAGGCTCTCAT
GGTTGCCAGCACATTTGTGTGAGTGATGGGGCCGCATCCTACCACTGTGATTGCTATCCTGGCTACACCT
TAAATGAGGACAAGAAAACATGTTCAGCCACTGAGGAAGCACGAAGACTTGTTTCCACTGAAGATGCTTG
TGGATGTGAAGCTACACTGGCATTCCAGGACAAGGTCAGCTCGTATCTTCAAAGACTGAACACTAAACTT
GATGACATTTTGGAGAAGTTGAAAATAAATGAATATGGACAAATACATCGTTAAATTGCTCCAATTTCTC
ACCTGAAAATGTGGACAGCTTGGTGTACTTAATACTCATGCATTCTTTTGCACACCTGTTATTGCCAATG
TTCCTGCTAATAATTTGCCATTATCTGTATTAATGCTTGAATATTACTGGATAAATTGTATGAAGATCTT
CTGCAGAATCAGCATGATTTTTCCAAGGAAATACATATGCAGATACTTATTAAGAGCAAACTTTAGTGTC
TCTAAGTTATGACTGTGAAATGATTGGTAGGAAATAGAATGAAAAGTTTAGTGTTTCTTTATCTACTAAT
TGAGCCATTTAATTTTTAAATGTTTATATTAGATAACCATATTCACAATGGAAACTTTAGGTCTAGTTTC
TTTTGATAGTATTTATAATATAAATCAATCTTATTACTGAGAGTGCAAATTGTACAAGGTATTTACACAT
ACAACTTCATATAACTGAGATGAATGTAATTTTGAACTGTTTAACACTTTTTGTTTTTTGCTTATTTTGT
TGGAGTATTATTGAAGATGTGATCAATAGATTGTAATACACATATCTAAAAATAGTTAACACAGATCAAG
TGAACATTACATTGCCATTTTTAATTCATTCTGGTCTTTGAAAGAAATGTACTACTAAAGAGCACTAGTT
GTGAATTTAGGGTGTTAAACTTTTTACCAAGTACAAAAATCCCAAATTCACTTTATTATTTTGCTTCAGG
ATCCAAGTGACAAAGTTATATATTTATAAAATTGCTATAAATCGACAAAATCTAATGTTGTCTTTTTAAT
GTTAGTGATCCACCTGCCTCAGCCTCCCAAAGTGCTGGGATTACAGGCTTGAAAGTCTAACTTTTTTTTA
CTTATATATTTGATACATATAATTCTTTTGGCTTTGAAACTTGCAACTTTGAGAACAAAACAGTCCTTTA
AATTTTGCACTGCTCAATTCTGTTTTTCGTTTGCATTGTCTTTAATATAATAAAAGTTATTACCTTTACA
TATTATCATGTCTATTTTTGATGACTCATCAATTTTGTCTATTAAAGATATTTCTTTAAATTAAAAAAAA
AAAAAAAAA
```

FIGURE 295
SEQ ID NO: 287
Genbank ID      : BF589529
Unigene ID(#167) : Hs.497208
Unigene name    :       DBCCR1-like DBCCR1L
>gi|11681865|gb|BF589529.1|BF589529 naa05f05.x1 NCI_CGAP_Pr28 Homo sapiens cDNA
  clone IMAGE:3254144 3' similar to TR:O95560 O95560 HYPOTHETICAL 88.7 KD PROTEI
N ;, mRNA sequence
```
AATAACTGTTCAGCTACAAAATTTTATTGGTATCTTTTTATGTTCCCTCTAGAGGATGTAATGCACAAAA
GCATTGCCACGGAACATATAAAATTACAAATGAAATTTATTGTAAAAGTAGAATGTCTTCTAGACTGGT
GTCAGTATTTATGTCATTCATAAACCAAAACTGCTGTATAATATATTCATTGTCAGCAAGTTCATGTGTG
TAAATTGCCATCCAATGTTATTGACTGATATAAGACAGATATTGAAAAGACAATTTAAATTTACTCTTCC
AAACATAAACTGTTCCACAAAAGCACTGTAAAAACTCCTTCAAGATTTTGGGTTGTGCTTGACATTTATG
GTTAACTACATAATTTGGTCGTGTCATAATCCATTGTGTTTGGCAATTTGGCATTAAACGCCTGCAGAGC
AGATTGGATCCTCACCACCTCACTAGTAGACAGCTTGAGTCTATGACGAAGCAAGCAAGAGAAAAGATCT
AGACGACGCTGACCAGGTGGGGAGAGTNTATTTACACGGTCTCTGATCTCTAGTAGTTGCAAAAGTGCTG
AATCCTGNGATCCCTGAGTATAGGGGTAGTCCAGCTGCAAAATCAGGTCCCGAATTGC
```

FIGURE 296
SEQ ID NO: 288
Genbank ID      : AW629527
Unigene ID(#167) : Hs.338851
Unigene name    :       FLJ41238 protein FLJ41238
>gi|7376317|gb|AW629527.1|AW629527 hi59h01.x1 Soares_NFL_T_GBC_S1 Homo sapiens
cDNA clone IMAGE:2976625 3', mRNA sequence
```
TTTTTTTTTTTTTGATAGGCTCAGCAGCATTTATTTTCTAGTTTTAAGAAAATTTGATTATTCTTGTATG
AGGTCTAAAGTGTGTATCTATCAGTCCAATCAAGCTTTTAAATTTTCGGAAATACTAAATTTCTAAATCA
TAAAGCGTCATTTAAAAATAATTAATTGTTTCAGTCCAAAAATAGCGTGGGTCAAACTGGAATTTTCAAA
GTGACGTATCTGTGGATGATATGCTTATGGTACCAAAAAGACTCTCAAAAACCAATACTCCCACGGGCAA
```

FIGURE 296 cont'd

```
GGGAATAGCCAAGTTTGTTGCGGTTTCCAATGAATGACATCAGCCCTGTGTAGGTCTCAATCAAAATGGG
TTCAGTTAACACCATCAGTTTCTTTCCTCTTCCAGATCCAGTTGAATTCTTGTGGGCATTCTGGATAGCT
GGAACAAGCTTAGACATGAACCCAGACAACTTGCAAATTTCAAGGAATTTCTCACTGGTGTATTTCATAG
GATGCTCAGTGAAAGTAGCATAAGGAACTTCAGTGGACCATGGGTTCCAGCGGGACA
```

FIGURE 297
SEQ ID NO: 289
Genbank ID         : AU144916
Unigene ID(#167)   : Hs.222056
Unigene name       :      CDNA FLJ11572 fis, clone HEMBA1003373.
>gi|11006437|gb|AU144916.1|AU144916 AU144916 HEMBA1 Homo sapiens cDNA clone HEM
BA1003373 3', mRNA sequence

```
GAGACAGCGTCTCACCTTGTCATCTAGGCTGGAGTGCAGTGGCTCCATCATAGCCTCCTGCAGCCTTGAT
GACTGTGCTAGAGCCACCCTCTCACTTTAGCCTCCTGAGTAGCTGGGACTACAGGTGCTTCCCACTGTGC
CTGGCCAATTAACAATTTCATTTTTATTTTTAGTAGAGATGAGATCTCACTATGTTGCCCAGGCTGGTCC
TGAACTCCTGAGCTCAAGAGATCCTCCCACCTTGGCCTCCCAAAGTACTGGGATTACAAACAAGAGCCAC
TGTGCCTGACCAGGCTCTAAGATTGCTAATCTGGCTATAGAAGGACTAATGTTGGCCACCTCAGAGACAT
TCATTCATTTTAAGAAACATCATCTTTCACTGAATATAATATGACATTTTTTAGAAGGCACAGCATATAT
GTACCATAAAGAGCCATCTCAACTCTGACATAAACTTTGNTATCATACAGCATGNTTATTTTATGCGAAT
GAAAGAACTCTTTTAGATGGTTTAGACNCCAATNTNTCATATNACCCCCTGGN
```

FIGURE 298
SEQ ID NO: 290
Genbank ID         : AU160004
Unigene ID(#167)   : Hs.79440
Unigene name       :      IGF-II mRNA-binding protein 3 IMP-3
>gi|11021525|gb|AU160004.1|AU160004 AU160004 Y79AA1 Homo sapiens cDNA clone Y79
AA1000871 3', mRNA sequence

```
AATTTATCACGTGCTTAAAAATCTTCAAAATAGCTTAGTGAGGCTCATGACAGTGCTGGCCCCATGGAAA
TGTAGTCTTTTGTTGCGTTTAAACACTGTCACACCATCTATGACTGTCCCATTGGTCTGAAGTGTAGTGG
CAAACTAAGCATCCTATAAGACAAGCTAAAGCTTGCTTTTTGCCAGTCAGTTGAAAGTCTTGCATCTCTT
CACTGATGCACTTTCTTTAGGTATTGATAGTCAGAAGCACAAAGCATTTATTATGCATTCAATCATGTAG
CTAAACAAAAAACTGAAGTCTCCTGAAGCCATTTAAACCAGCCGTTCCAAAATCTCCTGCGACCACTTTG
TTAGTACCGCAAAAACTTTCCCACTATAAATGAAGGAATAAATGGTAGTGCTGCTCTCCAGAATCCTANG
GCACTGGTTCCGNATTTTGGACCATTGGATTTAACTAATAACTGGGGCAAAAGCCTCAAAAAACCCTGAA
ATAAATTTCCAGCTTTACTGGNACCAGCCNNAAGTAAAAANCTTAATTTGCCTGGTAACTGGATGGCNGN
AAAATTTAAATTN
```

FIGURE 299
SEQ ID NO: 291
Genbank ID         : NM_021067.1
Unigene ID(#167)   : acc_NM_021067.1
Unigene name       :
>gi|10800147|ref|NM_021067.1|  Homo    sapiens   KIAA0186   gene   product
(KIAA0186), mR
NA

```
CTAGAACGAAAGGAGTGAGGCGCCGAGAGCCCAGATACCATTTTGGCGTGAGAGCTGGTGGTTGGCAAGG
CCGCGGGAGTGGGAAGCGTCCGCCATGTTCTGCGAAAAAGCCATGGAACTGATCCGCGAGCTGCATCGCG
CGCCCGAAGGGCAACTGCCTGCCTTCAACGAGGATGGACTCAGACAAGTTCTGGAGGAGATGAAAGCTTT
GTATGAACAAAACCAGTCTGATGTGAATGAAGCAAAGTCAGGTGGACGAAGTGATTTGATACCAACTATC
AAATTTCGACACTGTTCTCTGTTAAGAAATCGACGCTGCACTGTAGCATACCTGTATGACCGCTTGCTTC
GGATCAGAGCACTCAGATGGGAATATGGTAGCGTCTTGCCAAATGCATTACGATTTCACATGGCTGCTGA
AGAAATGGAGTGGTTTAATAATTATAAAAGATCTCTTGCTACTTATATGAGGTCACTGGGAGGAGATGAA
```

FIGURE 299 cont'd

```
GGTTTGGACATTACACAGGATATGAAACCACCAAAAAGCCTATATATTGAAGTCCGGTGTCTAAAAGACT
ATGGAGAATTTGAAGTTGATGATGGCACTTCAGTCCTATTAAAAAAAAATAGCCAGCACTTTTTACCTCG
ATGGAAATGTGAGCAGCTGATCAGACAAGGAGTCCTGGAGCACATCCTGTCATGACCATGCGCCGAGGCA
CTTCCAGGCTTCACTCAACTCATGGACTCCTCTGTACTCACTCTCTCCACCCTCCCTTCACCTCCCTCTT
TGATTTTAGAAGCTATAGACATTGTTTAAGATAACTAAGAATACTTGGCTAAGAAGTATAATTTGCTAAC
TATTAAGGACTTTCTTTTTTTAATGTTGTACACTATTCTTCCTACTCTTTTTTGGTTTTTGGTTTTGTTTT
GTAGAGACTGTCTCACTATGTTGCCCAAGCTGGTCTCAAACTCCTGGCCTCAAGCAGTCCTCCCACCTTA
GCTTCTCAAAGTGTTGAGATCACAGGCGTGAGCCACTGCACCCGACCCCTACTCCTTTTTCTAATAAGCT
GTATCTGTAATCACAGCATTCCTACAGTTGTTACAGTGTGTTTTTAAATGAAAGTAAACATGGTTACAT
TTGAATCTCTTAAATAATCAGTCACTTGGCTGGACAGGAAGAAGGTAGATCCTGTGTGTCTTGTTTTCTG
GTCATGTGTATTGTACAAGCTAGAGAGCTGAATTTCTGAGATACACATTTTCAAATCACATGCAAGTGAA
GATGATGGTCTGTAGAAATTTTCAGTATATATAATGTTTAATGACATACTAATTTATCATCTGGCTATTT
GGGAAGGAAGGACACACATGGATTTTGCACATTTCCACCATGGTGGCTGGTGTGGCTTGTGGCTATGGGG
TGATCACCAGTATCACCACTTTGGAAGGGGACAGTGAAATTGGGGCTAGAGAAGGAACTTTGTACAGTTT
TCCCTGAGATTCAGATTGACTGAAAAGTCACATGAAGAGTTGATTGTCTTTTAATGGTATGTTTTAAACA
GCTGACATTTTAAATTTTGATGAAATCCAGTTTATTCGTTTGTTCTTTTATGCTTTGGGTGTTGCATCCG
AGAAATCTTTTCCCATCCCAAGATCACAATTTTTTTTTCCTTTTTACTTCTAGAAGTGTTATAATTTTAAG
CTTTATACTTTGGTCTATGACCCGTTTTTTTTTTGTTTTGTTTTGTTTTTTCGTTTGTTTCTTTGTTTT
GAGATGGAGTCTTGTTCTGTCACCCAGGCTGGGGTGCAGTGGCGTGATCTTGGCTCACTGCAATCTCTAT
CCCCTGGGTTCAAGTGATTCTCTTGTCTCAGCCTCCCAAGTAGCTGGGATTACAGGCACAGGCCGCCACG
CCCGGCTAATTTTTGTATTTTTAGTAGAGACAGAGTTTTACCATGTTGGCCAGGCTGGTTTCAAACTCCT
GACCTCAAGTGACCCACCTTGGCCTCCCAAAGTTTTGGGATTACAAGTGTGGGCCACCGCGGCCAGCCTA
TGATCCATTTTGAATGAATTTTTTATATGGTGCAAGGTGTCAATCCACCTTCACTTTTTCTTGGGAATAT
AGATATCCAGCTGTTTCACTACCATTTTTTGAAAGGACTGCCCTTTGCTCTATCACCTTTGCATTTTTGT
TAAAAAGTAGTTGTCAATGTATATGTGGGTTTATTTCAGGACTCTGTTTTGTTCCATTGACCTGTTTTTC
TCTCCTGAATGCCAATACCATATTTGTATGTAGTGTATGTAATTTTCTAATAATTCTTGAAACAGATAGT
ATTAATGCGTCATATTTTTGCTGTTGTTTGTATTTTTTGTGGAGATGGGGTTTCACCATGTTGGCCAGGC
TGTGTTGAACTCCTGAGCTAAAGCAATACACTTGCCTCGTCGTCCTCCCCATGTGCTGGGATTACAGGCGTGA
GCCTTGGTGCTGGCCCAGTGTACCACATTTCTTTTGAGATTTGTTTTGGCTATGTTAAGTCCTTTGCTT
TTGATGTGAAATTTGGGAACAGGCAGGGTGTGGTGGCTTATGCCTGTAATCCTAGAACTTTGGGAGGCCT
AGATGGGTGGATCACTTGAGCTCAGGAGTTCCAGACCAGCCCGGGCCTATGGCGAAACTCCGTCTCTACA
AAAAATAGAAAAAATTAGCCAGGTGTGGTGGTGCATGCCTGTAGTCACAGTTACACGGCAGGCTGAGGTG
GGAGGATCACTTGAACCCCAGAGGTCAAGACTGCAGTGAGCTGAGATCACACCACTGTACTCCAGCCTGG
GTGACAAAGTGAGACTCTATCTCAAAAAGAAATTAGGATCAACTTGTCAATTTCTACAACAACAACAACA
AAAACCCCTGTTGGGCACCTTGATTGAGATTGCATTGAATTTATATAAAACTGTTGGGAGAATTGACATC
TTAATAATATTGAGTCTTCTGGCCTATAAACAAGGTCTGTCTTCCTAGGTATTAATGTTTTGTCTTCTAT
TTCTCTTAATAATCTTTTGTAGTTTTCAGTGTACAGGTCTACCATGTCAGCATTTCATAGTTTTGATGCT
AAATGGTATTTTAAAATTTCAAATTCTAACCACTTGTTGCTAGTAAATAGAAATACAATTGATGTTGAAC
TTGTATCCTTCAGCCTTGCTAAACTGTGAGTTCTCATGGTGTTTTTGTAAATTACATCAACAGTCATGTG
TTCTATGAATAAAGAGTTTTACTCCTTC
```

FIGURE 300
SEQ ID NO: 292
Genbank ID    : AF011390.1
Unigene ID(#167) : Hs.5462
Unigene name    :    solute   carrier   family   4,   sodium   bicarbonate
cotransporter, member 4 SLC4A4
>gi|3298567|gb|AF011390.1|AF011390 Homo sapiens pancreas sodium bicarbonate cot
ransporter mRNA, complete cds

```
GCGGCGGCGGCCGCGGTGGCAGCGAAGGCGGCGGCGGCGGCAGTGGCAGTGGCCGCTGCAGCCCCAC
ACTCCGCCGCCAAACTGGAGGAGCGACGGAAGCCAGACCCCAGGAGGATGGAGGATGAAGCTGTCCTGGA
CAGAGGGGCTTCCTTCCTCAAGCATGTGTGTGATGAAGAAGAAGTAGAAGGCCACCATACCATTTACATC
GGAGTCCATGTGCCGAAGAGTTACAGGAGAAGGAGACGTCACAAGAGAAAGACAGGGCACAAAGAAAAGA
AGGAAAAGGAGAGAATCTCTGAGAACTACTCGACAAATCAGATATTGAAAATGCTGATGAATCCAGCAG
CAGCATCCTAAAACCTCTCATCTCTCCTGCTGCAGAACGCATCCGATTCATCTTGGGAGAGGAGGATGAC
AGCCCAGCTCCCCCTCAGCTCTTCACGGAACTGGATGAGCTGCTGGCCGTGGATGGGCAGGAGATGGAGT
GGAAGGAAACAGCCAGGTGGATCAAGTTTGAAGAAAAGTGGAACAGGGTGGGGAAAGATGGAGCAAGCC
CCATGTGGCCACATTGTCCCTTCATAGTTTATTTGAGCTGAGGACATGTATGGAGAAAGGATCCATCATG
CTTGATCGGGAGGCTTCTTCTCTCCCACAGTTGGTGGAGATGATTGTTGACCATCAGATTGAGACAGGCC
```

FIGURE 300 cont'd

TATTGAAACCTGAACTTAAGGATAAGGTGACCTATACTTTGCTCCGGAAGCACCGGCATCAAACCAAGAA
ATCCAACCTTCGGTCCCTGGCTGACATTGGGAAGACAGTCTCCAGTGCAAGTAGGATGTTTACCAACCCT
GATAATGGTAGCCCAGCCATGACCCATAGGAATCTGACTTCCTCCAGTCTGAATGACATTTCTGATAAAC
CGGAGAAGGACCAGCTGAAGAATAAGTTCATGAAAAAATTGCCACGTGATGCAGAAGCTTCCAACGTGCT
TGTTGGGGAGGTTGACTTTTTGGATACTCCTTTCATTGCCTTTGTTAGGCTACAGCAGGCTGTCATGCTG
GGTGCCCTGACTGAAGTTCCTGTGCCCACAAGGTTCTTGTTCATTCTCTTAGGTCCTAAGGGGAAAGCCA
AGTCCTACCACGAGATTGGCAGAGCCATTGCCACCCTGATGTCTGATGAGGTGTTCCATGACATTGCTTA
TAAAGCAAAAGACAGGCACGACCTGATTGCTGGTATTGATGAGTTCCTAGATGAAGTCATCGTCCTTCCA
CCTGGGGAATGGGATCCAGCAATTAGGATAGAGCCTCCTAAGAGTCTTCCATCCTCTGACAAAGAAAGA
ATATGTACTCAGGTGGAGAGAATGTTCAGATGAATGGGGATACGCCCCATGATGGAGGTCACGGAGGAGG
AGGACATGGGGATTGTGAAGAATTGCAGCGAACTGGACGGTTCTGTGGTGGACTAATTAAAGACATAAAG
AGGAAAGCGCCATTTTTTGCCAGTGATTTTTATGATGCTTTAAATATTCAAGCTCTTTCGGCAATTCTCT
TCATTTATCTGGCAACTGTAACTAATGCTATCACTTTTGGAGGACTGCTTGGGGATGCCACTGACAACAT
GCAGGGCGTGTTGGAGAGTTTCCTGGGCACTGCTGTCTCTGGAGCCATCTTTTGCCTTTTGCTGGTCAA
CCACTCACTATTCTGAGCAGCACCGGACCTGTCCTAGTTTTGAGAGGCTTCTATTTAATTTCAGCAAGG
ACAATAATTTTGACTATTGGAGTTTCGCCTTTGGATTGGCCTGTGGTCCGCCTTCCTATGTCTCATTTT
GGTAGCCACTGATGCCAGCTTCTTGGTTCAATACTTCACACGTTTCACGGAGGAGGGCTTTTCCTCTCTG
ATTAGCTTCATCTTTATCTATGATGCTTTCAAGAAGATGATCAAGCTTGCAGATTACTACCCCATCAACT
CCAACTTCAAAGTGGGCTACAACACTCTCTTTTCCTGTACCTGTGTGCCACCTGACCCAGCTAATATCTC
AATATCTAATGACACCACACTGGCCCCAGAGTATTTGCCAACTATGTCTTCTACTGACATGTACCATAAT
ACTACCTTTGACTGGGCATTTTTGTCGAAGAAGGAGTGTTCAAAATACGGAGGAAACCTCGTCGGGAACA
ACTGTAATTTTGTTCCTGATATCACACTCATGTCTTTTATCCTCTTCTTGGGAACCTACACCTCTTCCAT
GGCTCTGAAAAAATTCAAAACTAGTCCTTATTTTCCAACCACAGCAAGAAAACTGATCAGTGATTTGCC
ATTATCTTGTCCATTCTCATCTTTTGTGTAATAGATGCCCTAGTAGGCGTGGACACCCCAAAACTAATTG
TGCCAAGTGAGTTCAAGCCAACAAGTCCAAACCGAGGTTGGTTCGTTCCACCGTTTGGAGAAAACCCCTG
GTGGGTGTGCCTTGCTGCTGCTATCCCGGCTTTGTTGGTCACTATACTGATTTTCATGGACCAACAAATT
ACAGCTGTGATTGTAAACAGGAAAGAACATAAACTCAAGAAAGGAGCAGGGTATCACTTGGATCTCTTTT
GGGTGGCCATCCTCATGGTTATATGCTCCCTCATGGCTCTTCCGTGGTATGTAGCTGCTACGGTCATCTC
CATTGCTCACATCGACAGTTTGAAGATGGAGACAGAGACTTCTGCACCTGGAGAACAACCAAAGTTTCTA
GGAGTGAGGGAGCAAAGAGTCACTGGAACCCTTGTGTTTATTCTGACTGGTCTGTCAGTCTTTATGGCTC
CCATCTTGAAGTTTATACCCATGCCTGTACTCTATGGTGTGTTCCTGTATATGGGAGTAGCATCCCTTAA
TGGTGTGCAGTTCATGGATCGTCTGAAGCTGCTTCTGATGCCTCTGAAGCATCAGCCTGACTTCATCTAC
CTGCGTCATGTTCCTCTGCGCAGAGTCCACCTGTTCACTTTCCTGCAGGTGTTGTGTCTGGCCCTGCTTT
GGATCCTCAAGTCAACGGTGGCTGCTATCATTTTCCAGTAATGATCTTGGCACTTGTAGCTGTCAGAAA
AGGCATGGACTACCTCTTCTCCCAGCATGACCTCAGCTTCCTGGATGATGTCATTCCAGAAAAGGACAAG
AAAAAGAAGGAGGATGAGAAGAAAAAGAAAAAGAAGAAGGGAAGTCTGGACAGTGACAATGATGATTCTG
ACTGCCCATACTCAGAAAAAGTTCCAAGTATTAAAATTCCAATGGACATCATGGAACAGCAACCTTTCCT
AAGCGATAGCAAACCTTCTGACAGAGAAAGATCACCAACATTCCTTGAACGCCACACATCATGCTGATAA
AATTCCTTTCCTTCAGTCACTCGGTATGCCAAGTCCTCCTAGAACTCCAGTAAAAGTTGTGCCTCAAATT
AGAATAGAACTTGAACCTGAAGACAATGATTATTTCTGGAGGAGCAAGGGAACAGAAACTACATTGTAAC
CTGTTTGTCTTTCTTAAAACTGACATTTGTTTTAATGTCATTTGTTTTTGTTTGGCTGTTTGTTTATTTT
TTAACTTTTATTTCGTCTCAGTTTTTGGTCACAGGCCAAATAATACAGCGCTCTCTCTGCTTCTCTCTTG
CATAGATACAATCAAGACAATAGTGCACCGTTCCTTAAAAACAGCATCTGAGGAATCCCCCTTTTGTTCT
TAAACTTTCAGATGTGTCCTTTGATAACCAAATTCTGTCACTCAAGACACAGACACCCACAGACCCTGTC
CTTTGCCTCTATTAAGCAGAGGATGGAAGTATTAAGGATTTTGTAACACCTTTTATGAAAATGTTGAAGG
AACTTAAAACTTTAGCTTTGGAGCTGTGCTTACTGGCTTGTCTTTGTCTGGTAGAACAAACCTTGACCTC
CAGACAGAGTCCCTTCTCACTTATAGAGCTCTCCAGGACTGGAAAAAGTGCTGCTATTTTAACTTGCTCT
TGCTTGTAAATCCTAATCTTAGAGTTATCAAAAGAAGAAAAAACTGAAGGTACTTTACTCCCTATAGAGA
AACCATTGCCATCATTGTAGCAAGTGCTGGAATGTCCCTTTTTCCTATGCAACTTTTTTAACCCTTTA
ATGAACTTATCTGTTGAGTACATTGAAGAATATTTTCTTCCTAGATTTTGTTGTTTAAATTATGGGGCC
TAACCTGCCACTTATTTTTGTCAATTTTTAAAACTTTTTTTAATTACTGTAAAGAAAATGAATTTTTT
CCTGCAGCAGGAAACATAGTTTTGAGTAGTTCTACCTCTTATTTGTAGCTGCCAGGCTTTCTGTAAAAAT
TGTATTGTATATAATGTGATTTTTACACATACATACACACAAATACACAATCTCTAGGGTAAGCCAGA
AGGCAAGATCAGATTAAAAACACCATGTTTCTAAGCATCCATTTTTCCCTTTCTTTAAAAGAAACTTAAC
TGTTCTATGAAGGAGATTGAGGGAGAAGAGACAAACTCCTATGTCATGAGAATAACCGATGTTCTGATAA
TAGTAGCATCTAGGTACAGATGCTGGTTGTATTACCACGTCAATGTCCTATGCAGTATTGTTAGACATTT
TCTCATTTTGAAATATTTGTGTGTTTGTGTATGTGCTCTGTGCCATGGCTGGTGTATATATGTGCAATGT
TAGAAGGCAAAGAGTGATGGTAGGCAGAGGGCAAAGTCATTGAATCTCTTATGCCAGTTTTCATAAAAC
CCAAACCACATATGAAAAATCCATTAAGGGTCCAAGAAGTCTGTCCATATGAAAATGAGGGTAAATATA
GTTTATTTCCCAGGTATCAGTCATTATAATTGATATAATAGCTCTAACATGCAATATAAAATTCATAGGA
GTATTAATAGCCCATTTACACATCTATAAAATGTAATGGGATTGCAGAGCTGCAGAGTACAGTGTAACAG

FIGURE 300 cont'd

TACTCTCATGCAATTTTTTTCAGGATGCAAAGGCAATTATTCTTTGTAAGCGGGACATTTAGAATATATT
TGTGTACATATTATATGTATGTATATTTCAAAGTACCACACTGAAAATTAGACATTTATTAACCAAATTT
AACGTGGTATTTAAAGGTAATATTTTTAATATGATACATTACATATTGTAATGTATACTAAAAAAACAT
TTTAAATGTTAAAATTATAATTTCAGATTCATATAACCACAACTGTGATATATCCTAACTATAACCAGTT
GTTGAGGGGTATACTAGAAGCAGAATGAAACCACATTTTTTGGTTTGATAATATGCACTTATTGACTCCC
AC

FIGURE 301
SEQ ID NO: 293
Genbank ID         : AI631846
Unigene ID(#167)   : Hs.137007
Unigene name       :        hypothetical protein BC009980 LOC113730
>gi|4683176|gb|AI631846.1|AI631846  wa36h03.x1 NCI_CGAP_Kid11 Homo sapiens cDNA
clone IMAGE:2300213 3', mRNA sequence
GCTTTCGGTGAATTAAAATGTATTTGGTGCCAGTGGTGCTGAACATAGAATAAAAAACAGAAAAAGGGCC
CAGACAGGGACATCCAGGCTGGAGGTTGGAGTGGAGCACAGTCAGATGTATTCACTTTTCTAGCATGGGT
TTCAAAGTGCGTAAGGGGAGAAAACGCATCATGGATTGTGCTGTGCATCCTGGACACCGTGCGAGGTGCT
CATAGCTGTGATCTTGTCTCCCACAACTCTCTTGGGTGACAGACGTCCACTGTCCACATTTTATAGACAA
GGAGAAAGGGAAGTCAAATGTCTCGTCCAAGTCTACACAGCTAAAAAGGGGCAGAACTAGGGTGACGCTC
AGGCCTCATTTAGAGATCGGGGGTTGGCGAGAAGTGGGGTGGGCTTCTGGAGGGGCTGGGAGAGCCCCAC
AAGGCTGCAGAGGGTGGTGAGCCCGGAGTGGGCCTGGCCTGGTGTGGGC

FIGURE 302
SEQ ID NO: 294
Genbank ID         : AF061812.1
Unigene ID(#167)   : Hs.432448
Unigene name       :        keratin 16 (focal non-epidermolytic palmoplantar
keratoderma)         KRT16
>gi|4091878|gb|AF061812.1|AF061812 Homo sapiens keratin 16 (KRT16A) mRNA, compl
ete cds
CCCTCCTTGGCACCATGACCACCTGCAGCCGCCAGTTCACCTCCTCCAGCTCCATGAAGGGCTCCTGCGG
CATCGGAGGCGGCATCGGGGGCGGCTCCAGCCGCATCTCCTCCGTCCTGGCCGGAGGGTCCTGCCGTGCC
CCCAGCACCTACGGGGGCGGCCTGTCTGTCTCCTCTCGCTTCTCCTCTGGGGGAGCCTGCGGGCTGGGGG
GCGGCTATGGCGGTGGCTTCAGCAGCAGCAGCAGCTTTGGTAGTGGCTTCGGGGGAGGATATGGTGGTGG
CCTTGGTGCTGGCTTCGGTGGTGGCTTGGGTGCTGGCTTTGGTGGTGGTTTTGCTGGTGGTGATGGGCTT
CTGGTGGGCAGTGAGAAGGTGACCATGCAGAACCTCAATGACCGCCTGGCCTCCTACCTGGACAAGGTGC
GTGCTCTGGAGGAGGCCAACGCCGACCTGGAAGTGAAGATCCGTGACTGGTACCAGAGGCAGCGGCCCAG
TGAGATCAAAGACTACAGTCCCTACTTCAAGACCATCGAGGACCTGAGGAACAAGATCATTGCGGCCACC
ATTGAGAATGCGCAGCCCATTTTGCAGATTGACAATGCCAGGCTGGCCGCCGATGACTTCAGGACCAAGT
ATGAGCACGAACTGGCCCTGCGGCAGACTGTGGAGGCCGACGTCAATGGCCTGCGCCGGGTGTTGGATGA
GCTGACCCTGGCCAGGACTGACCTGGAGATGCAGATCGAAGGCCTGAAGGAGGAGCTGGCCTACCTGAGG
AAGAACCACGAGGAGGAGATGCTTGCTCTGAGAGGTCAGACCGGCGGAGATGTGAACGTGGAGATGGATG
CTGCACCTGGCGTGGACCTGAGCCGCATCCTGAATGAGATGCGTGACCAGTACGAGCAGATGGCAGAGAA
AAACCGCAGAGACGCTGAGACCTGGTTCCTGAGCAAGACCGAGGAGCTGAACAAAGAAGTGGCCTCCAAC
AGCGAACTGGTACAGAGCAGCCGCAGTGAGGTGACGGAGCTCCGGAGGGTGCTCCAGGGCCTGGAGATTG
AGCTGCAGTCCCAGCTCAGCATGAAAGCATCCCTGGAGAACAGCCTGGAGGAGACCAAAGGCCGCTACTG
CATGCAGCTGTCCCAGATCCAGGGACTGATTGGCAGTGTGGAGGAGCAGCTGGCCCAGCTACGCTGTGAG
ATGGAGCAGCAGAGCCAGGAGTACCAGATCTTGCTGGATGTGAAGACGCGGCTGGAGCAGGAGATTGCCA
CCTACCGCCGCCTGCTGGAGGGCGAGGATGCCCACCTTTCCTCCCAGCAAGCATCTGGCCAATCCTATTC
TTCCCGCGAGGTCTTCACCTCCTCCTCGTCCTCTTCGAGCCGTCAGACCCGGCCCATCCTCAAGGAGCAG
AGCTCATCCAGCTTCAGCCAGGGCCAGAGCTCCTAGAACTGAGCTGCCTCTACCACAGCCTCCTGCCCAC
CAGCTGGCCTCACCTCCTGAAGGCCCGGGTCAGGACCCTGCTCTCCTGGCGCAGTTCCCAGCTATCTCCC
CTGCTCCTCTGCTGGTGGTGGGCTAATAAAGCTGACTTTCTGGTTGAT

FIGURE 303
SEQ ID NO: 295
```
Genbank ID        : NM_024101.1
Unigene ID(#167)  : Hs.297405
Unigene name      :      melanophilin      MLPH
>gi|13129107|ref|NM_024101.1| Homo sapiens melanophilin (MLPH), mRNA
GGCACGAGGAGCCGCTCTGCGCCCCGCGCCCTGCTTGCCCCCATTATCCAGCCTTGCCCCGGCGCCCTGA
CCTGACGCCCTGGCCTGACGCCCTGCTTCGTCGCCTCCTTTCTCTCCCAGGTGCTGGACCAGGGACTGAG
CGTCCCCCGGAGAGGGTCCGGTGTGACCCCGACAAGAAGCAGAAATGGGGAAGAAACTGGATCTTTCCAA
GCTCACTGATGAAGAGGCCCAGCATGTCTTGGAAGTTGTTCAACGAGATTTTGACCTCCGAAGGAAAGAA
GAGGAACGGCTAGAGGCGTTGAAGGGCAAGATTAAGAAGGAAAGCTCCAAGAGGGAGCTGCTTTCCGACA
CTGCCCATCTGAACGAGACCCACTGCGCCCGCTGCCTGCAGCCCTACCAGCTGCTTGTGAATAGCAAAAG
GCAGTGCCTGGAATGTGGCCTCTTCACCTGCAAAAGCTGTGGCCGCGTCCACCCGGAGGAGCAGGGCTGG
ATCTGTGACCCCTGCCATCTGGCCAGAGTCGTGAAGATCGGCTCACTGGAGTGGTACTATGAGCATGTGA
AAGCCCGCTTCAAGAGGTTCGGAAGTGCCAAGGTCATCCGGTCCCTCCACGGGCGGCTGCAGGGTGGAGC
TGGGCCTGAACTGATATCTGAAGAGAGAAGTGGAGACAGCGACCAGACAGATGAGGATGGAGAACCTGGC
TCAGAGGCCCAGGCCCAGCCCTTTGGCAGCAAAAAAAGCGCCTCCTCTCCGTCCACGACTTCG
ACTTCGAGGGAGACTCAGATGACTCCACTCAGCCTCAAGGTCACTCCCTGCACCTGTCCTCAGTCCCTGA
GGCCAGGGACAGCCCACAGTCCCTCACAGATGAGTCCTGCTCAGAGAAGGCAGCCCCTCACAAGGCTGAG
GGCCTGGAGGAGGCTGATACTGGGGCCTCTGGGTGCCACTCCCATCCGGAAGAGCAGCCGACCAGCATCT
CACCTTCCAGACACGGCGCCCTGGCTGAGCTCTGCCCGCCTGGAGGCTCCCACAGGATGGCCCTGGGGAC
TGCTGCTGCACTCGGGTCGAATGTCATCAGGAATGAGCAGCTGCCCCTGCAGTACTTGGCCGATGTGGAC
ACCTCTGATGAGGAAAGCATCCGGGCTCACGTGATGGCCTCCCACCATTCCAAGCGGAGAGGCCGGGCGT
CTTCTGAGAGTCAGATCTTTGAGCTGAATAAGCATATTTCAGCTGTGGAATGCCTGCTGACCTACCTGGA
GAACACAGTTGTGCCTCCCTTGGCCAAGGGTCTAGGTGCTGGAGTGCGCACGGAGGCCGATGTAGAGGAG
GAGGCCCTGAGGAGGAAGCTGGAGGAGCTGACCAGCAACGTCAGTGACCAGGAGACCTCGTCCGAGGAGG
AGGAAGCCAAGGACGAAAAGGCAGAGCCCAACAGGACAAATCAGTTGGGCCTCTCCCCCAGGCGGACCC
GGAGGTGGGCACGGCTGCCCATCAAACCAACAGACAGGAAAAAAGCCCCAGGACCCTGGGGACCCCGTC
CAGTACAACAGGACCACAGATGAGGAGCTGTCAGAGCTGGAGGACAGAGTGCAGTGACGGCCTCAGAAG
TCCAGCAGGCAGAGAGCGAGGTTTCAGACATTGAATCCAGGATTGCAGCCCTGAGGGCCGCAGGGCTCAC
GGTGAAGCCCTCGGGAAAGCCCCGGAGGAAGTCAAACCTCCCGATATTTCTCCCTCGAGTGGCTGGGAAA
CTTGGCAAGAGACCAGAGGACCCAAATGCAGACCCTTCAAGTGAGGCCAAGGCAATGGCTGTGCCCTATC
TTCTGAGAAGAAAGTTCAGTAATTCCCTGAAAAGTCAAGGTAAAGATGATGATTCTTTTGATCGGAAATC
AGTGTACCGAGGCTCGCTGACACAGAGAAACCCCAACGCGAGGAAAGGAATGGCCAGCCACACCTTCGCG
AAACCTGTGGTGGCCCACCAGTCCTAACGGGACAGGACAGAGAGACAGAGCAGCCCTGCACTGTTTTCCC
TCCACCACAGCCATCCTGTCCCTCATTGGCTCTGTGCTTTCCACTATACACAGTCACCGTCCCAATGAGA
AACAAGAAGGAGCACCCTCCACATGGACTCCACCTGCAAGTGGACAGCGACATTCAGTCCTGCACTGCT
CACCTGGGTTTACTGATGACTCCTGGCTGCCCACCATCCTCTCTGATCTGTGAGAAACAGCTAAGCTGC
TGTGACTTCCCTTTAGGACAATGTTGTGTAAATCTTTGAAGGACACACCGAAGACCTTTATACTGTGATC
TTTTACCCCTTTCACTCTTGGCTTTCTTATGTTGCTTTCATGAATGGAATGGAAAAAAGATGACTCAGTT
AAGGCACCAAAAAAAAAAAAAAAAAAAAAAA
```

FIGURE 304
SEQ ID NO: 296
```
Genbank ID        : AF116682.1
Unigene ID(#167)  : Hs.238205
Unigene name      :      chromosome 6 open reading frame 115 C6orf115
>gi|7959862|gb|AF116682.1|AF116682 Homo sapiens PRO2013 mRNA, complete cds
GCCGCTTTTTTTTTTGCCTCAGCCACTTCCTTCCTTGGCCTCACCCTCCCCAGTGCACTGAAGAAGGTA
ACCGGGTCCAGACCCACGCGGCGCCAGTTCTCCGGCGGGAAGGAAAACCGCGCAGAGAGGCAGCAATGAA
TGTGGATCACGAGGTTAACCTCTTAGTGGAGGAAATTCATCGTTTGGGTTCAAAAAATGCTGATGGAAAG
TTAAGCGTGAAATTTGGGGTCCTCTTCCGTGATGATAAATGTGCCAACCTCTTTGAAGCATTGGTAGGAA
CTCTTAAAGCTGCAAAACGAAGGAAGATTGTAACATATCCAGGAGAGCTGCTTCTGCAAGGTGTTCATGA
TGATGTTGACATTATATTACTGCAAGATTAATGTGGTTTACATATCTTTATGTACTGCCATTTTTTGTTT
CTGGTAAACTGGAATATAAAGTGAAAGAACAAACATTTGAACATACTTAATGTATTTTATAGAACTTTG
TAAACGAAAGGAGATTCATGTTTTAGAAGTCTGTCCTTTTTATATCTTGAAAGAAAATCTATGTATGAT
GCTATAAAATAAATCCTATTATTTTTCTCAGGAATCTGGTTAGGAATTGCAGGCAATGAGATTTTTTGCG
GGGCAGGGATGGGAATGTTTGTTCATAAATAATTAGACATTTTCTATAGATATTTGACATTCTGCGAAAG
CAACAAGCAAACTGAAGACCAACTCCTATGAGAAATATTATGATGTTTATGTAATAAAGACATGTAACTG
```

FIGURE 304 cont'd

TCTTAAATTTAAAAAAAAAAAAAAAAAAAAAAAAAAAAAAAAAAAAAAAAAAAAAAAAAAAAAAAAAAAA
AAAAAAAAAAAAAAAAAAAAAAAAAAAAAAAAAAAA

FIGURE 305
SEQ ID NO: 297
Genbank ID       : AA584428
Unigene ID(#167) : Hs.12742
Unigene name     :        zinc finger, CCHC domain containing 6        ZCCHC6
>gi|2369037|gb|AA584428.1|AA584428   nn81d05.s1   NCI_CGAP_Co9   Homo   sapiens
cDNA cl
one IMAGE:1090281 3' similar to TR:G1228035 G1228035 KIAA0191 PROTEIN ;,
mRNA s
equence
TTTTTTTTTTTTTTCATGACATGGTAAATAAATTTTTATTTGATGAAAATTACTATTGGTAGGAGAAATG
AATGAGGTACTTTTAGGTAGTTAAATAGAAAAACAAATCTAGAAAATACCTGGTAACTTGTGTTGGAACA
CATTTTCCATGATACGTTTAATTTCTAGCCTCTGTTCCAAGTTCTCATTGTGTAAGCCAAATTCCTGTAC
CACTTTGTCAATGGCAATGCCAACTGCATTTATCGGGGAGGGTGTTGGTGGGGGTAACGTAGTGTGCAAC
TCTTCCTCTTGCTTCTCCTTAATGTTTTTCTTGTGCCTCTTTTCCTTGATATGCTTATGGGCAAATGCAA
TGGATTCAATTAAAACATCACAGAGTCTGCAGGTGTACTTTGCTGTAGGGTAGTTTCGTGGTCGCCTTTT
TAGCCTGTCAATGCAGTCTCTCTTCAGTCTCTCCTCAGCCTGCTGTAAGCCTAGCAGCTCCTTCGTTGAA
AGTACAGACTCATCGATCACAGGGCCTTC

FIGURE 306
SEQ ID NO: 298
Genbank ID       : BF984207
Unigene ID(#167) : acc_BF984207
Unigene name     :
>gi|12387019|gb|BF984207.1|BF984207   602307631F1   NIH_MGC_88   Homo   sapiens
cDNA cl
one IMAGE:4398918 5', mRNA sequence
TGAGACTCTGTCTAAAAAAAAAAAGAAAGAAAGAAGGGAGGGAGGGAGGAAGGAAGGAAGGAAGGAAAGA
AAGAAAGGTCAGCTTTGGCCCAGATGTGGTTACCCCTTGGTCTCCTGTCTTTATGTCTTTCTCCTCTTCC
TATTCTGTCATCTCCCTCACTTAAGTCTCAGGCCTGTCAGCAGCTCCTGTGGACATTGCCATCCCCTCTG
GTAGCCTTCAGAGCAAACAGGACAACCTATGTTATGGATGTTTCCACCAACCAGGTAGTGGCATGGAGCA
CCGTAACCATCTGTGCTTCTGTGATCTCTATGACAGAGCCACTTCTCCAACCTCTGAAATGTTCCCTGTC
TGAAATCTGGCATGAGATGGCACAGGTGACCACGCAGAAGCCACCAGAATCTTGGCCTGCCTATTCCTCC
TCCCAAGTCTGTGACTCTTATTGTCAAGCCTCAGGACAAACAGGGCTGGCGCCAATGTGGATTAACAGAG
AAAGCAATCTGGTGTGGCTAGTGGGCAGATTACACATGGCAAGCCCCAGGAGAAATGGAGGAGCTTTGTA
GCCACCTCCCCTGTCAGCCAGTATTAAACATGTTCCCTTCCCCTTGGCCGGCGTAATTCAGGAAGTTCGC
CCCTGGTTGTGCCACCAAACCAGGGACTGTGCCCTTGGGTTGGCTCCCTGGTCCTCCTGGTACTCACAAG
AGGTCTGTCCAGGGCCGGTTATAGATTTATCAAGGCCCGAACAATGGGAAGCGCAAATGTAAATCCTTGC
TGAATAATAATGGAGCGGCAGACCAGGACAATGGGCCTGTATACGGCTGATCCCACCTGGGAAACAAGGG
AAACGAATTGCGGGTTTAGAACACCCCGATTGAAGGCACAACTGGC

FIGURE 307
SEQ ID NO: 299
Genbank ID       : U63743.1
Unigene ID(#167) : Hs.69360
Unigene name     :        kinesin family member 2C        KIF2C
>gi|1695881|gb|U63743.1|HSU63743 Homo sapiens mitotic centromere-associated
kin
esin mRNA, complete cds
GCGAAATTGAGGTTTCTTGGTATTGCGCGTTTCTCTTCCTTGCTGACTCTCCGAATGGCCATGGACTCGT
CGCTTCAGGCCCGCCTGTTTCCGGTCTCGCTATCAAGATCCAACGCAGTAATGGTTTAATTCACAGTGC
CAATGTAAGGACTGTGAACTTGGAGAAATCCTGTGTTTCAGTGGAATGGGCAGAAGGAGGTGCCACAAAG
GGCAAAGAGATTGATTTTGATGATGTGGCTGCAATAAACCCAGAACTCTTACAGCTTCTTCCCTTACATC
CGAAGGACAATCTGCCCTTGCAGGAAAATGTAACAATCCAGAAACAAAAACGGAGATCCGTCAACTCCAA

FIGURE 307 cont'd

```
AATTCCTGCTCCAAAAGAAAGTCTTCGAAGCCGCTCCACTCGCATGTCCACTGTCTCAGAGCTTCGCATC
ACGGCTCAGGAGAATGACATGGAGGTGGAGCTGCCTGCAGCTGCAAACTCCCGCAAGCAGTTTTCAGTTC
CTCCTGCCCCCACTAGGCCTTCCTGCCCTGCAGTGGCTGAAATACCATTGAGGATGGTCAGCGAGGAGAT
GGAAGAGCAAGTCCATTCCATCCGTGGCAGCTCTTCTGCAAACCCTGTGAACTCAGTTCGGAGGAAATCA
TGTCTTGTGAAGGAAGTGGAAAAAATGAAGAACAAGCGAGAAGAGAAGAAGGCCCAGAACTCTGAAATGA
GAATGAAGAGAGCTCAGGAGTATGACAGTAGTTTTCCAAACTGGGAATTTGCCCGAATGATTAAAGAATT
TCGGGCTACTTTGGAATGTCATCCACTTACTATGACTGATCCTATCGAAGAGCACAGAATATGTGTCTGT
GTTAGGAAACGCCCACTGAATAAGCAAGAATTGGCCAAGAAAGAAATTGATGTGATTTCCATTCCTAGCA
AGTGTCTCCTCTTGGTACATGAACCCAAGTTGAAAGTGGACTTAACAAAGTATCTGGAGAACCAAGCATT
CTGCTTTGACTTTGCATTTGATGAAACAGCTTCGAATGAAGTTGTCTACAGGTTCACAGCAAGGCCACTG
GTACAGACAATCTTTGAAGGTGGAAAAGCAACTTGTTTTGCATATGGCCAGACAGGAAGTGGCAAGACAC
ATACTATGGGCGGAGACCTCTCTGGGAAAGCCCAGAATGCATCCAAAGGGATCTATGCCATGGCCTCCCG
GGACGTCTTCCTCCTGAAGAATCAACCCTGCTACCGGAAGTTGGGCCTGGAAGTCTATGTGACATTCTTC
GAGATCTACAATGGGAAGCTGTTTGACCTGCTCAACAAGAAGGCCAAGCTGCGCGTGCTGGAGGACGGCA
AGCAACAGGTGCAAGTGGTGGGGCTGCAGGAGCATCTGGTTAACTCTGCTGATGATGTCATCAAGATGCT
CGACATGGGCAGCGCCTGCAGAACCTCTGGGCAGACATTTGCCAACTCCAATTCCTCCCGCTCCCACGCG
TGCTTCCAAATTATTCTTCGAGCTAAAGGGAGAATGCATGGCAAGTTCTCTTTGGTAGATCTGGCAGGGA
ATGAGCGAGGCGCAGACACTTCCAGTGCTGACCGGCAGACCCGCATGGAGGGCGCAGAAATCAACAAGAG
TCTCTTAGCCCTGAAGGAGTGCATCAGGGCCCTGGACAGAACAAGGCTCACACCCGTTCCGTGAGAGC
AAGCTGACACAGGTGCTGAGGGACTCCTTCATTGGGGAGAACTCTAGGACTTGCATGATTGCCACGATCT
CACCAGGCATAAGCTCCTGTGAATATACTTTAAACACCCTGAGATATGCAGACAGGGTCAAGGAGCTGAG
CCCCCACAGTGGGCCCAGTGGAGAGCAGTTGATTCAAATGGAAACAGAAGAGATGGAAGCCTGCTCTAAC
GGGGCGCTGATTCCAGGCAATTTATCCAAGGAAGAGGAGGAACTGTCTTCCCAGATGTCCAGCTTTAACG
AAGCCATGACTCAGATCAGGGAGCTGGAGGAGAAGGCTATGGAAGAGCTCAAGGAGATCATACAGCAAGG
ACCAGACTGGCTTGAGCTCTCTGAGATGACCGAGCAGCCAGACTATGACCTGGAGACCTTTGTGAACAAA
GCGGAATCTGCTCTGGCCCAGCAAGCCAAGCATTTCTCAGCCCTGCGAGATGTCATCAAGGCCTTACGCC
TGGCCATGCAGCTGGAAGAGCAGGCTAGCAGACAAATAAGCAGCAAGAAACGGCCCCAGTGACGACTGCA
AATAAAAATCTGTTTGGTTTGACACCCAGCCTCTTCCCTGGCCCTCCCCAGAGAACTTTGGGTACCTGGT
GGGTCTAGGCAGGGTCTGAGCTGGGACAGGTTCTGGTAAATGCCAAGTATGGGGGCATCTGGGCCCAGGG
CAGCTGGGGAGGGGGTCAGAGTGACATGGGACACTCCTTTTCTGTTCCTCAGTTGTCGCCCTCACGAGAG
GAAGGAGCTCTTAGTTACCCTTTTGTGTTGCCCTTCTTTCCATCAAGGGGAATGTTCTCAGCATAGAGCT
TTCTCCGCAGCATCCTGCCTGCGTGGACTGGCTGCTAATGGAGAGCTCCCTGGGGTTGTCCTGGCTCTGG
GGAGAGAGACGGAGCCTTTAGTACAGCTATCTGCTGGCTCTAAACCTTCTACGCCTTTGGGCCGAGCACT
GAATGTCTTGTACTTTAAAAAAATGTTTCTGAGACCTCTTTCTACTTTACTGTCTCCCTAGAGTCCTAGA
GGATCCCTAC
```

FIGURE 308
SEQ ID NO: 300
Genbank ID        : U41163
Unigene ID(#167)  : acc_U41163
Unigene name      :
>gi|1209100|gb|U41163.1|HSU41163 Human creatine transporter (SLC6A10) gene,
par
tial cds
```
CATGCGTGACTGCCCCCACACTCACACAGCTCTCACTCCCCACATGCTCCATGCCTCCTGTCCCCACTGA
GGAGAGCTCCTAGAGGCTCGCCCGCTCCCCACTGACATGCATCCCTGCAGACAAACGAGGCGCCCAGAGA
GCTTCCCCACTGCCACTTGCCAGGGCTGCGGGCCCAGCCTTGCCCCCTAGCTTCCTCTGGCGGGAGCTATGG
CTCGGAGGAGAATGGGGACTTCTGAACATACCTGCCCGCAAGGGGGACCGGAGGTGCTCGGAGTGGGCTT
GTGAGGGAGGTGGTGCCGCAGTCCCCGCTGAGCAGCCTGGCCCCCAGATCGTGTACTTCACTGCTACAT
TCCCCTACGTGGTCGTGGTCGTGCTGCTTGTGCTTGGAGTGCTGCTGCCTGGCGCCCTGGACAGCATCAT
TTACTATCTCAAGCCTGACTGGTCAAAGCTGGGGTCCCCTCAGGTGAGGTGGAGGTGGGGAGGCTGCAGC
AGGGTGTTGTGGGGGAGCCCTGCAGGCCCCTCATGCCTGCACTCTCCAGCCCTTTCTCTGTAGGTATGGA
TAGATGTGGGGACCCAGATTTTCTTTTCTTATGCCATTGGCCTGGGGCCCTCACAGCCCTGGGCAGCTA
CAACCGCTTCAACAACAACTGCTACAAGTAAGCACTGCTGCCCTGCCACCCGTGCCCTGTCCCGCCCTGC
CCTGCCCAGCAGCCTAACCCATCCACTCTGGCCCCTCCACCCCTCCAGGACGCCATCATCCTGGCTGTCA
TCAACAGTGGGACCAGCTTCTTTGCTGGCTTCGTGGTCTTCTCCATCCTGGGCTTCATGGCTGCAGAGCA
GGGCATGCACATCTCCAAGGTGGCAGAGTCAGGTAGGGCCCTACCCCCAGCCCCGCCTCCAGAGCAGCAA
CTGCCACCCAGATGCATGATGTACAAGAACACGCAATAGAAATGCTGAAAGTGATGAGGATTCAAACAG
AACTTCTCAGATTGTGGGCCTGTGGGGCAGGTCCTGGGATTTTTCAATGTTGACAGAGACAGGACCTCC
CAGCCCCTGCTGCATGACCCAGGGTTGACAGCACCTCAGAGGCAGGCGTGGGCATGGGCGTGAGTGTTGC
```

FIGURE 308 cont'd

AGGCAGGGCTCAGGGTGCGCGCAGGGCACGACATCGGCTGCAAGGTCTAGAGCCTGCACCTTTCCCACAG
GGCCGGGCCTGGCCTTCATCGCCTACCCACAGGCTGTCACACTGATGCCAGTGGCCCCACTCTGGGCTGC
CCTGTTCTTCTTCATGCTGTTGCTGCTTGGTCTCGACAACCAGTTTGCATGGGCTCTGGGACAGGGAGCC
AGGAGAGGGCGGAGTGAGGGCTGCGGGCAAGGAAAGGGGTGGAGGGTGGTGCGGGGCTCGGCCTGAGCT
AGCCTGGCCACAGTTTGTAGGTGTGGAGGGCTTCATCACCGGCCTCCTCAACCTCCTCCCGGCCTCCTAC
TACTTCTGTTTCCAAAGGGAGATCTCTGTGGCCCTCTGTTGTGCCCTCCGCTTTGTCATTGATCTCTCCA
TGGTGACTGATGTGAGTGGGGTGGGGGGTCTGCCTGTGACCTCTGGTGGCCGTCTGCCATCCTCCCTGAC
TGGGCTCTGTCCCCAGGGTGGGATGTATGTCTTCCAGCTGTTTGACTACTACTCGGCCAGCGGCACCAC
CCTGCTCTGGCAGGCCTTTTGGGAGTGCGTGGTGGTGGTCTGGGTGTATGGTAGGTCATGGCTGAGGGCT
GGGCTGGGGCATGGTGACGGGGAAGGCAGGTCTCCAGCTTGGCCCTCCCGCCTCGCCTTGCCACAGGAGC
TGACCGCTTCACGGACGACATTGCCTGTATGATCGGGTACCGACCTTGCCCCTGGATGAAATGGTGCTGG
TCCTTCTTCACCCCGCTGGTTTGCATGGTAAGGGCTGGGGGAGGTGGGCGGGGTGGGGGGGCGGGGCG
GGGTGGGGGCCCCATTAAGGACGGGCATTCTGGTCTGTAGGGCATCTTCATCTTCAACGTTGTGTACTAC
AAGCCGCTGGTCTACAACAACACCTACGTGTACCGTGGTGGGGTGAGGCCATGGGCTGGGCCTTCGTGC
TGTCCTCCATGCTGTGCATGCCACTGCACCTCCTGGGCTGCCTCCTCAGGGCCAAGGGCACCATGGCTGA
GGTAAGGCTCCCTCCCGGCCTGCCCTCCCCTCCCCTGCTATGAACATTCAACCCAGCCTGCTTCCTAGCC
AAGGAGTGGCCCTGACTAGGGTGGCAGGCAGCAGGAGCTGGAGAGAGAGGCAGAGGAAGTCACCGTGGGG
ATGAGCAGGTGACTCTGGGGGCTTCAACATGTCCTCTCCTGCAGTGCTGGAAGCACCTGACCCAGCCCAT
CTGGGGCCTCCACCACTTGGAGTACCGAGCTCAGGATGCAGATGTCAGGGCCTGACCACCCTGACCCCA
GTGTCCGAGAGCAGCAAGGTCGTCGTGGTGGAGAGTGTCATGGGACAGCTCAGCTCACATCACCAGCTCA
CCTCTGGTAGCCATAGCAGCCCTGCTTCATCCCCACCCCACCCCTCCAGGGGGCCTGCCTTTCCCTGAC
ACTTTTGGGGTCTGCCTGGGAGAGGAGGGGAGAAAGCACCATGAGTGCTCACTAAAACAACTTTTTCCAT
TTTTAATAAAACGCCAAAAATATCACAACCCACCAAAAATAGATGCCTCTCCCCCTCCAGTCCTAGCCCA
GCTGGTCCTAGGCCCCGCCTAGTGCCCCACCCCCACCCACAGTGCTGCACTCCTCCTGCCCCTGCCACGC
CCACCCCCTGCCCACCTCTCCAGGTTCTGCTCTGTAGCACACCCTTGGGTGACCCCTCACCCCAGAAGCA
GCAGTGGCAGCTTGGGAAATGTGAGGAAGGGAAGGAGGGAGAGACGGGAGGGAGGAGAGAGAGGAGAAGG
GAGGCAGGGGAGGGGCAGCAGAACCAAGACAAATATTTCAGCTGGGCTATACCCCTCTCCCCATCCCTGT
TATAGAAGCTTAGAGAGCCAGCCAGCAGTGGAACCTTCTGGTTCCTGCGCCAATCACCACCAATATCAAT
TGTGTGAGCTTGGGTGCGAGTGCACGCGTGCGTGAGCACGTAGAGTATATATAGATCTCTATCTCTTAGC
AAAGGTGAATACCAGATGTAAATGGTGCCTCTGGGCAAAGGAGGCTTGTATTTTGCACATTTTATAACAA
CTTGAGAGAATGAGATTTCTGCTTGTATATTTCTAAAAAGAGGAAGGAGCCCCAAACCCATCCTCTCCTT
TACCACTCCCCATTTCCTGTGAGCCCTACCTTACCCCTCTGCCCCTAGCCTAGGAGTGTGAATTTATAGA
TCTAACTTTCAGAGGCAAAACAAAAGCTTCGAGCTGTTGATGTGCAGTCTGTTGTGTGGATGTGTGTGTG
TGGTCCCCCAGACCCAGAATGGATTGGAAAAGTGCATGGTGGGGCCTCGGGGCTGTCCCCACGCTGTCCC
TTTGCCCACAGGTCTGTGGGGCAACAGGCTGCAATATTCCATCCTGGGTGTCTGGGCTGCTAACCTGGCC
TGCTCAGGCTTCCCACCCTGTGCCCTGGGCTGGGCACACCCCGGGAAGGGACCCCGGACACGGCTCCCA
CATCCAGGCTCAAGGCGGATGCACTTCCTGCACCTCCAGTCTTCTGTGTAGCGGCTTTAACCCACGTATG
TCTGTCACGTCCAGTCCCGAGACGGCTGAGTGACCCCAAGAAAGGCTTCCCTGACACCCGGACAGAGGCT
GGAGGGCTGGGGCTGGGTGAGGGTGGTGGGCCTGCGGGACATTCTACTGTGCTA

FIGURE 309
SEQ ID NO: 301
Genbank ID        : AK001380.1
Unigene ID(#167)  : Hs.121028
Unigene name      :    asp    (abnormal    spindle)-like,    microcephaly
associated (Drosophila) ASPM
>gi|7022604|dbj|AK001380.1|   Homo   sapiens   cDNA   FLJ10518   fis,   clone
NT2RP2000814
TTTATGATGAACGCTGGAAGGAAAAGCAGGAACAGGGCTTCACTTGGTGGTTAAATTTTATATTAACCCC
TGATGACTTCACTGTAAAAACAAATATTTCTGAAGTAAATGCTGCTACTCTTCTTTTGGGAATAGAGAAT
CAACATAAAATAAGTGTTCCTAGAGCACCTACAAAAGAGGAAATGTCTCTCAGAGCTTATACTGCTCGGT
GTAGGTTAAACAGACTACGTCGTGCAGCATGCCGTTTGTTTACTTCTGAAAAAATGGTTAAAGCTATTAA
AAAGCTTGAAATTGAAATTGAAGCTAGGCGGTTAATTGTTCGAAAAGATAGACACCTATGGAAAGATGTG
GGAGAACGTCAGAAAGTCCTGAATTGGCTGTTGTCCTACAATCCTTTGTGGCTTCGAATTGGTCTAGAGA
CAACTTATGGAGAACTCATATCTTTGGAAGATAACAGTGATGTCACAGGGTTGGCTATGTTTATTCTGAA
TCGCCTACTTTGGAATCCTGATATAGCAGCTGAGTATAGACACCCCACTGTTCCTCACCTGTATAGAGAT
GGTCATGAAGAAGCTTTGTCCAAGTTTACATTGAAAAAGTTATTGTTGTTGGTCTGTTTTCTTGATTATG
CTAAAATTTCCAGACTCATTGATCATGATCCTTGTCTCTTCTGTAAAGATGCCGAATTCAAGGCTAGTAA
AGAAATCCTTTAGGCTTTTTCACGAGATTTCCTAAGTGGTGAAGGTGACCTTTCCCGTCGCCTTGGCTTA
TTGGGATTACCTGTTAACCATGTTCAGACACCATTTGATGAATTTGATTTTGCCGTTACAAATCTTGCCG

FIGURE 309 cont'd

```
TAGACTTGCAATGTGGAGTGCGCCTTGTGCGAACCATGGAACTTCTCACACAGAACTGGGACCTCTCAAA
GAAACTCAGGATTCCGGCAATAAGTCGTCTTCAAAAGATGCACAATGTTGACATTGTTCTTCAAGTTCTT
AAATCACGAGGAATTGAATTAAGTGATGAGCATGGAAATACAATTCTATCTAAGGATATTGTGGATAGGC
ACAGAGAAAAAACTCTCAGGTTGCTTTGGAAAATAGCGTTTGCTTTTCAGGTGGATATTTCCCTTAACTT
AGATCAATTAAAGGAAGAAATTGCCTTTCTAAAACACACAAAGAGTATAAAGAAAACAATATCTCTACTA
TCATGCCATTCTGATGATCTTATTAATAAGAAAAAAGGCAAAAGGGATAGTGGTTCCTTTGAACAATATA
GTGAAAACATAAAGTTATTGATGGATTGGGTAAATGCTGTTTGTGCCTTCTATAATAAAAAGGTGGAGAA
TTTTACAGTGTCTTTCTCAGACGGCCGTGTGTTATGTTACCTGATCCACCATTACCATCCTTGCTATGTG
CCATTAGACGCTATATGTCAGCGTACTACTCAAACTGTGGAATGTACGCAAACTGGTTCAGTGGTATTAA
ATTCATCATCTGAATCTGATGACAGTTCTCTGGATATGTCACTTAAAGCATTTGATCATGAAATACTTC
AGAGCTATACAAAGAGCTCCTAGAAAATGAAAAGAAAAATTTTCACTTGGTTAGGTCTGCAGTTAGAGAC
CTTGGTGGAATACCTGCTATGATTAATCATTCAGATATGTCAAATACAATTCCAGATGAAAAGGTGGTTA
TTACCTATTTGTCATTTCTTTGTGCAAGGCTTTTGGATCTTCGTAAAGAAATAAGAGCTGCTCGACTCAT
ACAAACAACATGGAGAAAATATAAACTAAAAACAGATCTCAAACGCCATCAGGAGAGAGAGAAAGCTGCA
AGAATTATTCAATTGGCTGTAATCAATTTTCTAGCAAAACAAAGATTGAGAAAAAGAGTTAATGCAGCAC
TCGTCATTCAGAAATATTGGCGAAGAGTCTTAGCACAGAGAAAATTATTAATGTTAAAAAAGGAAAAGCT
GGAAAAAGTTCAAAATAAAGCAGCATCACTTATTCAGGGATATTGGAGAAGATATTCCACTAGACAAAGA
TTTCTGAAATTGAAATATTATTCAATCATCCTGCAATCTAGGATAAGAATGATAATTGCTGTTACATCTT
ATAAACGATATCTTTGGGCTACAGTTACAATTCAGAGGCATTGGCGTGCTTATTTAAGAAGAAAACAAGA
TCAACAAAGATATGAAATGCTAAAATCATCAACTCTTATAATCCAATCTATGTTCAGAAAATGGAAGCAA
CGTAAAATGCAATCACAAGTAAAAGCTACAGTAATATTGCAAAGAGCTTTTAGAGAATGGCATTTAAGAA
AACAAGCTAAAGAAGAAAATTCTGCTATTATCATACAATCATGGTATAGAATGCATAAAGAATTACGAA
GTATATTTATATTAGATCTTGTGTTGTTATCATTCAGAAAAGATTTCGGTGCTTTCAAGCCCAAAAGTTA
TAT
```

FIGURE 310

SEQ ID NO: 302
Genbank ID      : AF312864.1
Unigene ID(#167) : Hs.12532
Unigene name    :       chromosome 1 open reading frame 21  C1orf21
>gi|12017956|gb|AF312864.1|AF312864 Homo sapiens C1orf21 mRNA, complete cds

```
GCGGCCGCTGCTTCTTTCACACTTTAGTTGGGAGCTGCGCGCCGCGCTCAGTTACTGGAGAGCTGGCCGC
GCGCCGCCGCCTCCCGCACGCTTGCACGCGGGCCCGGCTTCGGGGTTTTGGGTTCTTACTCCAAGCGGCG
GGGAGGAGGGGGAGCCCCGGACACACTGTGGGGAGGAGGAAGAAGAAGAAGAGGAGGAGGGAGGAAGAAAAA
GACGAGGAGGACAGGGGCGGGGGCGGGAGGCTTGCCACCTTCAGCCCCCCGCGAACGCCCAAGGTGCA
CACATCTTGACCAACTCAGCAGCAAGGTGGATTTTCTTTGTGTTTAAAGAAAAAAATGTCCCTGTGTCT
GTAGAGATGATTTGCAGTTCAGCCCGGCTGAAGCTGACCGAATGAGACTATGGGCTGTGCCTCCGCCAAG
CATGTTGCCACTGTTCAAAATGAAGAGGAAGCCCAGAAAGGGAAAAACTACCAGAACGGAGATGTGTTTG
GCGATGAGTATAGGATCAAACCAGTGGAAGAGGTCAAATACATGAAAATGGGGCAGAAGAAGAGCAGAA
AATAGCAGCCAGGAACCAAGAAAACTTGGAAAAAGTGCCAGCTCAAATGTAAGACTTAAAACTAATAAA
GAGGTTCCGGGATTAGTTCATCAACCCAGAGCAAACATGCACATCTCTGAAAGCCAACAAGAATTCTTCA
GAATGCTGGATGAAAAAATTGAAAAGGGTCGGGATTACTGTTCGGAAGAAGAGGATATCACATAGCACCA
ATTTTACCACTCAAACCAGGAGCTACTACTGTGTAAATAGGTTACACCCCAGTTGAAATCTTTGCAAAGG
TCGGTTCTATTCAGCGAACAGCACTATAGCAAAAGAAGATCGTTCCATATTGTACGCCCCATTAAATTAC
AGTGTTTCTTAATGAACTTGCAAAGGAATATTGCTAAAAACAAACAAAAAAAACTGTTATCGAACTTTCT
TTGTTGCTGCTAGTTAAAACTTGTTGCAACTTTTCACTTCTCTTGTGTCCAGGTATGCAGCAAAATTCTG
CAATTTCACCTTAAAGATACTGTTGGTTTTACAGATGCTCTCCAACCTATTTTCTATAAGATGAGGTAGT
GGTGAACTCAGATAACAAACTTCCCTTCTAAACTGGTTCTGCTTCTAAGACAAGCATCTCCTGCCCTCTC
TCCTTCCTCCCCATCTCTCGCACGCAGTCTAGAGATGGACTGAGCCTTGCTTCTCACTGGCAGTGTTGAG
CTTTGGAGATGGGATGGTTGCTATGCCAAGCCTTGTTTCTGCTCAGAAGAAGTAGAGAAGCTATTATC
AATTAAAAGCATGCTGTGATGTGACTCCTGGAAGTGACGTAGGAGTGAGTGGCAGGTTGTTTGATTTAAT
AGGTATCTTAATCAAGAATTAAGCTTGCAACATTGGCTTTGCTCAGATGCAGATGGAAGTGTGATCACAA
TCATTTTGAATCCCTCTTCCTCACTTTTTTTCTAAGAAAATAAACATTTTACTGTTTTTATGGATCCTT
GTCTTCTCCCATTCATCCAGCTCAGTGTTTTAAGATGATCCTGGGTGCAGAAGTTGAGCCCTCCTTTGCA
TTGACACTGATAATTAGCCTATAGGGCTCCCTACCCTTCCATTAAGAATCTACCAAGCATTAGCAAGGCT
GAAAGTGGTCTAAGAGGTGAGGGGACATCCTATGCTTTTAGGAAGGCCTGAAACCACCTTGTTACCTT
TCATTTTGTTAGCAAATAAACCATCCTATTTTGTAACTCTCCCCCTTCAAAATGCTACATGAGCCTTGCC
ACTTCCTTTTTCTCTTACTTCCAGCACACTAGACATAGCAAAAGTGTTTGCCTACTCAAAAACATAATAC
TTTTATGCTGATGATGGTATTTGGAGATGTGAAAGCCAAAAGCCCCTGGCAGTGGTGGGGAATGTTGACT
GAGTGTTCAGCAGAGTTTATTTTTCCATACTATATGAAGAGAATGATCTCTTCTCAAAGACAGAAGTGAT
```

FIGURE 310 cont'd

```
ATTTTTAACAAATATTGTCACAAGTAAATAGCAATCAAAAGGAGAAAATAACTTTTGTATTTTTTAATG
TGTTTGATAGCTTTGACGAGGGTTCTCTTTGTTACTTTCAGGGGAGGGCATCCTATTAAATGCCACGCCA
GCAGTCCGGGTCTGGGTTTGTCCCACAAAATCACAGGAGCACTGTATGTTCCTCTCTTTTGGAGTTGTGA
CTTTGAAGGGCCTCAATATTAGCCACACTGCCGCCTGCAGAAGGTGGAGAGTTAAGATGTTCTATGTCAA
TTTGCTCTTGCCGAAAAGATGAGCCTCGATTTTAAAATCTATCCACATCCAACTGATGGCACCATTGATG
TGCAAATAATGAGATTCCCTATCTCCTTTTAGACCTGGGACGGCAAAAGGGAAGGGAAGGAAACTTAGCA
GAGTGCTATTGACTATAGATTCACATATTAGCAACAAAATCCCGTAATTCTTTTGGCCAACAGCAGCTAT
TTTGGGGAGCAGCTGTGGCTGTTACATAAATAGAGATGCAGCCAAAATTTTAGGCCTTTTATCCTGCTTC
TAGCAGAAAAATGCAGGGAGAGTCAAGTAGTCTAGGGTTTCAGGTTGCCTCCCCTCATATGGTTTTTGGC
CAAGTGACTAAAACAGTTTTCCACAACTGTAAACAACTGGTAAGCCCCACCTCAAACTTGTTCACTGGG
GACTTTGCTTACCGTTCTGTGGGTGACCTTTTCCGGGATTTCTTGTTCTTATCAAGCAAGAATTAAGCAC
ATGCTAAACGTCTTCCATTTGACTTCTCTACTCGGTGTCTCAGACAGTGTCTTCCCAGAAAACCACCACC
CTCTACCCAAAGATGAAACATGCTCATGTCATTTTTCTCATGGTCACATTTAACAGTTTTGACATGTTAT
ACTTGCGCATAGATCCAAGCGTTTCTTGGGAACCTGACTTTTGAGTGTTTAATAAAGCCGGAAGTGGTGT
TGCCCTGAACCAGCAGATTTTCACCTGGGTTCTGGCTCCGGTGTTTAACACTGGATACATCTTTGATGTG
CGAAAGTGAGTTCATCTTCAGACACATTTGGTACATCCAGAAATAGATCCAAGAAATGGGTGGTTGAGT
GGGTCCGCACGAAATGCTTGATTATGTCAGCAACACCCAACACTGTCTGTTTTCCATTTGTTGGTTTTAA
TCATAAAATTGTCAAGTGATTCGTGTTGTACTTTATTTTTGTGCCTTCTGAACGGATCTAAAACAAAWGT
ATTTTGCCTTTTTTACCCCACGTGTATCTGAACATTAAGCAGATTGGCTCAGACACCATGAAAAGGATAC
TCCAATGTACGTGCTGGTGCACTCTGCTAGTTGTTATCTCTGTAGGGCTCAAGAAGCTGGAAGGAGGAAG
GGAGGGTAAGTGGCCTGGTGAGTGGAGGTAGAAAAATGATGAGAAATGAACTGAGAGCATTAAGCAGAGA
GGGTTGATAGGCTGGCCGTGTCCGGGGTGAAATTGGAAATCCAGCTGCCTAGTGGCCAGTGGGTGGGGCA
AGACTGTCAACGAGATTTACAGCTGGCTTACACATGCCTTATGTCCTCTGAGTTGTAGAGTTGTAAAAGT
TCAGCAGTGTGTGCACAGCTTTCTTTTGGTTGGCAGAGATTCAGGATCATGGAGTACTGCTCTCATAATT
GAAGACGTGTTTGTTATTGGCAGAGAACCTTAAAAAAGGCCTTTACCTCAGCGATGCTTCCTAGCCCCAG
GCTTGCAGAGAACACAGAGTGGTGTTGTGGTCTATTTAGGGACAAAGAAGGTATAAAGTCCAGAGATGAG
AAAACTGGGTCAGCCCTCAGAAACTGCAGCAGCCACGCACACAGAAGCCTGCTGGAAGACAGGTCTCTCT
CCGTCCACAGTGCCCATCATCTGAGCCTGGCTGGGATGACTCAACTTAGCAAAGACGGACCCAGGAGGA
GTGCTGGTCTTCAGTCTTTGTACTGGCCCCATCCTCTCCTCACTGTAATGTGAGGAAGCACCTCTGTGT
CAGGGCTCACCTGGGCATCCAAAGCGGCCACGCCCACAATCCGACAGCCCCAGGAGCAGGTCCAGGGAT
GATGCAGCCCCCTTCTTGGTCCCATGTGATGTCATCCTGCTTTGTTATCTTCTTATAACTTTATCCTGCT
ATAACTTTATCCTCTTCCCAGCCTCATCCCTGTTTTCTGTTAGGGCAAGACTCTTCCATAAGCCTGCTA
AAAAACAGAGATGATACCTCTTACAAACTTTACCTCATAGCCTGTGAAGCAGGTTGGCATGTGGATTACA
AGTCCTGCTTTGACACTGGGCAAGAATTTAAGATTGTTCTATCTCTACTAGTCATAGAAAAGAAACATTG
TTAAACATGTTGAGTTTTAAAGGAAGAAATATTTTCAAATTCTTAATCCAAGAAAATACTGAGTTGGAAT
CTTAGACTTCGGGACTCTGACACGTTCTTTATGAAAGGCAAAATAATTGGTATCTAAAGTTCTCTCCTTC
CTGCCTCCCCTAAAGAAAAAGGATATTAGATTGCACACTATAATTTTACATAAGATCTGCCTTCCACACT
TCCCTGCTGGAAGGCATTCTCAGAGCTTTATGTCTTCGTACCTCTCAGAGATTGGACTTTTTCTTGTTTA
AAACCCCAACCAAAAAAAATAATAAGGCATGATTGGTGGGAGGGAATGTGTATTTAGGGGCATAATAAA
AAGGTGGCTCGAAGCAGGAACTTTGGCCTCATGGTGTCATGGGTGGATGCCTGGACTCCAGTGTGCCTGT
GAGGGGCTGGGTTAGGCAGTCGGCTGTCACACTCACATGTGCCTGCAATAAACCTTTTGGAATTTCATGA
ACGAGGTNCTATGAATTGCCTTTTGCCAATGAATGGATGTATTTTTCCAAGGGGGGAATAGTATCCTTGA
CTTTGGCAGTCACCTTTTTGTATGTCTCTAGARAGGGGTCAAAAAAACTATGGTAAAGATGAGGCTTATG
AGTGAATACCTCTGGGACAAACCTTAGGACTCACAAGCTATGCCATGTTTTTCAGGANACTCTGTACCTA
TCTGGAATCCAATCCTGGGAGAAGAGGAAAAAGGAGCTAATATTTGTCCTTTATACTCACTCTGTGCCAG
ATACTGTGSCAGGCATTTATAATTGTTTGTGTCACCCCATGATATCCGTTAAATTAATCTATTACCCCCG
TGTTCTAAATAATAGATCTTAAGTGTGGAATGCATCTATCCAACATAAATGCCCATGTTGAAAGAAGGAA
AGATGTCATTCAAGTATTTTTCAAATTCTTTTTATTATGACTATGCCCTTCGCAACACTGTGAAAACAAC
CCCTGGGGGCATCTGCCTTCCAGAATCTCTCTCTGGCTTCTCACCAGCTTGGTTTCCTCATGGGGAGTGT
TTTATTTGGCCTCCCCTATCTGAKCTGCACACACACCAGGGGGAGGCCACTGGCTAACAGTAGGACTTCA
GTGCCCTGAGGAAAAGGCTTTGGAATTTAGGCACACGTTTCTCTCCTTGGAATCCTTCTAGCATCTGGA
AAAGGAACCTGGTATTTCTGCAGTTAGATACCAGATGCACCAGAACAGGCTTCGAGTGCTGTGATTCTTC
CTGGTTCCCAAGTCTTGTTGTTCATCACAAACTGTATCTTTTAAGGTTAAAAGTCTTGACCTTCATGGG
GTCTGGGACAATCCGATCTCCAAGCATGGAGGAAAGGCAATGCCTGGACCACTGACTTGCATTGAAATCC
TTTCTTGTGGGCTAGGGTTTGATGTCTCTTTTTCATCTTTGGACTGGGGATCTGCATCTTCCAGGTCCAT
TTAAGCACTGAAACTAGATGCAAATCTCTTTCGAGACCTTACATGTTTTAGATAGTCATGTAATGACTTG
GATAGACATTTAAATAACTTGTTCCAAGGTCGGAAGACCCAAGAACTCCTCAGAGTTCCTCTTCTTGCTT
CTTGAATCACATCCTCTAAAGATGACTCATGTCTCCATAGCAATTGTTAAAGGTGCTGCCTAGACGGGAC
CCGCTCCCACCTTTACTTACTTTGCTCGAAGGAACCAAAACAATGTCCTTGTGTAAAGGGGCTGTCATAT
CCAGTTTTCCTTTGAAATCTGGCCCCCAAGATCCTGCTTCTTTCTAACCTGGCAGCTGTCATGTCCCTTC
AAGATGATGTGGGAAATGGCCCTTACAACTTGGGAACCACAGAAATTGCTGTATTTCGGGAAGATTCACC
```

FIGURE 310 cont'd

```
TCTAAACTGAAGGCTTCATTCTGATAGTGTCTGCCCTCTCTACCCTGATTTCGCCCTTCTTTGCTTCCAT
TTTTAGCCCAAGGCTTTGAATTTGATTGAGTAAGACTTAGAGGCAGTATAAAGAACACCATAAACTTAGG
CAGAGGTCCCTTAGGGTCTCTAGAGTTGAAAATAATTCTACAGCCTTAGGGGGACCTCTTGGCATTGACT
CTAAAGGGAGAGAATAGCCCCTGTGTCCTGGCATTTCAGTCTAGACCTTCAAGGACTGTTCTCTCTTGAC
AGGCAAGCAAGCAAAGAAAGTTTTGCAATAGATTTCAAGCCAGTTTTTCCATTCAAACCAAGATGCAAAT
TCATAAAATTACTCTTTTCCTGGAATAGATCCAGGCAGCTGCCTTATTAGAACTTTAGATTCGGATCTAT
TTTCTTAACACACATACACATACACGCGCATACATACATATACAGAGAGATACGTGGAGAAAGGAAATTT
ACTCTATCATTGCAATACTTCAAGAAAGAGCTGTATTTTGCCTTTCTGTAATCTCCAAGATAGTGTCTAG
GAAAGTAATAGTATAACTATAGGGATACCGAAACAGGAAAAACCAGCCATCACTCTTGAGAAAGTTTGAG
TTCGACTCACATGGGAGAATCGAGGTCTGCTACTCGTCTTGCTTTGTGCCCCATCTGTGCCTGGATGCCC
TACTACAYCTGCTTGACTCGTCTGGGCTGCTAGCCGGGTGTTGTGGCTGACATCCTTTCCTGGCCTTAC
ACACATAATAGACACATCCCTAACGGCGTGTGCCTGGTCCAGCCACATACAGCCACCACATGTGTCACAC
ACTGTCCCCCTCATCCATGTGGACTTGACTGGCATTTCAGCAGCTCCACTGGGATGCTCTAACCCCAGTG
TGTGGAGTTGGGGTCCCTTCATCTAGGTTGACCCAGGTATAGCATTTTTAGCATTGCCTTTCCAGTCTTG
ATGATTCATTCATTGAACTCATTTATTTCTGGAGCCCCTGGTACACTCCAGGCACTGCGCTAATTGCCAG
CAAAGCACAACTGAACTAAATCCACCTTCAAGGAACCTAGCCATAACGAGGGAGGCAGCATGGAAGTACC
CTACAGGGGAAGTCCTGAGTGCTGTGGGAGCATCTCACCGTGGCAGCCAGCCCAGTTTTGGCAATCAGG
GGCTTCCTGAAAGAGGTGACATCAAAGCCCGGATGTGTCAGAGGACTGAGGGAGAGTGTTACTAAAGGAC
TTTCAGGCTGAGAGGATAGCACAGGACTCAGCCCAAAGGAGGGCCAGTGTGGACTGTCCAGGGCCAGCCT
GCAGTACAGAGGCTGGAGCTTGGACTTGTAGAGGGAGAGAGAAGAGCAAGGGACGTGGACGGGGCAGTGA
GCCAGGCTAGCCACAGAGGGTTCCCGGGGCTTTGCTGGGGATTCAGGGAGCATAAATAAGAGCTTTAGGT
GGTGCTGTGTCCTCTGCAGCCCACTGCTGAGGTCCTCCAGACAGRTAAGGTGTGGTCACAATCAGGGCCG
GGGTTTCCCTGCTCACTGCGGCAGTGCAGGGTGCTTGCTGAGATGAYTCATCCCAGGGTGTCCTCTGTC
CCTTACCCAGCCCCAACTCCTCTTCCTCTGCCAAAAGCTATTTGAATTCAAGGACTTTAACCTGGGCCGG
ATCTGGTTTGGAGACAAAGGGGACAGCTCTGGGTCAGCATGACCTTCTTTAGAGCCACTAAGGCGAAAAA
TACCGTTTGGGACCAGGCTGGCCTAGACCCAGGGATGAGAATGCACCCTAAAATAAATATACGGGAAGCA
GCAGAGGGCTTCCCTGTCTAGTGTGATCCTAACTAAAGGCAGCTCTCTTGGGCAGCCTTCCCCTGGAT
TAGGTCACATACACCTGGTGGCCAAGCCTCTGCTGGGTCCCAAATACACACCCGAGTCCTGCCAAAGAAA
GGAGATTTTTAAAAAGCACAGACAAATTGTATGCAAGTGGAAAATACCCATAGGCCTAGACAGCTGTGGA
GGGAAGACCTCGTGGGTACCTGGAGGCTGCCAGAGCTGGGAGCTCTGCAGGTATGAGTCAGGGAAGGCTC
AGAGACAAGCAGAATCTCTCTATGGAGACAACTTGCAGTGCCTTTTAGGTTTTCCAAATAACCTCGGAGT
TCAGAGCATTGGGTTTTTTTCTCCCTCCCCACCCCCAGAAAAATAATTAGAAAAATGTTTAGGAGAAAG
GAAAAGAATTAGATGCATCAGAATACCAGCTATAAGCCAACACTGTTTCCAGAAACTCAAGAAAAAGCTC
AAACAGAAGACAGTTCCCCTGAGAGGCTGGAGGCGTTGGTGCTGAAGGCAATTTTCCTAGCTAAGGGGCA
CTGGGCCTTGCTGCACCTTGGGGCTGACCTTTTTTGCAAAACACCCACCCCTGCCCTCCTGGCATACTCA
ACAGCAACGCCAGCTTTCTGGACCCTTGGAAAGATGTTAGCTCAAACACCCACTTTTTCCAGATCTTCCT
CTTGCTCTTCACTGAGGAATTTGTAATTCTGAGGCTAGCGATGCCGACTCGGATATTCCGCAGCCCAGGT
GTTTAGATTAGAATTTGTCCAGCGGTAATCCTGATGCTGGAAACCAACAAACATTTGGCCTCATATTCAC
CCATTTAAAAACTAGAGCCCCTGGCAGGTCCCCTTAGGGCCATGTGTTCATGAATATAAGCCAAGTTTG
CCYTAGCGCTKGTTCATGGAATATAAGCCAAGTTTACCTCTCCCCATTTTCTGCCCTGGCCCACTTCCCA
CTCACCTCCACCTCATTGCCAGGAAGGGATCAAAATGCCTCCATGCCAGTTGTTAAATGGCTACATATTT
GCCCTTCCCAAGGGTATTTGCATTTNTATTTAGGAACATGGCCTTATATTCAAGGAAAATCTAGCATCAA
GATTACGAGGCATCACCTCTCAATCAGGTCTGGGAGGTATCTTGGGGCATTGCTCTTCTGAACACCTGCA
GAGGCTTCCTCAGGTGAGTGTGGGAGCCCGGAAGTGGCCTCCCTAACCACTCTGCCTGCACATGAATTCT
CCAAAGCAGTGGGCCCCATCTGTTTCAATTACACATGCCTGTCAGCAAAAACTTCGTGAGATGCACTCT
CTCTGTGTGTTTATTAATTTATTTAAAGCATATATCCCTTTACTTTTGTACTACTATATTAGGCACATTA
TAAAAAGTATACAGCATAGAAACTTTAAATGAATAAGACACAAAATATTATAAACAGAGGTTCTGGCATT
TTCTCTCTGAACTCCTGAGGGGGACCTTGGGCACCTCCTGGTATGTGCACACCCCACTTTGAACACCCTT
GCTTTAGTGCAAATCAGCACGCCTAAATRGCATCCCAAACCCACTGTGCGACATTTGGCCTGCAGAATAG
GAAAGTCCTAGGSCAGAATCCCCAGGAACTTCAAATCTGGGAGATGAGGAAAGAAAACTCACTCACAAAC
AACATAAATGTAAATAATTCAAAACCCTAAAGGAGAGCTGTCCCTAGACAGTAGTGGCTACAGGTGCTAA
GCAAAAGTCAGGTACACTGGACAGAGCCATGCGATTGATTGTTCATCTTCCCTCTCTGGGTCTCCAGAAA
AGGACACTGGCAATATCCCCAGCTCTCTCCTGATTGGAATTCTTTGAACCCTCGAAGTGCTCCAGCAGTA
CTACCCCCCACGTAGCAGTGGGCCCATGTCGCTTGAATATTATTTTTGATTTGACCACCAAGATGTAATG
ATGATTCTATTCCATTTTGAAAAGGGTCTGAGAAAGTGTACAGGTCTAATTATATATACATATTTATACA
TGTGTATTTTTGTTTATTGTTACATTTTGACATTGGACTTTCTATTAAATAATTTTTAAGAGTTG
```

FIGURE 311
SEQ ID NO: 303
Genbank ID        : X74794.1
Unigene ID(#167)  : Hs.460184

FIGURE 311 cont'd

Unigene name : MCM4 minichromosome maintenance deficient 4 (S. cerevisiae) MCM4
>gi|683749|emb|X74794.1|HSP1CDC21 H.sapiens P1-Cdc21 mRNA
GAATTCGGCACGAGCGAGTCGCGACGTCGTCGGCAAGCGGCCGCCTTCCACGTAACGCGCGCCGGCGGGG
GAGGGCGTTGGCGCGGAGCCGACGGGAACGTCCGCGCTGCGGAGCAGGGCAGGGAAGCCGGGAGGCGGGC
CCGGCCCGAGCTTGTCCTTGTCGCGCAGGTACTCCGAGCACTATGTCGTCCCCGGCGTCGACCCCGAGCC
GCCGCGGCAGCCGGCGTGGAAGGGCCACCCCCGCCCAGACGCCTCGGAGTGAGGATGCCAGGTCATCTCC
CTCTCAGAGACGTAGAGGCGAGGATTCCACCTCCACGGGGGAGTTGCAGCCGATGCCAACCTCGCCTGGA
GTGGACCTGCAGAGCACTGCTGCGCAGGACGTGCTGTTTTCCAGCCCTCCCCAAATGCATTCTTCAGCTA
TCCCTCTTGACTTTGATGTTAGTTCACCACTGACATACGGCACTCCCAGCTCTCGGGTAGAGGGAACCCC
AAGAAGTGGTGTTAGGGGCACACCTGTGAGACAGAGGCCTGACCTGGGCTCTGCACAGAAGGGCCTGCAA
GTGGATCTGCAGTCTGACGGGGCAGCAGCAGAAGATATAGTGGCAAGTGAGCAGTCTCTAGGCCAAAAAC
TTGTGATCTGGGGAACAGATGTAAATGTGGCAGCATGCAAAGAAAACTTTCAGAGATTTCTTCAGCGTTT
TATTGACCCTCTGGCTAAAGAAGAAGAAATGTTGGCATAGATATTACTGAACCTCTATACATGCAACGA
CTTGGGGAGATTAATGTTATTGGTGAGCAATTTTTAAATGTGAACTGTGAACACATCAAATCATTTGACA
AAAATTTGTACAGACAACTCATCTCTTACCCACAGGAAGTTATTCCAACTTTTGACATGGCTGTCAATGA
AATCTTCTTTGACCGTTACCCTGACTCAATCTTAGAACATCAGATTCAAGTAAGACCATTCAACGCATTG
AAGACTAAGAATATGAGAAACCTGAATCCAGAAGACATTGACCAGCTCATCACCATCAGCGGCATGGTGA
TCAGGACATCCCAGCTGATTCCCGAGATGCAGGAGGCCTTCTTCCAGTGCCAAGTGTGTGCCCACACGAC
CCGGGTGGAGATGGACCGCGGCCGCATTGCAGAGCCCAGTGTGTGCGGGCGCTGCCACACCACCCACAGC
ATGGCACTCATCCACAACCGCTCCCTCTTCTCTGACAAGCAGATGATCAAGCTTCAGGAGTCTCCGGAAG
ACATGCCTGCAGGGCAGCACCACACAGTTATCCTGTTTGCTCACAATGATCTCGTTGACAAGGTCCA
GCCTGGGGACAGAGTGAATGTTACAGGCATCTATCGAGCTGTGCCTATTCGAGTCAATCCAAGAGTGAGT
AATGTGAAGTCTGTCTACAAAACCCACATTGATGTCATTCATTATCGGAAAACGGATGCAAAACGTCTGC
ATGGCCTTGATGAAGAAGCAGAACAGAAACTTTTTTCAGAGAAACGTGTGGAATTGCTTAAGGAACTTTC
CAGGAAACCAGACATTTATGAGAGGCTTGCTTCAGCCTTGGCTCCAAGCATTTATGAACATGAAGATATA
AAGAAGGGAATTTTGCTTCAGCTCTTTGGCGGGACAAGGAAGGATTTTAGTCACACTGGAAGGGGCAAAT
TTCGGGCTGAGATCAACATCTTGCTGTGTGGCGACCCTGGTACCAGCAAGTCCCAGCTGCTGCAGTACGT
GTACAACCTCGTCCCCAGGGGCCAGTACACGTCTGGGAAGGGCTCCAGTGCAGTTGGCCTCACTGCGTAC
GTAATGAAAGACCCTGAGACAAGGCAGCTGGTCCTGCAGACAGGTGCTCTTGTCCTGAGTGACAACGGCA
TCTGCTGTATCGATGAGTTCGACAAGATGAATGAAAGTACAAGATCGGTATTGCATGAAGTCATGGAACA
GCAGACTCTGTCCATTGCAAAGGCTGGGATCATCTGTCAGCTCAATGCGCGCACCTCTGTCCTGGCAGCA
GCAAATCCCATTGAGTCTCAGTGGAATCCTAAAAAAACAACCATTGAAAACATCCAGCTGCCTCATACTT
TATTATCAAGGTTTGATTTGATCTTCCTCATGCTGGACCCTCAGGACGGCAAGCCTATGACAGGCGTCTGGC
TCACCACCTGGTCGCACTGTACTACCAGACGCGAGGAGCAGGCAGAGGAGGAGCTCCTGGACATGGCGGTG
CTAAAGGACTACATTGCCTACGCGCACAGCACCATCATGCCGCGGCTAAGTGAGGAAGCCAGCCAGGCTC
TCATCGAGGCTTATGTAGACATGAGGAAGATTGGCAGTAGCCGGGGAATGGTTTCTGCATACCCTCGACA
GCTAGAGTCATTAATCCGCTTAGCAGAAGCCCATGCTAAAGTAAGATTGTCTAACAAAGTTGAAGCCATT
GATGTGGAAGAGGCCAAACGCCTCCATCGGGAAGCTCTGAAGCAGTCTGCAACTGATCCCCGGACTGGCA
TCGTGGACATATCTATTCTTACTACGGGATGAGTGCCACCTCTCGTAAACGGAAAGAAGAATTAGCTGA
AGCATTGAAAAAGCTTATTTTATCTAAGGGCAAAACACCAGCTCTAAAATACCAGCAACTTTTTGAAGAT
ATTCGGGGACAATCTGACATAGCAATTACTAAAGATATGTTTGAAGAAGCACTGCGTGCCCTGGCAGATG
ATGATTTCCTGACAGTGACTGGGAAGACCGTGCGCTTGCTCTGAAGCCTTGTGAGCAAGGAAGGCTCCCT
GCATGTCATGCAATTCTGCACGCCACATGGGTGTGGTCATGCAATCATCAGTTGGCCGCCATCAGTGTAA
ATAGAGCTTAAAGTCATGGTTTGGCTGCATAAAAAATTTTCTAACTTGGGTTCAATATTTGTAGTGAAGT
ATCTGTTTTCATTTTTTTCACGTTATAAATAAAAATACTATGCTGGCCGGCGGCGGTGGCTCACACCTGT
AATCCCAGCACTTTGGGAGGCCAATGTGGGTGGATCATGAGGTCAGGAGTTCAAGACCAGCCTAGCCAAG
ATGGTGAAACCCCGTCTCTAGTAAAGATAACAAAAAATTAGCTGGGCTTGATGGCATGCGCCTGTAATCC
CAGCTACTCGGGAGGTTGAGGCAGGAGATCGCTTAAACCCAGGCGGCAGAGGTTGCAGTGAGCCAAGATC
GCGCCACTGCACTCCAGCCTCAGCAATAGAGTGAGACTGTCTCAAAAAAAAAA

FIGURE 312
SEQ ID NO: 304
Genbank ID : AW974812
Unigene ID(#167) : Hs.433049
Unigene name : Transcribed sequences
>gi|8166015|gb|AW974812.1|AW974812 EST386917 MAGE resequences, MAGN Homo sapien
s cDNA, mRNA sequence
TTGAATTTAGGTGACACTATAGAAGAGCTATGACGTCGCATGCACGCGTACGTAAGCTTGGATCCTCTAG FIGURE 312 cont'd AGCGGCCGCCTACTACTACTAAATTCGCGGCCGCGTCGACTTTTTTTTTTTTTTTTTAAAAAACAATGA
ACCATGAATGCCATTAATGCTTTTTCTATTTAAATTGGTAGAGCCTCTCAAGATAGCAAGAGAGCATATT
GTGGTGTTGTAGAAAGAATATGGTCTTTGGAGTCAGCCTTATTTAAAGGTCCAATCTGAGTAATTTCAGA
AAAGTTGATTTGACACAATTAGTTAAGTGTTCTCTTCTACGAAATAGTGATAATGTTGTCCACTTTTCTG
AGTTGCGACAATTAGAGGTTATATATGTAAGCTACCTGGAACAGAGTCAGTGCTCTATTCACCTGGATGA
ATGGATCAATGACATTATAAAGACTCTATAAATTTGCAATTCCAGAAAAGCCAAATACTTTCCCTTTTGC
ATTTTGCATGTATGTGCATGAATATATGGCTCCAAAGACAATTATGAAGGAGAGATGCCACAAAATATGA
TGCTATGTTCTAGATGCATAGTGGCACGGGATTGCAAAATAGTTCCAATTGCACTAAGAATAATAAAGTC
GAGAAAATTGAGATCCTACAGAAATATTTTATCTTATGGGA

FIGURE 313
SEQ ID NO: 305
Genbank ID       : AF277174.1
Unigene ID(#167) : Hs.130946
Unigene name     :       egl nine homolog 1 (C. elegans)       EGLN1
>gi|12751078|gb|AF277174.1|AF277174 Homo sapiens PNAS-137 mRNA, complete
cds
GCAGCATGGACGACCTGATACGCCACTGTAACGGGAAGCTGGGCAGCTACAAAATCAATGGCCGGACGAA
AGCCATGGTTGCTTGTTATCCGGGCAATGGAACGGGTTATGTACGTCATGTTGATAATCCAAATGGAGAT
GGAAGATGTGTGACATGTATATATTATCTTAATAAAGACTGGGATGCCAAATTTGATAGACTGCTGTTTT
TCTGGTCTGACCGTCGCAACCCTCATGAAGTACAACCAGCATATGCTACAAGGTACGCAATAACTGTTTG
GTATTTTGATGCAGATGAGAGGCACGAGCTAAAGTAAAATATCTAACAGGTGAAAAAGGTGTGAGGGTT
GAACTCAATAAACCTTCAGATTCGGTCGGTAAAGACGTCTTCTAGAGCCTTTGATCCAGCAATACCCCAC
TTCACCTACAATATTGTTAACTATTTGTTAACTTGTGAATACGAATAAATGGGATAAAGGCCCAAAAAAA
AAAAAAAAAAAAAAA

FIGURE 314
SEQ ID NO: 306
Genbank ID       : NM_017535.1
Unigene ID(#167) : Hs.194369
Unigene name     :       arginine-glutamic acid dipeptide (RE) repeats
       RERE
>gi|8922158|ref|NM_017535.1| Homo sapiens hypothetical protein
DKFZp566H0824 (D
KFZp566H0824), mRNA
TTTTTTTTTTTTTTTTTAAGCAGGAGAATGGCGTGAACCCGGGAAGCGGAGCTTGCAGTGAGCCGAGAT
TGCGCCACTGCAGTCCGCAGTCCAGCCTGGGCGACAGAGCGAGACTCCGTCTCAAAAAAAAAAAAAAAAG
ATTGCACAGACTGTTTCCTCTCCGGTGCAATCCCCTGTCCTTTCCACGCAAAGATAACCACTAGACTGGG
TATTCTGCTATAACCCCCCTCCTTTTCCTTATGGCTTGCCTCATATATGTGTATTGCTACACAGTATATT
AGTTTTGCATGTCTTTGAACTTCCTATGAATGGAGTCATGGAGGAAAAATGTCCTGCACCTTGCTGTTTT
CATTCCCCTTTATCCCGAGAGGCAGCTCTGCATCCTGTGGTACTTCACAGCCTTGTATGAATAGAGCGTC
TTTTCCTTCTCTTTTCTGCTGTTGATGGACATTTCAGTTGGTTCCAGTGTTTTGCTGTTGCATACAGTTC
TGCTGTAAACTTTCTTGCACACATCAACTGGCACACATGCACACGAATTCTTTAGGGTATAGTTAAGACA
ATTTTTGAGTTACAGGTATGCGTATCTGCTATTTTACCAAGAAAAGCAGATTGTTGTTTTCCAGCTGTA
TGTAAGAATTCCAGTAACTTCACATCCTAGCCAACACTTGATAGAATCAGACCTTAAAATGCTTACCAAC
ATTATAAACTTGAAATGTCTGAGTGATTTTAATTTGTATTTCCCTGGTTTCCAGTCATATTGAGCATCCT
TTAATGAGTTTATTGGCTATTTGTATTTCCTCCTTCTTTATGAAGGGCCTATATAAATCTTTTGCTTACTTTTC
AATTTGATTGTCTTTTTCTAGATTTGTAAGAGTTCTAGATACTCATCTTAAATAATGTGTGTTGCAAATA
CCTTCTGGCTTGTGGCTTATCTTTTCACACTTTTTATGATTGGTTAAAGATTAATATGTTGTTAATTTTA
ACGATTTTATCCTCTCTCCTTAAATGTATCAGCCTTTATACTTTGAGCTTTTATTTGTTAGAAATCTCTC
TTGGTCATTTAGGCAGTCTCCTATACTTACTGTTTTCTAAAAGTTTTATAATTTTGCTTTTCATATTTAA
GTTCTTAGTCCGTGGGTTTGGTGATTGTGTAGCATAAAGAAAGAGACCAGATTTACTTGTTTCTGTAATA
CATCACCAGGTGTCCCAGTGTCATCTCTGGAGAAGTCCAGCCTTTTCTCCACTGATTTGTGTTGCCAGCT
ATGTCAAAGTGAAATTTCCGTAAGAGTGTGAATCTGTTTCTAAGCTGTTTTGTTCTGTTGGTCTCTCTGT
CTATTCCAGTGCTTCACTGTCTAGCTTTAGGATAATTGTTGATAGTTGACTTAGCAGGTCCCCTACCTTT
TTCTTGTTTTTCAAGAGTGTCTTGATTAGTGGCACTTTATTCTTCTTTAAAATTTTTAAAATCAGCTTGT
CTTGTTCCACAAACTAACCAGCTGGGATTACAGGTATGAGCCACCGCACCTGGCCCTTGGGCATAAATTG
TAACATAAGTGTATGTTCTTCGACACATTTAAGAGTGGAGTGATGGTGTCATAAAATTAAATAATGGGAT

FIGURE 314 cont'd

```
GTTCTAAGTCCCTTAAGCTGGACCTTTCCAATCTGTGCATCAAAGCTAATTCTGCATTAAAGTGCAAGGA
CGGCTCACAAACCCCATAGTTGCCTGATATAGATTGGCAGGTGCATTCTCTTGGTTTCGTTTTTATTCCT
GCTGAAATGTTTAATGATCTTGTGTGGCGTCATTCTGTTGCCGATTGTGTAAGAGAGAAGCTGGACCTGG
GTGGAGACAGGCTTCTTAGGTGGCCTCAGTGGGCTGTTGGGCATTTATGGTTCTGCTGGTTGCAGCTGAG
ATCTTCAGACAGAATACTCTTCTCCTTGACCAGCGCTTATCTTTCAGATTGTGAACTAGGCCCAGACACC
ATTACCATTCACCATCTCTAACATTCTCTTATTCTTTGACTACATAAGGCACTGTCGTTCTAGGGGAAAC
ATGATAGAGGAAGGAAGTTGGTTGCAGAAACCATTCTTTGAAAGACTTTTTTTTTTTTTAACTTAGTCA
ATTAAAATAGTCCTTTAAGGTGAACTTAGTTCTGAGTTTCTGGTCCTTTTCCCAGATGGAAAAGGATTTT
CAAGAAAAAATCCTGTCACTTACTGAGCATGTGTGCCGGCTCCTTTTGGCACTTCCATCCTCACCACAA
CCCTATAAAGGAGGGAGCTCGTGGCGAGGCAGCCCAGGTTTCTAGATAAGGAGAGTCTCGAGGAGGTTCC
TTAACCTTCCTGTGGTGGTTTTCTCCATTTTTTAAAATGAAGAAACAGAGGCCAAGAGAGGTTAGGGAA
TTTGCTCAAGGTCGTGCAGCCAGTGGCAGCTGTTCTCACTCGGAGTTCTGAGAGAGGTAAGCCTCAGAAG
CCGGGCATCCATTGTGTGTAACGTAGTAACGTCTTGCCTGTGCATCTAGAAAGGTACCTGTTATGTTCCG
TTCATAGGAGAATTGAGAAAATATTAATAGTCACTTCATTTTAAGAACTCCAGTTGAAAAAGGCTAGACA
GTCAATGTTTGTTCATTGTTTTTCTCCATTCTTCCCCAGCATGCGCGCTCTCTCATGCACACGCACGCAT
GCGCACGTGGCTGAGCCAAAGCCTAAGCTGCGAATTGAGTTTCGTTAATTCATGTGGAGGCAGCTGAGAG
TGCCACCTGGTCCTGAAGAAATTGGGATACTTGTGGGCACAAAGGTGGACCTGAGATCACTGGAGCCAAG
CTGGTGGAAGTGTTGACCACTGCCGTTGGCAGAGAGCTGTCATTACTGGTGCTTCAGGCCACAGCTCAGC
AGGCTGTCCTTGTTCTGTTTGTTAAGAGCCTAGCAGCATGGCTAGCTTGCAGGCATAATCCCAGAGCCT
CTTGCTATCTGCCTGCAGGAAGTCTCTATGTGCTCCAGCACACTGAAGGAATTTGGTGCTCACTTTCTCC
TGCTTTTGAGCTTTGGTCCTGTGTTATTACTAATCCTTAGAGGAAGATTTGACTGTAACCACTTTCCTG
AGTGCTCTTAAGGCAGGTCCAGAGGATTCTCACAGCGTGAAATGAGAAAACGCTCAGCCTCAGAAAATG
GAAGTTATTCTTTTAGTGCCAAAGTGTCATTGGACCACAGTGCAGCTTGGTTAATTCAGGTTAAGACTTA
GCCCCTGGAACAGTGTCAAGCCAAGGCCTGTGTGGTTTCATCATAGATTTGTAAAACAAAAAACACGTGT
GTTCTGGTAAATTCCAAGCGCACATTAGTGCATACGTGTATGTGCAGGAGCACTCCCTGTAAGACTCTTG
TTCTCATTTCACACTGGCGCTCCCCGGGGCTGGGGAAATCATTTTCATTTTTGAGAGTAACCTTAACTA
ATTAAATGGATCAAGGGACTCTTTGTGTTTTGTTTTCATTTGTTTTGTTTTTTACTTTAATGTACAGAT
AAATTAAGGGAAATAATAATTACCTTGAATAATTTTGATTCTCGTAACTAATTTTCCACCTATGTGTGTT
TAGCTCAATTTTGAAATGGTTCACTGAAAGATTTCCAAATTTCTTATCACTGAAACTGAGTTATTTCACT
TTTATGACTGTTAGTGACTCCTCTGTTTTATGTATTTCTGGTGCAGTATAATTCTTCTATGTCTGTGTGT
CTGTGATAGATCTCAGTTCAAGTTAGCGTTTCCCGAGCACCCATCTTGTGTCAGGCACTCTGCTAATGAT
TGCGCAGGTTACAAGGTTTAGAGTGGCCACATCCCCTGTTCACTTGCAGTTTAGAGTCCAGTCGGAGGAA
AGGGAGGAGGGGAATCATGTTATAGACATAACTTGATATCCTGCAGGACTCAGTGATGTATGAGCCTCAA
AAAGGTCACAGCTGAGTGAGAGAGTTGGTAATCATGGAAACAGGCGCATCGGAAACTCGCTTCCTATGGG
TCAGTAAAGTGTGTATGAGGTGGTGTGGATGACAGCACATAGAGCTGGAGGGGTGGGCCAGCAGCAACCA
GGAGAAGGCGTTCCAGGTGTCTGCACCCAAGGAGATCCTGGGGTCAGAGGCAGGACATGTGGGAAAAACC
ATTGGTCCCTTTTACCCAGGGAAGGACTCAAGAAGCCGAACGTGATAGGAGATGGAGGCTCCCAAGCCCT
GGCAGACGTTACAGCAGCGCTGAGCACTTTCAGGACCAGGACTCCAAGGTCCAGCTCTGGAACGCCCCTC
TCTGCCCTGACTTTGGTTCCTTCATCAGCAGAGGGCTCCTGGGCTATGGGCTCAAGTCTGAAGTCACCT
TAAAGAGAAATCTCTACCTTTCTGTTCTCCTTCATTGCTGAGGATTTTGACTTGTGTTGAAAAGTTTCTG
AAGCTTTCTGCAGCTGGAAAATCAAGCTTTTAAAAAAGCTCTTGATGGGCCAGGCTTGGTGGCTCACGCC
TGTAATCCCAGCACTTTAGGAGGCCAAGGCAGGTGGATCATGAGATCAGGAGTTTGAGACTAGCCTGGTC
AGCATGGTGAAACGCCATCCCTACTAAGGATACAAAAATTGGCCGGGTGCGGTGGCGCGTGCCTGTGGTT
CCAGCTGCTCGGGAGGTTGAGGGAGAAGAATCACTTAAACCCAGGAGGTGGAGGTTGCAGTGAGCTGAGA
CCATGCCACTGCACTCCAGCCTGGGCAACAGAGCAAGGCTCTGTTTTGTTTCGTTTAAAAAAAAAAAAAA
AAAAAA
```

FIGURE 315
SEQ ID NO: 307
Genbank ID        : AI828648
Unigene ID(#167)  : Hs.406684
Unigene name      :     sodium   channel,  voltage-gated,  type  VII,  alpha
       SCN7A
>gi|5449319|gb|AI828648.1|AI828648  wc10h07.x1  NCI_CGAP_Pr28  Homo  sapiens
cDNA c
lone IMAGE:2314813 3', mRNA sequence
```
TTGTGGTTTACAGGTTATATTTATTATTTTCTATAGTATCTAAAAAGTAACATATATTGTTAAGACTTTG
TTAAAAATAACTCTTTACACAGCTTTCGGAAGGTAACTGGCAAACAAGGTTTACAAGTAAAAGATAAACT
TTTCAAACTAAAATCAGTTTGTTGTCTTTACGCAATTTACAGAAGCAAGTTATGATTCAATTTAAGTATC
TGAAGCAGTTTCCACAATAAAGCATTCCCAAGAAATAGAAAACGGAGCTTAGATAAAGCACCAGCTGTCA
```

FIGURE 315 cont'd

CATTGTCACCAAGTTAACACTGGTTCCTCACTGGTCTCCATAACATGATGGAGAGCAGGAGAAGAAAGGG
AAGGAACACTTAGAGAGGAAAAAAAAAAAACCCTGAAATCTGAAATTACATTTACTTAGGGCATCCCCTA
AAGGCATCTTGGTTAGGTTATTCAATTTCTGAGGGGCAGAAAAAGATTATAGTAGTTAAGGCTTGAGATC
ATGCATTCAGAATAAAATACAATCACTGATACATAAACTATATTGAATGTTATACAACATATTTAAAGGA
TGATATTTAAATCAATAATATATAAAT

FIGURE 316
SEQ ID NO: 308
Genbank ID       : AW594320
Unigene ID(#167) : Hs.405557
Unigene name     :     hypothetical protein DKFZp434C0631   DKFZp434C063
>gi|7281578|gb|AW594320.1|AW594320  hg59d01.x1  NCI_CGAP_GC6  Homo sapiens cDNA cl
one IMAGE:2949889 3' similar to SW:A1I3_RAT P14046 ALPHA-1-INHIBITOR III PRECUR
SOR. ;, mRNA sequence
TTTTAAATGACAACATTTAATGGGATGATAAGGAAATAAGACTTGTGCAAGAAACCATAGCCCACTGCAG
ACTGTTCACGATGTCAGATGGTTCATGATTTTTTTCCAGGTTTGATACAGAAGAATCAGTTTGTTAAAAG
AAATGCTTCTCCATCTTTTTCGTAGTAATCGTAGACCATGCCTGGGGCTGGCTGGCTGAATGTTGAACACAAGG
TTGCTCTGCTCAACAGAAAAGTGAAACTGTCTGCTCGACCAAAAACATTTTCCAAGTAGAAAAGAACAT
GGTCATTCTTGACTTCAGTCTTCATCACTTGGCCCTTGTTTTCAAGCTCTTCAATGGATGACATGGTTGG
AGTAAATCCTGATAGCATTTTTACATCTATAACCACCATACTGGATTTATTGCGAATTCCAGTGTATTTG
AGGTTCACTGTGAGGTCAAAAACAGTCAAGAGTAGTTCTTTACTATTTCCAAGGAAAGAGAAAATCCAG
ATGCCTTCTTAGGTAGGAGAACATTGTACTTAAGGGTGGCCGTGATAAATGTACAACCGCGGTCTTCCAC
ATCTACTGTGTA

FIGURE 317
SEQ ID NO: 309
Genbank ID       : BF508639
Unigene ID(#167) : Hs.58488
Unigene name     :     catenin (cadherin-associated protein), alpha-like 1
                 CTNNAL1
>gi|11591937|gb|BF508639.1|BF508639 UI-H-BI4-aop-a-07-0-UI.s1 NCI_CGAP_Sub8 Hom
o sapiens cDNA clone IMAGE:3085357 3', mRNA sequence
TTTTTTTTTTTTTTTTAATGTAAAAATCAATTTATTATACAACAATCATAGATAATGCTTTTTATCTAC
AAAGAGAAATGGCTTCTGCAGCCTCCCTGTCTACTCCATTCATGATACTATGTTCTTAAGATATAATTAC
TTTCAAAGGAAAACAAAGCGATATCCATATTTTCCAAACAAGGAAGCCCCCAGACACATTTATGAACGAT
ATGGAAATATTGGAAAGAACTCAAATGGACTCCTAGATACAAAAGGCTGTTCTGCCCATCACAGTAAACA
CTGTTTTGCCTTAAAATAAAAATAATAAAATATTTCTCAAATGCAGGGGTGAGGACTTTACCCCGTAACA
TGCCTAAGTGGTTCGATATATAATTTTGATGGCTTGACAATTGCTATGTTTAATTCCATTCAGTTAACAT
TCCATTTTGTTAGTTTAAAAAATTGGGGGAATTATTAATAGATATGCTTTACAGTATTTAAGTATTTTCA
TTCCCATGGGTCAGAGGAAATTTGAGAGAAAACATTCTCCATTTTTTTTAATAGATTATACAAATATTAA
TTTTTCAATAGTTTTTAGAAAAATCACATTAAAATAAGCATTTTGGGTTTTTGAGGTTACACACTTAACGA
CAGGTTAAAATGTTTACCTGGATTATTTTTTGTGGC

FIGURE 318
SEQ ID NO: 310
Genbank ID       : AW188131
Unigene ID(#167) : Hs.250696
Unigene name     :     DEAD (Asp-Glu-Ala-Asp) box polypeptide 17 DDX17
>gi|6462567|gb|AW188131.1|AW188131  xj92f11.x1  Soares_NFL_T_GBC_S1  Homo sapiens
cDNA clone IMAGE:2664717 3' similar to gb:X52104 P68 PROTEIN (HUMAN);, mRNA seq
uence
AAATATTTATTTAACCACATGTATATACAACTTTCTAAACTTGAAGTCTGAATTTGAAATGACGAATCTT

FIGURE 318 cont'd

```
TAAACCAAAAGATACATATACCATTGACAGAGACACCTATCTATACAAACCTAGCCCACGGGAGGCTACA
TCTGTAGCAATAAGGATGGGTGCCTTTCCAGAACGGAACTCATTAAGTACCCAATCTCTTTCTGGTTGAC
TCTTGTCTCCATGGATACACATAGCTGGCCAACCATCTCTGCGCATCCTTCGAGTCAGATCATCACAGCG
TCTCTTTGTCTCCACAAATATTATTGTTTTGTTTTCCTTTTCAGCCATTATTTCTTCCATTAGTTGGATC
AACTTGTGGTCTTTTTCACTTTCCATGCAGACATCCACTATCTGGAGGATGTTGTGGTTGGCACTCAACT
CCAGATTGCCTACGTTGATCTGGGTGTAATCACGAAGGAAATCCTCTGCAAGCTGTCTTACTTCTTTTGG
CCAGGTTGCACTCCACATCAGTGTCTGCCTATCAGGCCTGATTTGGTCAACAATTTTACGGATCTGGGGT
TCAAACCCCATATCAAGCATTCTGTCAGCTTCNTCCAATACAAGGTA
```

FIGURE 319
SEQ ID NO: 311
Genbank ID        : AW242836
Unigene ID(#167)  : Hs.355663
Unigene name      :       hypothetical protein BC016153 LOC120224
>gi|6576513|gb|AW242836.1|AW242836 xn26f02.x1 NCI_CGAP_Kid11 Homo sapiens cDNA
clone IMAGE:2694843 3', mRNA sequence
```
TTTTTAGGGTATCAAGATTTTACATTACTAATTCTGAATTCGTTATCCTTTGCTTTCAGCCATATTAAAA
CTGAAAGCCTTCCATACCTGATGTTTTTCTATCTCATTATACAGCTTTCCTGTCAGATCTTCTTTTAGGG
TGACTTTGAAGAATCAGAACATCAGGGCTCCAACTCTCAGTAGAGCCAGTAACCAGCTTCCTGATTTAAA
AAAAATCACCTTTGGCCTAATTTTGTCACTTATAAACAGTGGTATTGCAGTACCCTGGTATGATTAGTTA
TGATATGTTTAACAATAATTTTAAAATACCAAAGCTTGTGAATTATTTTACTTTCAAAAAATTATGTAGG
TAGGAATGGTAATTCTAAAGGCACTGTCGTTTGCTTACACATTCTAACATATTTCTAATAAGAAAGTACC
TGCTTTCTTAAGAGAAAAAGGGATAAGTTACCAAAAGCAGCACGTTCTCCTGGGCTCATACCCCGGATTC
ATCCATGAGGCCACTTCCATTGTAAAGCTTTTAGCATCTCTTGATTTCTCTTCACACTGAGGCACAAAG
```

FIGURE 320
SEQ ID NO: 312
Genbank ID        : R72286
Unigene ID(#167)  : Hs.296049
Unigene name      :       microfibrillar-associated protein 4 MFAP4
>gi|846318|gb|R72286.1|R72286 yj89b06.s1 Soares breast 2NbHBst Homo sapiens cDN
A clone IMAGE:155891 3', mRNA sequence
```
CAGGTTCTGAAGNCNTTATTGAGACCTTCAGTCCCTACCCACTCCCAGCCCTGCAGAGATTGTCCTCTGC
TCCCTCATGTGGCTAAACCTCTCAACACCCAGAGGTANTGGGGAAGACCTCATATGCATGCCTACCTTGG
CTGTGGCTGTTTCAGGGTGGTGTGCGGTANTGTGTTCTTGGCATAGAGCTTCAGGGGCTGGGATGGGCCA
TCAGGGGAAGCTGAGTATGATAGTGAGGTGGGCTGGGGTTCCACGGTACTCACCACAGGGGAGTAAGTTG
GTGGGAGGGATGCTGAAGATGGGACATGGTTTGAGAGCAGCCCAGAGGAGTGCTGGGCTGTGGCCTAGGA
ATACACCATGGGCCCTNTTCACACTGCACTGCTCAGCTTAGCACACTAGGGTGGCCCAGACAGGGGTCCA
CAGTGAGGAAGCAGGACAAGATGGACCACAAAGGCCTGCAGCTGGGAGT
```

FIGURE 321
SEQ ID NO: 313
Genbank ID        : R49343
Unigene ID(#167)  : Hs.430576
Unigene name      :       SEC14-like 2 (S. cerevisiae) SEC14L2
>gi|820298|gb|R49343.1|R49343 yg67d03.s1 Soares infant brain 1NIB Homo sapiens
cDNA clone IMAGE:38427 3', mRNA sequence
```
TTTTTTTTTTTTTTTTTGCACGGNTTATTTCCTTTAATCTTTGCAACAACCCAAAGTGTAATAGTAAG
CACAGGGTTTTTGCGTGATACCCGGTAGCCTTATTAAGAATTAGCTCTTATTTTCATCAAAGGTAGAGAA
AATGAGTAACTATTGAGGCCCCCGCTGGCTCCCTACGGAGGCCCCCGNTTTCAGCCCTAGGNGCCTCTGT
CTTGTAGGGCTNTATAGGACAGTCCGGTCAGCAGTTACCTCAAGCTGAGCTGGGCTTGTAGGTTGGGGAG
GGTGGTGGGTGGGAGAAAAGTTGATGGGGAACGCAGCGGTTCCCACCCCCTGAAACACCGGCAATGCTGG
CCGTGGGAATTNTTAGACAGTCCCTAAAACCACGTGATCGNTGCCTCCTCCGCCTCCCTNTCATTTTGGGC
CCAGTGTTAGCTCCGCAGGCGTTCGCCCGG
```

FIGURE 322
SEQ ID NO: 314
Genbank ID         : Y13710
Unigene ID(#167)   : Hs.16530
Unigene name       :    chemokine   (C-C  motif)   ligand  18   (pulmonary  and
activation-regulated)   CCL18
>gi|2326515|emb|Y13710.1|HSAMAC1    Homo    sapiens    mRNA    for    alternative
activated ma
crophage specific CC chemokine 1
CCGGCACGAGAGGAGTTGTGAGTTTCCAAGCCCCAGCTCACTCTGACCACTTCTCTGCCTGCCCAGCATC
ATGAAGGGCCTTGCAGCTGCCCTCCTTGTCCTCGTCTGCACCATGGCCCTCTGCTCCTGTGCACAAGTTG
GTACCAACAAAGAGCTCTGCTGCCTCGTCTATACCTCCTGGCAGATTCCACAAAAGTTCATAGTTGACTA
TTCTGAAACCAGCCCCCAGTGCCCCAAGCCAGGTGTCATCCTCCTAACCAAGAGAGGCCGGCAGATCTGT
GCTGACCCCAATAAGAAGTGGGTCCAGAAATACATCAGCGACCTGAAGCTGAATGCCTGAGGGGCCTGGA
AGCTGCGAGGGCCCAGTGAACTTGGTGGGCCCAGGAGGGAACAGGAGCCTGAGCCAGGGCAATGGCCCTG
CCACCCTGGAGGCCACCTCTTCTAAGAGTCCCATCTGCTATGCCCAGCCACATTAACTAACTTTAATCTT
AGTTTATGCATCATATTTCATTTGAAATTGATTTCTATTGTTGAGCTGCATTATGAAATTAGTATTTTC
TCTGACATCTCATGACATTGTCTTTATCATCCTTTCCCCTTTCCCTTCAACTCTTCGTACATTCAATGCA
TGGATCAATCAGTGTGATTAGCTTTCTCAGCAGACATTGTGCCATATGTATCAAATGACAAATCTTTATT
GAATGGTTTTGCTCAGCACCACCTTTTAATATATTGGCAGTACTTATTATATAAAAGGTAAACCAGCATT
CTCACTGTGAAAAAAAAAAAAAAAAAAAAAAAAAA

FIGURE 323
SEQ ID NO: 315
Genbank ID         : AI278445
Unigene ID(#167)   : Hs.43334
Unigene name       :     Transcribed   sequence   with   weak    similarity   to
protein   sp:P39189   (H.sapiens)   ALU2_HUMAN   Alu    subfamily   SB   sequence
contamination warning entry
>gi|3900713|gb|AI278445.1|AI278445                                   qm53d05.x1
Soares_placenta_8to9weeks_2NbHP8t
o9W Homo sapiens cDNA clone IMAGE:1892457 3' similar to contains element
MER6 r
epetitive element ;, mRNA sequence
TTTTTTTTTTTTCTGTTTCAATAAAACTTTATTCACAAAAACAGGTGGCAGGGTAGATTTGGTCTCTGTAC
TGTAGTTCACTGACCCCTGATCTAAAAGATTACATACTTTGAAAACAGCAATGCCAAACCTTGAATCCAG
GTCCGATATTTTCCAGCAATCGTGATGCTTCTCTGATCAACTGAATGAAACAGTTATAAATGTACTGGCT
AAATTTAGCTTTATGCACTTGTTTTGTCCCCTATTACAGTATAAACTTTTGGTGAATAGGGATTTTCAAA
TTAATTAAAGCACTTATTTTTATACCCAATACACACAAATACAGAACTTTACTATAGCAGATTTTTGACC
CCAATTTAGTGTGCTATCTGAATAAAAGGCTTAGTAACTAAAAAAAGTGCTGNCTTAGATTTCTGAACTA
TTTTTTTTTTTTTTTTGGA

FIGURE 324
SEQ ID NO: 316
Genbank ID         : BG231773
Unigene ID(#167)   : Hs.371680
Unigene name       :      CDNA FLJ46579 fis, clone THYMU3042758
>gi|12726899|gb|BG231773.1|BG231773 naf30b12.x1 Soares_NPBMC Homo sapiens
cDNA
clone IMAGE:4142542 3', mRNA sequence
AAACATACCAGGATTTTTTTATTTTTCAGTGTAAAAATCAAACATGATAAACCTAGAAAACTATCAGCAG
GGCTATTTCTTACAGGGTTCCAGCAAGGGTTAGCATTGTTACATTTCAGAAGCTGACTTTCTTTAAACCA
TCTTTACAGAGGAGTAAACTTCACAGTTCCACACATGGCTGGGCTCCAGGTAGAACTCCATAAGAGTGAC
GAGGGAAAGTCACCACTGGGCAGGGAGGGCATTTCTGAGAAATGCAGATGAGAGGAGAGGCTGTGAGCAC
AGGCTGTGTCAAAACCCAGGGCAAGGGCTCCCTCCCGCCTTCCCTCCCAGTGGGAAGGCCACCCTGAGCC
CCAAACCACATTCTGTTCCTTCCTCGTCATTCTGCAGACAATGGTCATCCACAGACCACACGTGTGGTGG

FIGURE 324 cont'd

```
CTTTGGCAACCAGAAATTTAAAATAAGCTATGGTTTTTCCAGTAGCCAAAATGATCCTGCACCAAAGCTC
ATAGACTGAGAACCTGAGCATGCAAAACCACAGTCTGGGTGAAGGGATGTCTGCTT
```

FIGURE 325
SEQ ID NO: 318
Genbank ID        : AW058580
Unigene ID(#167)  : Hs.151444
Unigene name      :     Transcribed sequences
>gi|5934219|gb|AW058580.1|AW058580 wx23f10.x1 NCI_CGAP_Kid11 Homo sapiens cDNA
clone IMAGE:2544523 3', mRNA sequence
```
TTTGGTTTAAATGTCTTTTATTTGCACCAGTTTATAGAGGGGAGGCAGATTAGGTACTATGTCTTTCAAT
GGCATGTATATAACATCTAGTCAAATACAGGTGCTCCATCATTACATCACTTAAGTTTGAAGTTTTTTGT
TTTCTAATTGGCAGATTACTTTTTGCTTTTGAATATTTGAAACAGAAATGCTATAAATTGATCACTGATC
CAACTTGGGCCTATAAGAGATCACTATNGTTGTCATTAGTACAATTTACTTTAAAACAGGAGCAAAAAAC
GTGTCTGTCACTCCCTGTTTTTGCAAAATCTCTCCCCTTAGTTTTATGGTAGTTTAGTGACATTCTGCTG
TATTTCACTATTGTGAGATGACGTGGAGCCAAATGAAGGGCCACTTTGATCCATTCTTTGATTTCAACCC
CAAACTTTCTGCAAATATGTTTTATTTCCTAGCCAAAGTTATTTTAGATGCCACATGGCACTATATAAAG
AATTNTAATGTTCTAGAGTCTTATGTACTGGATAGTAAAGA
```

FIGURE 326
SEQ ID NO: 318
Genbank ID        : BE552393
Unigene ID(#167)  : Hs.100469
Unigene name      :     myeloid/lymphoid     or     mixed-lineage     leukemia
(trithorax homolog, Drosophila); translocated to, 4    MLLT4
>gi|9794085|gb|BE552393.1|BE552393 hy07b03.x1 NCI_CGAP_GC6 Homo sapiens cDNA cl
one IMAGE:3196589 3', mRNA sequence
```
ACAATTACAAGACAACTTTATTCTACCCAACAAATGAATGGCACATTTTTCTATAACAAAGCAAACCCAT
GAGTTTTGGACATTCTGATATAAAAATAGGTTATTCGCCTTTTTACAGTGACCACTTAATTATAGAAGCA
GTTACTAACACAAGTGTATTTCAAATAATCATGAGTTATGAAAACACATTGGAAAAATTAAATAACCCAA
GAGTTTCTCAGCACAGGAAAAACATGGCCTGGTCCTCTCTGCATGTGCACTGTGCTGCCGTGACAACCCA
GCTGCCCCGCCGAGGCTCCGGCGTGGCCAGGACTGGGCCAGCTATAGCAATGGGCACTGTGCACGGCC
TGGGACAGCCAAGCTGGCACTGACCTGGAAAAGCACAGCCCTCCAAGCAGCCAGGGAGCGCTTTCATGGA
ACAGCAAAGCAACAGCAAAAACCACCAACACTTAGACATCAAGCGGCTCAGCATTTTGTAAATCTGATTT
CCTTAGAAAGATCATCAATGTTGACTTACCATTACACAAGTGAAAGACTCACAGGGGAACCTAATCCTGA
AAGCTCAAACTCTT
```

FIGURE 327
SEQ ID NO: 319
Genbank ID        : NM_014716.1
Unigene ID(#167)  : Hs.337242
Unigene name      :     centaurin, beta 1 CENTB1
>gi|7661879|ref|NM_014716.1| Homo sapiens centaurin, beta 1 (CENTB1), mRNA
```
GGGGTGAGAGCTCCTCCTAGGACACCCCTTTCCCCTTGGGGAAAGAATTGTGCCCCCAGGCCCTTCCCCG
CGGAGGTCCCTCTCCTCCTTCCCCCTCATCTCCCCTTCCTGGGACAGAAAGTGCCTCCACCTGCATCCCC
AGGGGCCCGGCCTCCAGGGCCCGCTGGCCCCACAGCAGGCAAGCTGAGATGACGGTCAAGCTGGATTTCG
AGGAGTGTCTCAAGGACTCACCCCGTTTCCGAGCCTCTATTGAGCTGGTGGAAGCCGAAGTGTCAGAATT
GGAGACCCGTCTGGAAAAGCTCCTGAAACTGGGCACTGGTCTCCTGGAAAGTGGGCGCCATTACCTTGCT
GCCAGCCGCGCCTTCGTTGTCGGCATTTGTGACCTGGCCCGCCTGGGTCCACCAGAGCCCATGATGGCGG
AGTGTCTGGAAAAATTCACCGTGAGCCTGAACCACAAGCTGGACAGCCATGCGGAGCTTCTAGATGCCAC
CCAACACACACTGCAGCAGCAGATCCAGACCCTGGTCAAGGAAGGTCTGCGGGGTTTCCGAGAGGCTCGC
CGGGATTTCTGGCGGGGGCTGAGAGCCTGGAGGCTGCCCTGACCCACAACGCAGAGGTTCCCAGGCGCC
GGGCCCAGGAGGCAGAAGAGGCAGGAGCTGCTTTGAGGACGGCTCGAGCTGGGTACCGGGGACGGGCACT
GGATTATGCCCTGCAGATCAACGTGATTGAGGACAAGAGGAAGTTTGACATCATGGAGTTTGTGCTGCGT
TTGGTGGAGGCCCAGGCTACCCATTTCCAGCAGGGCCATGAGGAGCTGAGCCGGCTGTCCCAGTATCGAA
```

FIGURE 327 cont'd

```
AGGAGCTGGGCGCCCAGTTGCACCAGCTGGTCTTGAATTCAGCACGAGAGAAGAGGGACATGGAGCAGAG
ACACGTGCTGCTGAAACAGAAGGAGCTGGGTGGGGAGGAGCCAGAACCAAGCTTAAGAGAGGGGCCTGGT
GGCCTGGTGATGGAAGGACATCTCTTCAAACGGGCCAGCAACGCATTTAAGACCTGGAGCAGACGCTGGT
TCACCATTCAGAGCAACCAACTGGTTTACCAGAAGAAGTACAAGGACCCTGTGACTGTGGTGGTGGATGA
CCTTCGTCTCTGCACAGTGAAACTCTGCCCTGACTCAGAAAGGCGGTTCTGCTTTGAGGTGGTGTCCACC
AGCAAGTCCTGCCTCCTCCAGGCTGACTCAGAGCGCCTCCTGCAGCTGTGGGTCAGTGCTGTGCAGAGCA
GCATTGCTTCTGCCTTCAGTCAGGCTCGCCTTGATGACAGCCCCGGGGTCCAGGCCAGGGCTCAGGACA
CCTGGCCATAGGCTCTGCTGCCACCCTGGGCTCTGGTGGAATGGCCAGGGGAAGGGAGCCTGGGGGAGTC
GGGCACGTGGTGGCCCAGGTCCAGAGTGTGGATGGCAATGCCCAGTGCTGCGACTGCCGGGAGCCAGCCC
CGGAGTGGGCCAGCATCAACCTTGGTGTCACCCTCTGCATTCAGTGTTCCGGCATCCACAGGAGCCTTGG
TGTTCACTTCTCCAAAGTCCGGTCTCTGACCCTTGACTCATGGGAGCCAGAACTAGTGAAGCTCATGTGT
GAGCTGGGAAATGTCATCATCAACCAGATCTATGAGGCCCGCGTGGAGGCCATGGCAGTGAAGAAACCAG
GGCCCAGCTGCTCCCGGCAGGAGAAGGAGGCCTGGATTCACGCTAAATACGTGGAGAAGAAGTTCCTGAC
CAAGCTGCCTGAGATTCGAGGGCGAAGAGGTGGCCGGGGGCGCCCAAGGGGGCAGCCTCCTGTGCCCCCA
AAGCCTTCCATCAGGCCCCGGCCAGGGAGCTTGAGATCCAAGCCAGAGCCCCCTCTGAGGACCTGGGAA
GCCTGCACCCTGGGGCCCTACTGTTTCGAGCGTCTGGGCATCCTCCATCTCTTCCCACCATGGCTGATGC
CCTTGCCCATGGAGCTGATGTCAACTGGGTCAATGGGGCCAAGATAATGCCACACCGCTGATCCAGGCC
ACAGCTGCTAATTCTCTTCTGGCCTGTGAGTTTCTCCTCCAGAACGGGGCGAACGTGAACCAAGCGGACA
GTGCGGGCCGGGGCCCGCTGCACCACGCAACCATTCTTGGCCACACGGGGCTCGCCTGCCTGTTCCTGAA
ACGGGGAGCTGATCTGGGGCTCGAGACTCTGAAGGCAGGGACCCTCTGACCATCGCCATGGAAACAGCC
AACGCTGACATCGTCACCCTGCTACGACTGGCAAAGATGAGGGAGGCTGAAGCGGCCCAGGGGCAGGCAG
GAGATGAGACGTATCTTGACATCTTCCGCGACTTCTCCCTCATGGCGTCAGACGACCCGGAGAAGCTGAG
CCGTCGCAGTCATGACCTCCACACGCTGTGACCCGAGGCCCACGGGGCCCGCGCCTGCCTCCCTTCCCCG
CCACCGGGCCCTCTGCCATTAAAGCCTCCGTGCTTCGCTCTTCC
```

FIGURE 328
SEQ ID NO: 320
Genbank ID        : AI341234
Unigene ID(#167)  : Hs.6191
Unigene name      :        coronin, actin binding protein, 1B  CORO1B
>gi|4078161|gb|AI341234.1|AI341234  qx90b09.x1  NCI_CGAP_GC6  Homo  sapiens
cDNA cl
one IMAGE:2009753 3' similar to SW:CORO_BOVIN Q92176 CORONIN-LIKE PROTEIN
P57.
;, mRNA sequence
```
TTGGCTTTTAGAAAGAGAATTTTATTTGGAATGAAAATATAGAGCCCACCCTCCCGCCTCCTCTGGGGAG
GGAGCAGAGGGCTGGGCAGTGGTCGGGGAGATGGTCCCTCAGAGGTCGAGGAGCTCGCCTGGGCGTAGAC
ATCCTCCACAGGAACAGTGAGGAAAGCTGGGCGCTGGCTTCGGCCTGGGCTGGGACGGGTGGGGGTGGG
AACTGACCCCTGCGCTGCCTCAGAGGCTCTGGGCAGCCAGCTAGCCCGGTGCGACCCGCTGGCAGAAGCT
GAGTGGGAAGGGGCGGCGGAGGAGATGAAGGTGGCGTGTGGCTGTGGCCCTACGCATCCCCGTTCTCCA
TGCGGCCCAGCTGCTCCTCCAGGCGGCAGATGCCGGTCGCCCTGCTCCTTGACCAGCGCCCTCAGGGCCC
GCAGCTCCTGCATCACCTCCTCCAGCTTCCCAGCCTCCCCGGCTCTGGCCAGGCTGCCGCTGGGGGTGGC
ATCAGCAGCAGTGGTGGTGGAGGCGGNGGCCCCTANGTGGGAGGAGCCCGGNGCCATGGCGGGGCCGCTG
TCAGACAACACGTTGCGCCGGCTGATCTTCAGGTCCGCTGCTTGCTGGGCACGTAGGCCTCCCGCAGTG
AGATGAGGGATCGGTCGGCATCCCGCCCGCTCACCCACTCCTCAGCCTCCAGGGCTGCCTCGGGCCCCGC
TGGGGGCGGGTCAGATCATTCCTGGNAGAGGTTCGACTTTCTTTGCCCAGTCATGACGATGGCTTACA
CTGGCGCCTCATGCCAGTTGTGGACCCCGGCGATCTTGCACTTGCTGACCTTCCAGCCCGCTTTGGCAT
GCTGCCCATACCCCGTTGCCGTTTCCTTGGTGGGTGAACGGTTCCAGAAATGGAGGAAGGAGGC
```

FIGURE 329
SEQ ID NO: 321
Genbank ID        : U10691
Unigene ID(#167)  : acc_U10691
Unigene name      :
>gi|533522|gb|U10691.1|HSU10691 Human MAGE-6 antigen (MAGE6) gene, complete
cds
```
AGGATCTACAGCCTCAGGACCCCCGTCCCAATCCTTACCCCTTGCCCCATCACCATCTTCATGCTTACCT
CCACCCCCATCCGATCCCCATCCAGGCAGAATCCAGTTCCACCCCTGCCCGGAACCCAGGGTAGTACCGT
```

FIGURE 329 cont'd

```
TGCCAGGATGTGACGCCACTGACTTGCGCATTGGAGGTCAGAAGACCGCGAGATTCTCGCCCTGAGCAAC
GAGCGACGGCCTGACGTCGGCGGAGGGAAGCCGGCCCAGGCTCGGTGAGGAGGCAAGGTAAGACGCTGAG
GGAGGACTGAGGCGGGCCTCACCTCAGACAGAGGGCCTCAAATAATCCAGTGCTGCCTCTGCTGCCGGGC
CTGGGCCACCCCGCAGGGGAAGACTTCCAGGCTGGGTCGCCACTACCTCACCCCGCCGACCCCGCCGCT
TTAGCCACGGGGAACTCTGGGGACAGAGCTTAATGTGGCCAGGGCAGGGCTGGTTAGAAGAGGTCAGGGC
CCACGCTGTGGCAGGAATCAAGGTCAGGACCCCGAGAGGGAACTGAGGGCAGCCTAACCACCACCCTCAC
CACCATTCCCGTCCCCAACACCCAACCCCACCCCCATCCCCCATTCCCATCCCCACCCCCACCCCTATC
CTGGCAGAATCCGGGCTTTGCCCCTGGTATCAAGTCACGGAAGCTCCGGGAATGGCGGCCAGGCACGTGA
GTCCTGAGGTTCACATCTACGGCTAAGGGAGGGAAGGGGTTCGGTATCGCGAGTATGGCCGTTGGGAGGC
AGCGAAAGGGCCCAGGCCTCCTGGAAGACAGTGGAGTCCTGAGGGGACCCAGCATGCCAGGACAGGGGGC
CCACTGTACCCCTGTCTCAAACCGAGGCACCTTTTCATTCGGCTACGGGAATCCTAGGGATGCAGACCCA
CTTCAGCAGGGGGTTGGGGCCCAGCCCTGCGAGGAGTCATGGGGAGGAAGAAGAGGGAGGACTGAGGGGA
CCTTGGAGTCCAGATCAGTGGCAACCTTGGGCTGGGGATGCTGGGCACAGTGGCCAAATGTGCTCTGTG
CTCATTGCGCCTTCAGGGTGACCAGAGAGTTGAGGGCTGTGGTCTGAAGAGTGGGACTTCAGGTCAGCAG
AGGGAGGAATCCCAGGATCTGCAGGGCCCAAGGTGTACCCCCAAGGGGCCCCTATGTGGTGGACAGATGC
AGTGGTCCTAGGATCTGCCAAGCATCCAGGTGAAGAGACTGAGGGAGGATTGAGGGTACCCCTGGGACAG
AATGCGGACTGGGGGCCCCATAAAAATCTGCCCTGCTCCTGCTGTTACCTCAGAGAGCCTGGGCAGGGCT
GTCAGCTGAGGTCCCTCCATTATCCTAGGATCACTGATGTCAGGGAAGGGGAAGCCTTGGTCTGAGGGGG
CTGCACTCAGGGCAGTAGAGGGAGGCTCTCAGACCCTACTAGGAGTGGAGGTGAGGACCAAGCAGTCTCC
TCACCCAGGGTACATGGACTTCAATAAATTTGGACATCTCTCGTTGTCCTTTCCGGGAGGACCTGGGAAT
GTATGGCCAGATGTGGGTCCCCTCATGTTTTTCTGTACCATATCAGGTATGTGAGTTCTTGACATGAGAG
ATTCTCAGGCCAGCAGAAGGGAGGGATTAGGCCCTATAAGGAGAAAGGTGAGGGCCCTGAGTGAGCACAG
AGGGGATCCTCCACCCCAGTAGAGTGGGGACCTCACAGAGTCTGGCCAACCCTCCTGACAGTTCTGGGAA
TCCGTGGCTGCGTTTGCTGTCTGCACATTGGGGGCCCGTGGATTCCTCTCCCAGGAATCAGGAGCTCCAG
GAACAAGGCAGTGAGGACTTGGTCTGAGGCAGTGTCCTCAGGTCACAGAGTAGAGGGGGCTCAGATAGTG
CCAACGGTGAAGGTTTGCCTTGGATTCAAACCAAGGGCCCCACCTGCCCCAGAACACATGGACTCCAGAG
CGCCTGGCCTCACCCTCAATACTTTCAGTCCTGCAGCCTCAGCATGCGCTGGCCGGATGTACCCTGAGGT
GCCCTCTCACTTCCTCCTTCAGGTTCTGAGGGGACAGGCTGACCTGGAGGACCAGAGGCCCCCGGAGGAG
CACTGAAGGAGAAGATCTGTAAGTAAGCCTTTGTTAGAGCCTCCAAGGTTCCATTCAGTACTCAGCTGAG
GTCTCTCACATGCTCCCTCTCTCCCCAGGCCAGTGGGTCTCCATTGCCCAGCTCCTGCCCACACTCCCGC
CTGTTGCCCTGACCAGAGTCATCATGCCTCTTGAGCAGAGGAGTCAGCACTGCAAGCCTGAAGAAGGCCT
TGAGGCCCGAGGAGAGGCCCTGGGCCTGGTGGGTGCGCAGGCTCCTGCTACTGAGGAGCAGGAGGCTGCC
TCCTCCTCTTCTACTCTAGTTGAAGTCACCCTGGGGGAGGTGCCTGCTGCCGAGTCACCAGATCCTCCCC
AGAGTCCTCAGGGAGCCTCCAGCCTCCCCACTACCATGAACTACCCTCTCTGGAGCCAATCCTATGAGGA
CTCCAGCAACCAAGAAGAGGAGGGGCCAAGCACCTTCCCTGACCTGGAGTCTGAGTTCCAAGCAGCACTC
AGTAGGAAGGTGGCCAAGTTGGTTCATTTTCTGCTCCTCAAGTATCGAGCCAGGGAGCCGGTCACAAAGG
CAGAAATGCTGGGGAGTGTCGTCGGAAATTGGCAGTACTTCTTTCCTGTGATCTTCAGCAAAGCTTCCGA
TTCCTTGCAGCTGGTCTTTGGCATCGAGCTGATGGAAGTGGACCCCATCGGCCACGTGTACATCTTTGCC
ACCTGCCTGGGCCTCTCCTACGATGGCCTGCTGGGTGACAATCAGATCATGCCCAAGACAGGCTTCCTGA
TAATCATCCTGGCCATAATCGCAAAAGAGGGCGACTGTGCCCCTGAGGAGAAAATCTGGGAGGAGCTGAG
TGTGTTAGAGGTGTTTGAGGGGAGGAAGACAGTATCTTCGGGGATCCCAAGAAGCTGCTCACCCAATAT
TTCGTGCAGGAAAACTACCTGGAGTACCGGCAGGTCCCCGGCAGTGATCCTGCATGCTATGAGTTCCTGT
GGGGTCCAAGGGCCCTCATTGAAACCAGCTATGTGAAAGTCCTGCACCATATGGTAAAGATCAGTGGAGG
ACCTCGCATTTCCTACCCACTCCTGCATGAGTGGGCTTTGAGAGAGGGGAAGAGTGAGTCTGAGCACGA
GTTGCAGCCAGGGCCAGTGGGAGGGGTTTGGGCCAGTGCACCTTCCGGGCCCCATCCCTTAGTTTCCA
CTGCCTCCTGTGACGTGAGGCCCATTCTTCACTCTTTGAAGCGAGCAGTCAGCATTCTTAGTAGTGGGTT
TCTGTTCTGTTGGATGACTTTGAGATTATTCTTTGTTTCCTGTTGGAGTTGTTCAAATGTTCCTTTTAAC
GGATGGTTGAATGAGCGTCAGCATCCAGGTTTATGAATGACAGTAGTCACACATAGTGCTGTTTATATAG
TTTAGGAGTAAGAGTCTTGTTTTTTATTCAGATTGGGAAATCCATTCCATTTTGTGAATTGTGACATAAT
AATAGCAGTGGAAAAAGTATTTGCTTAAAATTGTGAGCGAATTAGCAATAACATACATGAGATAACTCAA
GAAATCAAAGATAGTTGATTCTTGCCTTGTACCTCAATCTATTCTGTAAAATTAAACAAATATGCAAAC
CAGGATTTCCTTGACTTCTTTGAGAATGCAAGCGAAATTAAATCTGAATAAATAATTCTTCCTCTTCACT
GGCTCGTTTCTTTTCCGTTCACTCAGCATCTGCTCTGTGGGAGGCCCTGGGTTAGTAGTGGGGATGCTAA
GGTAAGCCAGACTCACGCCTA
```

FIGURE 330
SEQ ID NO: 322
Genbank ID          : H05668
Unigene ID(#167)    : Hs.7407
Unigene name        :      epsin 2       EPN2

FIGURE 330 cont'd

>gi|869220|gb|H05668.1|H05668 y175e11.s1 Soares infant brain 1NIB Homo sapiens
cDNA clone IMAGE:43677 3', mRNA sequence
TTTTTTTTGTCATCCAAACATCTCTTCCTTTTAAAATTTTCTTAGAGTTAAAACCATAAATAAGAGGATT
TAAACCACTAAAATGACANGTGCCAACATCTTCATTCAGCCAGACCTGGNAAATTCTATCAAAACTAGAC
AGTTAAATAAGAACCACGTTATAAAAATATTAGCCAAAAAAAGACTATTAGGATAATTCTGCAAACTCAA
ATATGAAACTGTACTAAACAAAATATGTGCAAAGGTACACAAGCATAGAGCCACGTTGGGGGTTATGCTC
AGATTAGTTTTAAAGGCTCGCTCTAGTGGGATTTAATTCAAGAGTTGTCCACGGTNGGTGGTGTTTACTT
TGAACTCACACAAGTTCAAAGAATNATAAAATATGGCACAACCACTTNCCCAAAAGGTGTTCTTTTGGGA
GNCGGTGGNTCCTTCGTGTTCCACACCNGGGTTAANCGGGGGTTTTCCNAGGGTTNGGGAGNTCGGGGAG
GGCAAAGGGNAGGGNCATTTTTCCCAAGTTCCGGGGCCCGGGAAACTNCCCGG

FIGURE 331
SEQ ID NO: 323
Genbank ID          : AW027968
Unigene ID(#167)    : Hs.454465
Unigene name        :       Similar to cDNA sequence BC021608 (LOC143941), mRNA >gi|5886724|gb|AW027968.1|AW027968 wv25f02.x1 NCI_CGAP_Kid11 Homo sapiens
cDNA
clone IMAGE:2530587 3' similar to contains TAR1.t1 TAR1 TAR1 repetitive element
;, mRNA sequence
CCCCCGGCTGGTCCCCAGCCCGCGCCGAGTACCCCGAGTGCCCTTCTCTCCGGGCGCGGGCAGGACGCA
GGAGCAGGCGGAGTCGGTGAGGCCCGACGGCTTTATTGGTTCAGGGCCCAGTCCCGTCCCCTCGCCCGCG
GACGCCCGGGTCCGCGGCGCTCAGCGGCTGTCACGGGGCGGCGCAGCTGCCCCATCATGTCGGCCAGCA
TGCGGTTGCACAGCGCGGCGTAGGGGTTGAGCAGCACCAGCTGGCGCCGCGCGAAGGGGCTGCCCAGCCG
TGCCGCCCTCTCGAAGTCCCTGCGGGCGTCGTCGTCTCGGCCCTGCAGCCGCGCCAGGAGTCCGCGCTGC
ACAAAGCTCTGGCGGGCGGCGCGGCCCCGGCCGCCGCTCAGCTCCACCGCGCGTTCCAGATCCTCCAGGG
CGCCGTGGTTCTTGCGGCTCCCGGGCGTGGCCATTTACAACCCGCCTCGCACCTGCTAGAGGTACGGATC
GTTATTCCCATTACACAGATGAAGACTGTGGAAGAGT

FIGURE 332
SEQ ID NO: 324
Genbank ID          : NM_004749.1
Unigene ID(#167)    : Hs.231411
Unigene name        :       cell cycle progression 2 protein    CPR2
>gi|4758045|ref|NM_004749.1| Homo sapiens cell cycle progression 2 protein (CPR 2), mRNA
GAATTCGGTCCGCTGGCGCATGCGGAAGCTCAAGTACAAGCACCTGGCCTTCCTGGCAGAGTCCTGTGCC
ACCCTCTCACAGGAGCAGCACTCGCAGGAGCTGCTGGCTGAGCTGCTCACACACTGGAAAGGCGTTGGAC
AGAAATTGAAGATTCCCACACATTAGTGACCGTCATGATGAAGGTGGGACACCTCTCGGAGCCACTAATG
AACCGCCTGGAAGACAAGTGCCTGGAGTTGGTGGAGCACTTTGGCCCCAATGAGCTGCGGAAGGTGCTGG
TGATGCTGGCAGCTCAGAGCCGGCGGTCCGTGCCCTTGCTGCGGGCCATCTCCTACCACTGGTGCAGAA
GCCCTTCTCTCTGACGAAAGATGTGCTCTTGGACGTGGCCTATGCCAAGCTCAGCTTTCACCAG
ACCCAGGTGTCCCAGCGCCTGGCCACCGACCTGCTATCCCTCATGCCCAGCCTGACTTCTGGTGAGGTGG
CCCACTGTGCCAAGTCCTTCGCCTTACTCAAGTGGCTCAGCCTGCCCCTGTTTGAGGCCTTTGCCCAGCA
CGTCCTGAACAGAGCGCAGGACATCACCCTGCCCCACCTGTGCAGCGTACTTCTGGCTTTTGCGCGTCTG
AACTTCCATCCAGACCAAGAGGATCAGTTCTTCAGCCTGGTACATGAGAAGCTGGGGTCAGAGCTGCCAG
GCCTGGAGCCAGCCCTGCAGGTGGACCTGGTGTGGGCCCTGTGTGTGCTGCAGCAGGCACGGGAAGCAGA
GCTGCAAGCCGTCCTCCACCCTGAATTTCACATCCAATTTCTAGGGGGCAAGTCTCAGAAGGATCAGAAC
ACCTTCCAGAAGCTGCTCCACATCAACGCCACTGCCCTGCTGGAGTACCCCGAGTACTCGGGTCCCCTTC
TGCCTGCCTCGGCTGTGCCCCTGGGCCCTCAGCCCTTGACAGGAAGGGAGACCCCCCTGCAAAAGGAGCTG
CAAGACGCTGAAGGGGCTGCTGGGGAGCGCCGACAAGGGCAGCCTCGAGGTGGCCACGCAGTATGGCTGG

FIGURE 332 cont'd

```
GTGCTGGATTCTGAGGTGCTGCTGGACAGTGACGGCGAGTTTCTGCCCGTAAGGGACTTTGTGGCACCTC
ACCTTGCCCAGCCAACTGGGAGCCAGTCACCACCTCCAGGGTCTAAGAGGCTAGCGTTCTTGCGGTGGGA
GTTCCCCAACTTCAACAGCCGAAGAAGGACTTGCTGGGTCGCTTTGTTCTGGCCCGGCGACACATAGTGG
CTGCAGGCTTCCTGATAGTGGACGTCCCATTCTATGAGTGGCTGGAACTCAAGTCTGAATGGCAGAAAGG
CGCCTACCTCAAGGACAAGATGCGCAAAGCGGTGGCTGAGGAGCTGGCCAAGTGACTTGTGCCAGCAGCA
TGGACTGCGTGCCTCTCCGCCGGAGGTCTAGCTGTGGGCGGCCAAGAAGGGTCACCCTTGAGGACAAACC
TCTGTGCAGGACCTTGGCCACTCTGAGGGACAGAACGTCCTCTTGTGTATAATAAACCTTTAATTTTGGT
GTTGGACCCCTGGGGCCTTCCCAGGCTTGGTCACCCTCTGCACTGTCAAAAAAAAAAAAAAAA
```

FIGURE 333
SEQ ID NO: 325
Genbank ID      : NM_003534.1
Unigene ID(#167) : Hs.247813
Unigene name    :      histone 1, H3g    HIST1H3G
>gi|4504290|ref|NM_003534.1|  Homo  sapiens  H3  histone  family,  member  H
(H3FH), m
RNA
```
ATGGCCCGCACCAAGCAGACTGCACGCAAGTCCACCGGTGGCAAAGCGCCGCGCAAGCAGCTGGCCACTA
AGGCGGCTCGGAAAAGCGCGCCGGCCACCGGCGGCGTGAAGAAACCTCATCGCTACCGTCCCGGCACCGT
GGCTCTGCGCGAGATTCGCCGCTATCAGAAGTCGACTGAGCTGCTGATCCGCAAGTTGCCTTTCCAACGC
CTGGTGCGAGAAATCGCTCAGGACTTCAAGACAGATCTGCGCTTTCAGAGTTCCGCGGTGATGGCCCTGC
AGGAGGCCTGCGAGGCCTACTTGGTGGGGCTCTTTGAGGATACCAACCTGTGTGCCATCCATGCTAAGCG
AGTGACTATCATGCCCAAGGACATTCAGCTCGCTCGCCGCATTCGTGGGGAGAGAGCGTAG
```

FIGURE 334
SEQ ID NO: 326
Genbank ID      : NM_000587.1
Unigene ID(#167) : Hs.78065
Unigene name    :      complement component 7   C7
>gi|4557386|ref|NM_000587.1|  Homo  sapiens  complement  component  7  (C7),  mRNA
```
ATGAAGGTGATAAGCTTATTCATTTTGGTGGGATTTATAGGAGAGTTCCAAAGTTTTTCAAGTGCCTCCT
CTCCAGTCAACTGCCAGTGGGACTTCTATGCCCCTTGGTCAGAATGCAATGGCTGTACCAAGACTCAGAC
TCGCAGGCGGTCAGTTGCTGTGTATGGGCAGTATGGAGGCCAGCCTTGTGTTGGAAATGCTTTTGAAACA
CAGTCCTGTGAACCTACAAGAGGATGTCCAACAGAGGAGGGATGTGGAGAGCGTTTCAGGTGCTTTTCAG
GTCAGTGCATCAGCAAATCATTGGTTTGCAATGGGGATTCTGACTGTGATGAAGACAGTGCTGATGAAGA
CAGATGTGAGGACTCAGAAAGGAGACCTTCCTGTGATATCGATAAACCTCCTCCTAACATAGAACTTACT
GGAAATGGTTACAATGAACTCACTGGCCAGTTTAGGAACAGAGTCATCAATACCAAAAGTTTTGGTGGTC
AATGTAGAAAGGTGTTTAGTGGGGATGGAAAAGATTTCTACAGGCTGAGTGGAAATGTCCTGTCCTATAC
ATTCCAGGTGAAAATAAATAATGATTTTAATTATGAATTTTACAATAGTACTTGGTCTTATGTAAAACAT
ACGTCGACAGAACACACATCATCTAGTCGGAAGCGCTCCTTTTTTAGATCTTCATCATCTTCTTCACGCA
GTTATACTTCACATACCAATGAAATCCATAAAGGAAAGAGTTACCAACTGCTGGTTGTTGAGAACACTGT
TGAAGTGGCTCAGTTCATTAATAACAATCCAGAATTTTTACAACTTGCTGAGCCATTCTGGAAGGAGCTT
TCCCACCTCCCCTCTCTGTATGACTACAGTGCCTACCGAAGATTAATCGACCAGTACGGGACACATTATC
TGCAATCTGGGTCGTTAGGAGGAGAATACAGAGTTCTATTTTATGTGGACTCAGAAAAATTAAAACAAAA
TGATTTTAATTCAGTCGAAGAAAAGAAATGTAAATCCTCAGGTTGGCATTTTGTCGTTAAATTTTCAAGT
CATGGATGCAAGGAACTGGAAAACGCTTTAAAAGCTGCTTCAGGAACCCAGAACAATGTATTGCGAGGAG
AACCGTTCATCAGAGGGGGAGGTGCAGGCTTCATATCTGGCCTTAGTTACCTAGAGCTGGACAATCCTGC
TGGAAACAAAAGGCGATATTCTGCCTGGGCAGAATGTTCTGGCTAATCTTCCTCAAGTCATAAAACAAAG
CTGACACCTTTATATGAGCTGGTAAAGGAAGTACCTTGTGCCTCTGTGAAAAAACTATACCTGAAATGGG
CTCTTGAAGAGTATCTGGATGAATTTGACCCCTGTCATTGCCGGCCTTGTCAAAATCGTGGTTTGGCTAC
TGTTGAGGGGACCCATTGTCTGTGCCATTGCAAACCGTACACATTTGGTGCGGCGTGTGAGCAAGGAGTC
CTCGTAGGGAATCAAGCAGGAGGGGTTGATGGAGGTTGGAGTTGCTGGTCCTCTTGGAGCCCCTGTGTCC
AAGGGAAGAAAACAAGAAGCCGTGAATGCAATAACCCACCTCCCAGTGGGGGTGGGAGATCCTGCGTTGG
AGAAACGACAGAAAGCACACAATGCGAAGATGAGGAGCTGGAGCACTTGAGGTTGCTTGAACCACATTGC
TTTCCTTTGTCTTTGGTTCCAACAGAATTCTGTCCATCACCTCCTGCCTTGAAAGATGGATTTGTTCAAG
ATGAAGGTCCAATGTTTCCTGTGGGGAAAAATGTAGTGTACACTTGCAATGAAGGATACTCTCTTATTGG
AAACCCAGTGGCCAGATGTGGAGAAGATTTACGGTGGCTTGTTGGGGAAATGCATTGTCAGAAAATTGCC
TGTGTTCTACCTGTACTGATGGATGGCATACAGAGTCACCCCCAAAAACCTTTCTACACAGTTGGTGAGA
```

FIGURE 334 cont'd

```
AGGTGACTGTTTCCTGTTCAGGTGGCATGTCCTTAGAAGGTCCTTCAGCATTTCTCTGTGGCTCCAGCCT
TAAGTGGAGTCCTGAGATGAAGAATGCCCGCTGTGTACAAAAAGAAAATCCGTTAACACAGGCAGTGCCT
AAATGTCAGCGCTGGGAGAAACTGCAGAATTCAAGATGTGTTTGTAAAATGCCCTACGAATGTGGACCTT
CCTTGGATGTATGTGCTCAAGATGAGAGAAGCAAAAGGATACTGCCTCTGACAGTTTGCAAGATGCATGT
TCTCCACTGTCAGGGTAGAAATTACACCCTTACTGGTAGGGACAGCTGTACTCTGCCTGCCTCAGCTGAG
AAAGCTTGTGGTGCCTGCCCACTGTGGGGAAAATGTGATGCTGAGAGCAGCAAATGTGTCTGCCGAGAAG
CATCGGAGTGCGAGGAAGAAGGGTTTAGCATTTGTGTGGAAGTGAACGGCAAGGAGCAGACGATGTCTGA
GTGTGAGGCGGGCGCTCTGAGATGCAGAGGGCAGAGCATCTCTGTCACCAGCATAAGGCCTTGTGCTGCG
GAAACCCAGTAGGCTCCTGGAGGCCATGGTCAGCTTGCTTGGAATCCAGCAGGCAGCTGGGGCTGAGTGA
AAACATCTGCACAACTGGGCACTGGACAGCTTTTCCTTCTTCTCCAGTGTCTACCTTCCTCCTCAACTCC
CAGCCATCTGTATAAACACAATCCTTTGTTCTCCAAATCTGAATCGAATTACTCTTTTGCCTCCTTTTT
AATGTCAGTAAGGATATGAGCCTTTGCACAGGCTGGCTGCGTGTTCTTGAAATAGGTGTTACCTTCTCTG
GGCCTTGGTTTTTTAAAATCTGTAAAATTAGAGGATTGCACTAGAGAAACTTGAATGCTCCATTCAGGCC
TATCATTTTATTAAGTATGATTGACACAGCCCATGGGCCAGAACACACTCTACAAAATGACTAGGATAAC
AGAAAGAACGTGATCTCCTGATTAGAGAGGGTGGTTTTCCTCAATGGAACCAAATATAAAGAGGACTTGA
ACAAAAATGACAGATACAAACTATTTCTATCCTGAGTAGTAATCTCACACTTCATCCTATAGAGTCAACC
ACCACAGATAGGAATTCCTTATTCTTTTTTTAATTTTTTTAAGACAGAGTCTCACTTTGTTGCCCAGGCT
GGAGCGCAGTGGGGTGATCTCATCTCCCTGCAACCTCCGCCTCCTGGGTTGAAGCGATTCTTGTGCCTCA
GCTTCCCAAGCAGCTGGGATTACAGGTGCCCGCCACCACGCCCAGCTAATTTTTGCATTTTTAGTAGAGA
TGGGTTTCACCATGTTGGCCATGCTCGTCTCCAACTCCTGACCTCAGGTAATCCGTCTGCCTTGGCCTCC
CAAATGCTGGGATTACAGACATGAACCACCACGCCTGGCTGGAATACTTACTCTTGTCGGGAGATTGAAC
CACTAAAATGTTAGAGCAGAATTCATTATGCTGTGGTCACAGGGGTGTCTTGTCTGAGAACAAATACAAT
TCAGTCTTCTCTTTGGGGTTTTAGTATGTGTCAAACATAGGACTGGAAGTTTGCCCCTGTTCTTTTTTCT
TTTGAAAGAACATCAGTTCATGCCTGAGGCATGAGTGACTGTGCATTTGAGATAGTTTTCCCTATTCTGT
GGATACAGTCCCAGAGTTTTCAGGGAGTACACAGGTAGATTAGTTTGAAGCATTGACCTTTTATTTATTC
CTTATTTCTCTTTCATCAAAACAAAACAGCAGCTGTGGGAGGAGAAATGAGAGGGCTTAAATGAAATTTA
AAATAAGCTATATTATACAAATACTATCTCTGTATTGTTCTGACCCTGGTAAATATATTTCAAAACTTCA
GATGACAAGGATTAGAACACTCATTAAGATGCTATTCTTC
```

FIGURE 335
SEQ ID NO: 327
Genbank ID         : AF225986.1
Unigene ID(#167)   : Hs.300717
Unigene name       :       sodium    channel,   voltage-gated,   type   III,   alpha
    SCN3A
>gi|12642271|gb|AF225986.1|AF225986   Homo    sapiens   voltage-gated   sodium channel a
lpha   subunit   splice   variant   SCN3A-s   (SCN3A)   mRNA,   complete   cds, alternatively s
pliced

```
AGCGAAGCGGAGGCATAAGCAGAGAGGATTCTGGAAAGGTCTCTTTGTTTTCTTATCCACAGAGAAAGAA
AGAAAAAAATTGTAACTAATTTGTAAACCTCTGTGGTCAAAAAAAAAAAAAAAAAAAAGCTGAACAGC
TGCCAGAGGAAGACACGTTATACCCTAACCATCTTGGATGCTGGGCTTTGTTATGCTGTAATTCATAAGG
CTCTGTTTTATCAGAGATTATGGAGCAAGAAAACTGAAGCCAAGCCACATCAAGGTTTGACAGGGATGAG
ATACCTGTCAAGGATTCATAGTAGAGTGGCTTACTGGGAAAGGAGCAAAGAATCTCTTCTAGGGATATTG
TAAGAATAAATGAGATAATTCACAGAAGGGACCTGGAGCTTTTCCGGAAAAAGGTGCTGTGACTATCTAA
GGTAATTCGTATGCAAGAAGCTACACGTAATTAAATGTGCAGGATGAAAAGATGGCACAGGCACTGTTGG
TACCCCCAGGACCTGAAAGCTTCCGCCTTTTTACTAGAGAATCTCTTGCTGCTATCGAAAAACGTGCTGC
AGAAGAGAAAGCCAAGAAGCCCAAAAAGGAACAAGATAATGATGATGAGAACAAACCAAAGCCAAATAGT
GACTTGGAAGCTGGAAAGAACCTTCCATTTATTTATGACATTCCTCCAGAGATGGTGTCAGAGCCCC
TGGAGGACCTGGATCCCTACTATATCAATAAGAAAACTTTTATAGTAATGAATAAAGGAAAGGCAATTTT
CCGATTCAGTGCCACCTCTGCCTTGTATATTTTAACTCCACTAAACCCTGTTAGGAAATTGCTATCAAG
ATTTTGGTACATTCTTTATTCAGCATGCTTATCATGTGCACTATTTTGACCAACTGTGTATTTATGACCT
TGAGCAACCCTCCTGACTGGACAAAGAATGTAGAGTACACATTCACTGGAATCTATACCTTTGAGTCACT
TATAAAAATCTTGGCAAGAGGGTTTTGCTTAGAAGATTTTACGTTTCTTCGTGATCCATGGAACTGGCTG
GATTTCAGTGTCATTGTGATGGCATATGTGACAGAGTTTGTGGACCTGGGCAATGTCTCAGCGTTGAGAA
CATTCAGAGTTCTCCGAGCACTGAAAACAATTTCAGTCATTCCAGGTTTAAAGACCATTGTGGGGCCCT
GATCCAGTCGGTAAAGAAGCTTTCTGATGTGATGATCCTGACTGTGTTCTGTCTGAGCGTGTTTGCTCTC
ATTGGGCTGCAGCTGTTCATGGGCAATCTGAGGAATAAATGTTTGCAGTGGCCCCCAAGCGATTCTGCTT
TTGAAACCAACACCACTTCCTACTTTAATGGCACAATGGATTCAAATGGGACATTTGTTAATGTAACAAT
```

FIGURE 335 cont'd

```
GAGCACATTTAACTGGAAGGATTACATTGGAGATGACAGTCACTTTTATGTTTTGGATGGGCAAAAAGAC
CCTTTACTCTGTGGAAATGGCTCAGATGCAGGCCAGTGTCCAGAAGGATACATCTGTGTGAAGGCTGGTC
GAAACCCCAACTATGGCTACACAAGCTTTGACACCTTTAGCTGGGCTTTCCTGTCTCTATTTCGACTCAT
GACTCAAGACTATTGGGAAATCTTTACCAGTTGACATTACGTGCTGCTGGGAAAACATACATGATATTT
TTTGTCCTGGTCATTTTCTTGGGCTCATTTTATTTGGTGAATTTGATCCTGGCTGTGGTGGCCATGGCCT
ATGAGGAGCAGAATCAGGCCACCTTGGAAGAAGCAGAACAAAAAGAGGCCGAATTTCAGCAGATGCTCGA
ACAGCTTAAAAAGCAACAGGAAGAAGCTCAGGCAGTTGCGGCAGCATCAGCTGCTTCAAGAGATTTCAGT
GGAGTAGGTGGGTTAGGAGAGCTGTTGGAAAGTTCTTCAGAAGCATCAAAGTTGAGTTCCAAAGGTGCTA
AAGAATGGAGGAACCGGAGGAAGAAAAGAAGACAGAGAGAGCACCTTGAAGGAAACAACAAAGGAGAGAG
AGACAGCTTTCCCAAATCCGAATCTGAAGACAGCGTCAAAAGAAGCAGCTTCCTTTTCTCCATGGATGGA
AACAGACTGACCAGTGACAAAAAATTCTGCTCCCCTCATCAGTCTCTCTTGAGTATCCGTGGCTCCCTGT
TTTCCCCAAGACGCAATAGCAAAACAAGCATTTTCAGTTTCAGAGGTCGGGCAAAGGATGTTGGATCTGA
AAATGACTTTGCTGATGATGAACACAGCACATTTGAAGACAGCGAAAGCAGGAGAGACTCACTGTTTGTG
CCGCACAGACATGGAGAGCGACGCAACAGTAACGGCACCACCACTGAAACGGAAGTCAGAAAGAGAAGGT
TAAGCTCTTACCAGATTTCAATGGAGATGCTGGAGGATTCCTCTGGAAGGCAAAGAGCCGTGAGCATAGC
CAGCATTCTGACCAACACAATGGAAGAACTTGAAGAATCTAGACAGAAATGTCCGCCATGCTGGTATAGA
TTTGCCAATGTGTTCTTGATCTGGGACTGCTGTGATGCATGGTTAAAAGTAAAACATCTTGTGAATTTAA
TTGTTATGGATCCATTTGTTGATCTTGCCATCACTATTTGCATTGTCTTAAATACCCTCTTTATGGCCAT
GGAGCACTACCCATGACTGAGCAATTCAGTAGTGTGTTGACTGTAGGAAACCTGGTCTTTACTGGGATT
TTCACAGCAGAAATGGTTCTCAAGATCATTGCCATGGATCCTTATTACTATTTCCAAGAAGGCTGGAATA
TCTTTGATGGAATTATTGTCAGCCTCAGTTTAATGGAGCTTGGTCTGTCAAATGTGGAGGGATTGTCTGT
ACTGCGATCATTCAGACTGCTTAGAGTTTTCAAGTTGGCAAAATCCTGGCCCACACTAAATATGCTAATT
AAGATCATTGGCAATTCTGTGGGGGCTCTAGGAAACCTCACCTTGGTGTTGGCCATCATCGTCTTCATTT
TTGCTGTGGTCGGCATGCAGCTCTTTGGTAAGAGCTACAAAGAATGTGTCTGCAAGATCAATGATGACTG
TACGCTCCCACGGTGGCACATGAACGACTTCTTCCACTCCTTCCTGATTGTGTTCCGCGTGCTGTGTGGA
GAGTGGATAGAGACCATGTGGGACTGTATGGAGGTCGCTGGCCAAACCATGTGCCTTATTGTTTTCATGT
TGGTCATGGTCATTGGAAACCTTGTGTTCTGAACCTCTTTCTGGCCTTATTATTGAGTTCATTTAGCTC
AGACAACCTTGCTGCTACTGATGATGACAATGAAATGAATAATCTGCAGATTGCAGTAGGAAGAATGCAA
AAGGGAATTGATTATGTGAAAAATAAGATGCGGGAGTGTTTCCAAAAAGCCTTTTTTAGAAAGCCAAAAG
TTATAGAAATCCATGAAGGCAATAAGATAGACAGCTGCATGTCCAATAATACTGGAATTGAAATAAGCAA
AGAGCTTAATTATCTTAGAGATGGGAATGGAACCACCAGTGGTGTAGGTACTGGAAGCAGTGTTGAAAAA
TACGTAATCGATGAAAATGATTATATGTCATTCATAAACAACCCCAGCCTCACCGTCACAGTGCCAATTG
CTGTTGGAGAGTCTGACTTTGAAAACTTAAATACTGAAGAGTTCAGCAGTGAGTCAGAACTAGAAGAAAG
CAAAGAGAAATTAAATGCAACCAGCTCATCTGAAGGAAGCACAGTTGATGTTGTTCTACCCCGAGAAGGT
GAACAAGCTGAAACTGAACCCGAAGAAGACTTTAAACCGGAAGCTTGTTTTACTGAAGGGTGTATTAAAA
AGTTTCCATTCTGTCAAGTAAGTACAGAAGAAGGCAAAGGGAAGATCTGGTGGAATCTTCGAAAAACCTG
CTACAGTATTGTTGAGCACAACTGGTTTGAGACTTTCATTGTGTTCATGATCCTTCTCAGTAGTGGTGCA
TTGGCCTTTGAAGATATATACATTGAACAGCGAAAGACTATCAAAACCATGCTAGAATATGCTGACAAAG
TCTTTACCTATATATTCATTCTGGAAATGCTTCTCAAATGGGTTGCTTATGGATTTCAAACATATTTCAC
TAATGCCTGGTGCTGGCTAGATTTCTTGATCGTTGATGTTTCTTTGGTTAGCCTGGTAGCCAATGCTCTT
GGCTACTCAGAACTCGGTGCCATCAAATCATTACGGACATTAAGAGCTTTAAGACCTCTAAGAGCCTTAT
CCCGGTTTGAAGGCATGAGGGTGGTTGTGAATGCTCTTGTTGGAGCAATTCCCTCTATCATGAATGTGCT
GTTGGTCTGTCTCATCTTCTGGTTGATCTTTAGCATCATGGGTGTGAATTTGTTTGCTGGCAAGTTCTAC
CACTGTGTTAACATGACAACGGGTAACATGTTTGACATTAGTGATGTTAACAATTTGAGTGACTGTCAGG
CTCTTGGCAAGCAAGCTCGGTGGAAAAACGTGAAAGTAAACTTTGATAATGTTGGCGCTGGCTATCTTGC
ACTGCTTCAAGTGGCCACATTTAAAGGCTGGATGGATATTATGTATGCAGCTGTTGATTCACGAGATGTT
AAACTTCAGCCTGTATATGAAGAAATCTGTACATGTATTTATACTTTGTCATCTTTATCATCTTTGGGT
CATTCTTCACTCTGAATCTATTCATTGGTGTCATCATAGATAACTTCAACCAGCAGAAAAAGAAGTTTGG
AGGTCAAGACATCTTTATGACAGAGGAACAGAAAAAATATTACAATGCAATGAAGAAACTTGGATCCAAG
AAACCTCAGAAACCCATACCTCGCCCAGCAAACAAATTCCAAGGAATGGTCTTTGATTTTGTAACCAGAC
AAGTCTTTGATATCAGCATCATGATCCTCATCTGCCTCAACATGGTCACCATGATGGTGGAAACGGATGA
CCAGGGCAAATACATGACCCTAGTTTTGTCCCGGATCAACCTAGTGTTCATTGTTCTGTTCACTGGAGAA
TTTGTGCTGAAGCTCGTTTCCCTCAGACACTACTACTTCACTATAGGCTGGAACATCTTTGACTTTGTGG
TGGTGATTCTCTCCATTGTAGGTATGTTTCTGGCTGAGATGATAGAAAAGTATTCTGTGTCCCCTACCTT
GTTCCGAGTGATCCGTCTTGCCAGGATTGGCCGAATCCTACGTCTGATCAAAGGAGCAAAGGGGATCCGC
ACGCTGCTCTTTGCTTTGATGATGTCCCTTCCTGCGTTGTTTAACATCGGCCTCCTGCTCTTCCTGGTCA
TGTTTATCTATGCCATCTTTGGGATGTCCAACTTTGCCTATGTTAAAAAGGAAGCTGGAATTGATGACAT
GTTCAACTTTGAGACCTTTGGCAACAGCATGATCTGCTTGTTCCAAATTACAACCTCTGCTGGCTGGGAT
GGATTGCTAGCACCTATTCTTAATAGTGCACCACCCGACTGTGACCCTGACACAATTCACCCTGGCAGCT
CAGTTAAGGGAGACCGTGGGGACCCATCTGTTGGGATTTTCTTTTTTGTCAGTTACATCATCATATCCTT
CCTGGTTGTGGTGAACATGTACATCGCGGTCATCCTGGAGAACTTCAGTGTTGCTACTGAAGAAAGTGCA
```

FIGURE 335 cont'd

```
GAGCCCCTGAGTGAGGATGACTTTGAGATGTTCTATGAGGTTTGGGAAAAGTTTGATCCCGATGCGACCC
AGTTTATAGAGTTCTCTAAACTCTCTGATTTTGCAGCTGCCCTGGATCCTCCTCTTCTCATAGCAAAACC
CAACAAAGTCCAGCTTATTGCCATGGATCTGCCCATGGTCAGTGGTGACCGGATCCACTGTCTTGATATT
TTATTTGCCTTTACAAAGCGTGTTTTGTGTGAGAGTGGAGAGATGGATGCCCTTCGAATACAGATGGAAG
ACAGGTTTATGGCATCAAACCCCTCCAAAGTCTCTTATGAGCCTATTACAACCACTTTGAAACGTAAACA
AGAGGAGGTGTCTGCCGCTATCATTCAGCGTAATTTCAGATGTTATCTTTTAAAGCAAAGGTTAAAAAAT
ATATCAAGTAACTATAACAAAGAGGCAATTAAAGGGAGGATTGACTTACCTATAAAACAAGACATGATTA
TTGACAAACTAAATGGGAACTCCACTCCAGAAAAAACAGATGGGAGTTCCTCTACCACCTCTCCTCCTTC
CTATGATAGTGTAACAAAACCAGACAAGGAAAAGTTTGAGAAAGACAAACCAGAAAAAGAAAGCAAAGGA
AAAGAGGTCAGAGAAAATCAAAAGTAAAAAGAAACAAAGAATTATCTTTGTGATCAATTGTTTACAGCCT
ATGAAGGTAAAGTATATGTGTCAACTGGACTTCAAGAGGAGGTCCATGCCAAACTGACTGTTTTAACAAA
TACTCATAGTCAGTGCCTATACAAGACAGTGAAGTGACCTCTCTGTCACTGCAACTCTGTGAAGCAGGGT
ATCAACGTTGACAAGAGGTTGCTGTTTTTATTACCAGCTGACACTGCTGAGGAGAAACCCAATGGCTACC
TAGACTATAGGGATAGTTGTGCAAAGTGAACATTGTAACTACACCAAACACCTTTAGTACAGTCCTTGCA
TCCATTCTATTTTTAACTTCCATATCTGCCATATTTTTACAAAATTTGTTCTAGTGCATTTCCATGGTCC
CCAATTCATAGTTTATTCATAATGCTATGTCACTATTTTTGTAAATGAGGTTTACGTTGAAGAAACAGTA
TACAAGAACCCTGTCTCTCAAATGATCAGACAAAGGTGTTTTGCCAGAGAGATAAAATTTTTGCTCAAAA
CCAGAAAAAGAATTGTAATGGCTACAGTTTCAGTTACTTCCATTTTCTAGATGGCTTTAATTTTGAAAGT
ATTTTAGTCTGTTATGTTTGTTTCTATCTGAACAGTTATGTGCCTGTAAAGTCTCCTCTAATATTTAAAG
GATTATTTTTATGCAAAGTATTCTGTTTCAGCAAGTGCAAATTTTATTCTAAGTTTCAGAGCTCTATATT
TAATTTAGGTCAAATGCTTTCCAAAAAGTAATCTAATAAATCCATTCTAGAAAAATATATCTAAAGTATT
GCTTTAGAATAGTTGTTCCACTTTCTGCTGCAGTATTGCTTTGCCATCTTCTGCTCTCAGCAAAGCTGAT
AGTCTATGTCAATTAAATACCCTATGTTATGTAAATAGTTATTTTATCCTGTGGTGCATGTTTGGGCAAA
TATATATATAGCCTGATAAACAACTTCTATTAAATCAAATATGTACCACAGTGTATGTGTCTTTTGCAAG
CTTCCAACAGGGATGTATCCTGTATCATTCATTAAACATAGTTTAAAGGCTATCACTAATGCATGTTAAT
ATTGCCTATGCTGCTCTATTTTACTCAATCCATTCTTCACAAGTCTTGGTTAAAGAATGTCACATATTGG
TGATAGAATGAATTCAACCTGCTCTGTCCATTATGTCAAGCAGAATAATTTGAAGCTATTTACAAACACC
TTTACTTTTGCACTTTTAATTCAACATGAGTATCATATGGTATCTCTCTGGATTTCAAGGAAACACACTG
GATACTGCCTACTGACAAAACCTATTCTTCATATTTTGCTAAAAATATGTCTAAAACTTGTTTAAATATA
AATAATGTAAAAATATAATCAACTTTATTTGTCAGCATTTTGTACATAAGAAAATTATTTTCAGGTTGAT
GACATCACAATTTATTTTACTTTATGCTTTTGCTTTTGATTTTTAATCACAATTCCAAACTTTTGAATCC
ATAAGATTTTTCAATGGATAATTTCCTAAAATAAAAGTTAGATAATGGGTTTTATGGATTTCTTTGTTAT
AATATATTTTCTACCATTCCAATAGGAGATACATTGGTCAAACACTCAAACCTAGATCATTTCTACCAA
CTATGGTTGCCTCAATATAACCTTTTATTCATAGATGTTTTTTTTATTCAACTTTTGTAGTATTTACGT
ATGCAGACTAGTCTTATTTTTTAATTCCTGCTGCACTAAAGCTATTACAAATATAACATGGACTTTGTT
CTTTTTAGCCATGAACAAAGTGGCAAAGTTGTGCAATTACCTAACATGATATAAATTTTTGTTTTTTGCA
CAAACCAAAAGTTTAATGTTAATTCTTTTTACAAAACTATTTACTGTAGTGTATTGAAGAACTGCATGCA
GGGAATTGCTATTGCTAAAAAGAATGGTGAGCTACGTCATTATTGAGCCAAAAGAATAAATTTCATTTTT
TATTGCATTTCACTTATTGGGCTCTGGGGTTTTTTGTTTTTGTTTTTGCTGTTGGCAGTTTAAAATATA
TATAATTAATAAAACCTGTGCTTGATCTGACATTTGTATACATAAAAGTTTACATGAATTTTACAACAAA
CTAGTGCATGATTCACCAAGCAGTACTACAGAACAAAGGCAAATTAAAAGCAGCTTGTGAACTTTTATG
TGTGCAAAGGATCAAGTTCACATGTTCCAACTTTCAGGTTTGATAATAATAGTAGTAACCACCTACAATA
GCTTTCAATTTCAATTAACTCCCTTGGCTATAAGCATCTAAACTCATCTTCTTTCAATATAATTGATGCT
ATCTCCTAATTACTTGGTGGCTAATAAATGTTACATTCTTTGTTACTTAAATGCATTATATAAACTCCTA
TGTATACATAAGGTATTAATGATATAGTTATTGAGAATTTATATTAACTTTTTTTTCAAGAACCCTTGGA
TTTATGTGAGGTCAAAACCAAACTCTTATTCTCAGTGGAAAACTCCAGTTGTAATGCATATTTTAAAGA
CAATTTGGATCTAAATATGTATTTCATAATTCTCCCATAATAAATTATATAAGGTGGAAAAAAAAAAAA
AAAAAAAAAAAAAAAA
```

FIGURE 336
SEQ ID NO: 328
Genbank ID      : AI733041
Unigene ID(#167) : Hs.374649
Unigene name    :       hypothetical protein DKFZp547A023   DKFZp547A023
>gi|5054154|gb|AI733041.1|AI733041   oj35b04.x5   NCI_CGAP_Lu5   Homo   sapiens
cDNA cl
one IMAGE:1500271 3', mRNA sequence
```
TTTCCTTTCCCCTCCTTTATTTTTACTAATGAATTGGCCACTGATACACAAATGGTGGGTGGACAGGCTC
TCATTTCTCAACTAGTTTTATAGAAATTAAATTAAAAATTATTCCTGTGGAACAATGCTCATTGCCCACT
TCTGATTCATTAGGAAAACACATCCTATTTTGAAGCCAGTGTTTTGAAAGACAGTTGAAGTTCCATTTCA
```

FIGURE 336 cont'd

AGGACTAAGCATCAGAAGCACTCCTTATGAATTCACACACACACACATACACACACACACACAAAT
TGACAAGGCAGCACTGCTGACAGGCTATTAAGGGAAACCGGATATGCTAGTATTTGTTGAAATGATCATT
AATTTGCTTAAATGCTGAAAACTTCAGATATGTAAACATCCACACTATTTGAACATTTTTTAGACATCAA
AGGATTTTCAAGTGCTTCTCTCTGGCTTGCATTTGCTAACATTGCAGCAGCAACAGCGCTGGAGTAGTTG
AAAAGGGATGCATTAATCATTTGTAAAATGAGAGAGCAGAACAAGATTATGCTTTCTTAAGCAGAAATAC
ATGAGCCATGGATGGCTTCAGGGTCTTTGGATCCTATGAAGCCATCAAACAAA

FIGURE 337
SEQ ID NO: 329
Genbank ID        : AW135316
Unigene ID(#167)  : Hs.105448
Unigene name      :          protein kinase, lysine deficient 4   PRKWNK4
>gi|6139374|gb|AW135316.1|AW135316  UI-H-BI1-ach-h-10-0-UI.s1  NCI_CGAP_Sub3 Homo
   sapiens cDNA clone IMAGE:2714371 3', mRNA sequence
TTTTTTTTTTTTTTTGTAGTGTCTGTAGTGTTTCCACCTCTGACAAGTGCCTGAGGATGCACGGAGGGCA
TGAAAGGGCTAGCCACACACCTTGCTCTCCCAGGTTCTCCTCTCACTCCTCCATCCTCCCGAGACTCACT
TCTGCCGAAGACTCTGCAGCTCAGCCCAGAACTCCTCATCTTCCCCACTGCTTTCTGACTCCTCGCTGCT
CAAACACAGGCTGCTGTAGGAGTAGTTCATCCACACTGGGCTGGGATGGCTCAGGGGTTGGGGCTGCCC
CCAACTTGGGGTTCCTTCCCATCATCTCCTTCCTCCTCAACTCCAGCCCCCAGACCCTCAGCTGCACGGT
CGCTCTCAGCCAGAGCTTCCCTGGTCTCTGGCCCGCCTCCAGCACTGTCCTCTGTATCTGAGCTCTCTGA
AGTGAGCTGAGGGGTT

FIGURE 338
SEQ ID NO: 330
Genbank ID        : AI635931
Unigene ID(#167)  : Hs.147613
Unigene name      :          Transcribed sequences
>gi|4687261|gb|AI635931.1|AI635931  tz82d01.x1  NCI_CGAP_Pan1  Homo sapiens cDNA c
lone IMAGE:2295073 3', mRNA sequence
TTTTTTAAATTCATACTTTTATTATTAGGGGGTAGGTAGGGGTCATTTTGTTGTTTATGTACACTTCATA
TTTTTTCAACGAAAGACAAAATAAGATTAATAAAATAGAAATATATGCTCAGTGTTATAAAATTAAAAAG
TAGTTGTTCTAACACTTAAGGCTATTGCAGTTGCTGTATTTAAGGAATAAATTTGACCTTGAGTTTCCTG
ACAGCGAAGGTAAAAATGGAACATGATGTTGTGGTTAATACAGTTATATAACGAATCACCCCCAAAACTT
AGAGTAAGCTGAAAACAACCACTTCTTACGCTCATGAGCATAGCAGAGATAACTTAATCATCCTGTTCAC
AAGGTTTGGAGCTCAGCAGGAAGATTCAACAGCTGGAAGCTGGGACCATCTGAAGATTCACTCACTTGTC
TGTCTAGTGATTGATCTCAACTGTCAGCTAAAATCTTAGCTGGGACAACTTCCTAAAACACT

FIGURE 339
SEQ ID NO: 331
Genbank ID        : NM_004659.1
Unigene ID(#167)  : Hs.211819
Unigene name      :          matrix metalloproteinase 23B   MMP23B
>gi|4758729|ref|NM_004659.1|  Homo  sapiens  matrix  metalloproteinase  23A (MMP23A)
, mRNA
CATAGCAAGTCTGCCATGGGCCGCGGGCCCGTGTCCCCTCGGAGGCCCCGGGGGCAGGCGTCGAGCGCC
GCTGGCTTGGAGCCGCGCTGGTCGCCCTGTGCCTCCTCCCCGCGCTGGTGCTGCTGGCCCGGCTGGGGGC
CCCGGCGGTGCCGGCCTGGAGCGCAGCGCAGGGAGACGTCGCTGCGCTGGGCCTCTCGGCGGTGCCCCCC
ACCCGGGTCCCGGGCCCACTGGCCCCCCGCAGACGCCGCTACACACTGACTCCAGCCAGGCTGCGCTGGG
ACCACCTCAACCTCACCTACAGGATCCTCTCCTTCCCGCGGAACCTGCTGAGCCCGCGGGAGACGCGGCG
GGCCCTAGCTGCCGCCTTCCGCATGTGGAGCGACGTGTCCCCCTTCAGCTTCCGCGAGGTGGCCCCCGAG
CAGCCCAGCGACCTCCGGATAGGCTTCTACCCGATCAACCACACGGACTGCCTGGTCTCCGCGCTGCACC
ACTGCTTCGACGGCCCCACGGGGGAGCTGGCCCACGCCTTCTTCCCCCCGCACGGCGGCATCCACTTCGA
CGACAGCGAGTACTGGGTCCTGGGCCCCACGCGCTACAGCTGGAAGAAGGCGTGTGGCTCACGGACCTG

FIGURE 339 cont'd

```
GTGCACGTGGCGGCCCACGAGATCGGCCACGCGCTGGGCCTGATGCACTCACAACACGGCCGGGCGCTCA
TGCACCTGAACGCCACGCTGCGCGGCTGGAAGGCGTTGTCCCAGGACGAGCTGTGGGGGCTGCACCGGCT
CTACGGATGCCTCGACAGGCTGTTCGTGTGCGCGTCCTGGGCGCGGAGGGGCTTCTGCGACGCTCGCCGG
CGGCTCATGAAGAGGCTCTGCCCCAGCAGCTGCGACTTCTGCTACGAATTCCCCTTCCCCACGGTGGCCA
CCACCCCACCGCCCCCCAGGACCAAAACCAGGCTGGTGCCCGAGGGCAGGAACGTGACCTTCCGTTGCGG
CCAGAAGATCCTCCACAAGAAGGGAAAGTGTACTGGTACAAGGACCAGGAGCCCCTGGAGTTCTCCTAC
CCCGGCTACCTGGCCCTGGGCGAGGCGCACCTGAGCATCATCGCCAACGCCGTCAATGAGGGCACCTACA
CCTGCGTGGTGCGCCGCCAGCAGCGCGTGCTGACCACCTACTCCTGGCGAGTCCGTGTGCGGGGCTGAGC
CCGGCTGATAAAGCACTTTCTCTCTGAAAAAAAAAAAAAAA
```

FIGURE 340
SEQ ID NO: 332
Genbank ID        : AL518291
Unigene ID(#167)  : acc_AL518291
Unigene name      :
>gi|45654836|gb|AL518291.3|AL518291 AL518291 Homo sapiens NEUROBLASTOMA Homo sa
piens cDNA clone CS0DA009YD24 3-PRIME, mRNA sequence
```
ACAATTTATTTCCGAGTACCCGCCAGACCACCAGGCTGAGCCTGTGACGACCGCCTCAAGGGACCAGCCA
TTCCTGTTCCCAGTGCTGCGAGCCACACAGGCCTGGGATCCGGCCAGAGTGAGCGCAGCCCCACCCCTGGAG
CGAGCGTGTGACGGGGGCGCTGCATCTGCATCGTCCCTGCGGCCACCTGGCCTNGGAATCTGCCCCTCCA
AGACCCAGCCAGGCTGGGCCAGGGCAGGCTTCCCACACGAGGGCCCGTGGACAGGGCCCCAGCGTCCAGG
TGGCGGGAKCCAGAGGAGAACAGGGCGGGCTCCCACCAGCCTGGCCAGTTCCTGCCGACACTGTTCCTGT
GGTGGACGTAGCACCGCCTCCAGGCAGGCCTCCGGGCTCCTCAGCGTCCTGATCACCACAGCGGCCCGCA
GGTCCCGGTCCCCTGCNGCCCCANCCTCTCGTCTCANCAGCCGGTGTGGCCCAGGGGCTGGGCCGGGCC
ACCGTCTCGCTCCCAGCACTGCTGTGGAGCTCCCAGCCCCTTTTCCACAGCCTCCCGAGAGGCCCGCCGC
GCGCACTTCACTTTGGCCCCCGTCCACAGCCTCCAGCCTTGGCCTCCCAGGCCGCCCGCCTGCGCNCCGC
AGCCTCCCGCAGCTCCTCCTCCAGTGCCTGCNGCGCCCGCACTAACAGGACCAACTCGCCACCACCGCGC
TCGGGGACCCAGGGCAGGAAGGTGGGCTGTKAGGYTGCAGCAGGSACCTYCGGGGCAMAGGTGCHCAGGA
CCGTGTTCATTCACCGCCAGAAGAACAGCWCAGAGCGCCGCCACGCCAGGGCAGCYTCCAGGCGCTGGTT
CTCACGCYCCAGAGTTCGCAGCAGCCGCYGGCCTYCCTCTGGGTTCCTGAGCATCTTCGCTTCAGTTAAA
RAAAGAAGGCTAAGGCTCTGGTCGCTGTGGCAGCCGCCGTGTTTTCAGGTGGATMTTGCCCAGGAGGGCGC
MCTGCTCCCSCCGAHTGGGMAMAGCDGGGGCMAACGGAACGCAGCRTTHCAAWAACAATWCAAAAGGGGR
AAWCAAAGGMCTTTTCTTCATTTTGGGGGAGGGGGCAAGG
```

FIGURE 341
SEQ ID NO: 333
Genbank ID        : AI963605
Unigene ID(#167)  : Hs.406256
Unigene name      :       Transcribed sequences
>gi|5756383|gb|AI963605.1|AI963605 wr65d11.x1 NCI_CGAP_Ut1 Homo sapiens cDNA cl
one IMAGE:2492565 3', mRNA sequence
```
TTTTCTGTTTCAGACATTTATTTCCATTTAAATGACACTTTGAAAGATCGAGGAGCCAATCTGTACCGCA
AAGACAACTTATCATCAAAGACTCTAGAAGTACAATCGTATCAATTCACAAGACTTGATTTCTTCAACTT
AAATGATAGCTTTTAGTTAAAATATACCTGAGAGAAGAACTCCAAAGGATGCCTGCCTCATAATCTGCCC
TGGACTTGTCATTCCCGACAGGACACCTCAATGGACACTGCCCCACCCCATTAAGACTCTGAAGCGTAGG
GTCCCATTGCTTTGCTTCCGAAATCCAAGGGGAACAAGAAGTACCCATCTCTTACAAAAATAAGCATGTC
AACATTGTTCAGTACATTTTTCTACACATATAAAATCAAAATAAATTGTAAAAATATTTTTCCAGGTACA
AAATAAATATAGAAAACATCAATGTAAAAACAAAAGGATTGTCCGATTCAGACCATTACCTTGCCAATT
```

FIGURE 342
SEQ ID NO: 334
Genbank ID        : AW237462
Unigene ID(#167)  : Hs.127951
Unigene name      :       hypothetical protein FLJ14503 FLJ14503

FIGURE 342 cont'd

>gi|6569851|gb|AW237462.1|AW237462 xm72c03.x1 NCI_CGAP_Kid11 Homo sapiens cDNA
clone IMAGE:2689732 3', mRNA sequence
GACTCTTCAATGAAAATGTATTTCACATTAAACACAAGGTACATATCATGCAAATGAGGCATCACCATGG
TCACAATGGTGCTGTGAGGTACAACAAATCACAAGAAAACAGACATTTAGCAAAATAAGGTTCCAGGAAA
GATGAGAGGCATTTTCTGAAAGCCAGACCATGCTATGGTTTCTGTGTGCCTGTCATAAAGGGACTTGGCC
AGTATTTGCCGAGATGGACAGCACCGCATTATGTGGAGGCATGTACTTTATTGAGTAGAGACACATACAC
AGACATATAATTTCTGTAACTAATACATTCTTAAATGTAGCTGGCTGTAAAAGCACATGAACAAGATTAC
TACTGAGACTTCTTTGTATCTCCTGGTTGCAAACCTCTCTCAGAATTATGAATCTTTCCAAACCCTTAAT
TATACAAGTCAAAACAAAAAGTTTCAAAGAAGAAAAGGTCATTTTAATTTGAAAGCCACATTTCGCCACA
AGAAACAAAATTAAGAAAACACACCATTATATGGCATAAAATGTGTGGAGTATACATTCTAGTGTCATTT
TTCCCATTCAGATTTTTTCTTGAAGTCCATTAAAGTGA

FIGURE 343
SEQ ID NO: 335
Genbank ID        : AA496211
Unigene ID(#167)  : Hs.157208
Unigene name      :         aristaless related homeobox    ARX
>gi|2229532|gb|AA496211.1|AA496211 zx70c09.s1 Soares_total_fetus_Nb2HF8_9w Homo
  sapiens cDNA clone IMAGE:796816 3', mRNA sequence
TTTTTTTTTTTTTTAAACATATAATTTTTTTATTTTGAGCGTGACACTTCTCCACTAGATAGCAAGGAA
AAGTGGTAACAATTACACATTACACAAAAGTACTGTACCATTGCCTTTATCTTGAAGGTTTCGGAAGCCT
CTACAGTTAATAAGTTAAATAAAGGGCTTGAGTACATAAATATTTGTCTAGGAACCCTACCGTATCTACA
ACACAGTAAGAATCTACGGGAGGACAAACTTTTACCATACCACGCTGAGTGCAATTGCGTTATAACATTT
CAAATATACAAAGCTCTGTTCTTTTCTTTTTTTTTTTAATAACAATGGTATGTACAGAATCAATAATCAC
AGTTTGGTGACTTCAACAGTCCATATTCTAGCAGAGTATTATTTCCCTTTGGTTTGATATAAAAACCTTG
GTTGGTGTATGATAAAGAAGAGAACAAGAACAAGACGCCCCTTTCCTTTAAGTGCACTGTTAGCTATCTT
ACAGGCTCGCATTTGCTTCCCGGGCCCTGGCTTCACGCTGGGGCCCTCGCTGGGGAGATCAACTTCGAGC
GCCAAAATGCTATTTAAAAA

FIGURE 344
SEQ ID NO: 336
Genbank ID        : BF111626
Unigene ID(#167)  : Hs.55028
Unigene name      :         CDNA clone IMAGE:6043059, partial cds
>gi|10941316|gb|BF111626.1|BF111626 7132d03.x1 Soares_NSF_F8_9W_OT_PA_P_S1 Homo
  sapiens cDNA clone IMAGE:3523228 3' similar to contains element PTR7 repetitiv
e element ;, mRNA sequence
TTTTTAGCAAGACAAGGTGTTTTTATTGAGGTCTCAGGAATTGCAATTTGGGAGACAGATTCAGCTAGAA
GCCACTTGTGTTCTGAAGAGAGAGGGTAGAGGAGGGGTTTTTAAAAAAAGCTGAGGGTGATTAGACAAGT
TGACAAGTTGTTTTGAAAGAGGCAACTGGCTTAGTACAAAAATCCATAGTTTATTGGTTGGTGCTGTTGA
GGAGTTGTAGTGCTGGTGAAATAAAATTTTCCAGGATGCAGTGGTCATCGCAATTTGGCCCAATTCAAAG
GTTCAAGGTAAGCTCCTGTATTGTTTTTTTTTGGAGCTTTTAATTTTTTTCAAGTTGCAGGTCATGT
AGGGAGTCCTTTTTAGAATGGCTTCCTCCCTCCATTTAGAGTTCTGAACCAAAGTGATGTCATTTATTT
TATTTTATTTATTTATTTTTAAGATGGAGTCTCACTCTGTCACCTAGGCTGGAGTGCAGTGGCG

FIGURE 345
SEQ ID NO: 337
Genbank ID        : NM_006456.1
Unigene ID(#167)  : Hs.288215
Unigene name      :         sialyltransferase 7 ((alpha-N-acetylneuraminyl-2,3-
beta-galactosyl-1,3)-N-acetyl galactosaminide alpha-2,6-sialyltransferase)
B       SIAT7B

FIGURE 345 cont'd

>gi|5454091|ref|NM_006456.1| Homo sapiens sialyltransferase 7 ((alpha-N-acetyln
euraminyl-2,3-beta-galactosyl-1,3)-N-acetyl galactosaminide alpha-2,6-sialyltra
nsferase) B (SIAT7B), mRNA
GGGACGTCAGCGGACGGGGCGCTCGCGGGCCGGGGCTGTATGGGGCTCCCGCGCGGGTCGTTCTTCTGGG
TGCTGCTCCTGCTCACGGCTGCCTGCTCGGGGCTCCTCTTTGCCCTGTACTTCTCGGCGGTGCAGCGGTA
CCCGGGGCCAGCGGCCGGAGCCAGGGACACCACATCATTTGAAGCATTCTTTCAATCCAAGGCATCGAAT
TCTTGGACAGGAAAGGGCCAGGCCTGCCGACACCTGCTTCACCTGGCCATTCAGCGGCACCCCCACTTCC
GTGGCCTGTTCAATCTCTCCATTCCAGTGCTGCTGTGGGGGACCTCTTCACCCCAGCGCTCTGGGACCG
CCTGAGCCAACACAAAGCCCCGTATGGCTGGCGGGGCTCTCTCACCAAGTCATCGCCTCCACCCTGAGC
CTTCTGAACGGCTCAGAGAGTGCCAAGCTGTTTGCCCCGCCCAGGGACACCCCTCCAAAGTGTATCCGGT
GTGCCGTGGTGGGCAACGGAGGCATTCTGAATGGGTCCCGCCAGGGTCCCAACATCGATGCCCATGACTA
TGTATTCAGACTCAATGGAGCTGTGATCAAAGGCTTCGAGCGCGATGTGGGCACCAAGACTTCCTTCTAT
GGTTTCACTGTGAACACGATGAAGAACTCCCTCGTCCTACTGGAATCTGGGCTTCACCTCCGTGCCAC
AAGGACAGGACCTGCAGTATATCTTCATCCCCTCAGACATCGCGACTATGTGATGCTGAGATCGGCCAT
TCTGGGCGTGCCTGTCCCTGAGGGCCTAGATAAAGGGGACAGGCCGCACGCCTATTTTGGACCAGAAGCC
TCTGCCAGTAAATTCAAGCTGCTACATCCGGACTTCATCAGCTACCTGACAGAAAGGTTCTTGAAATCAA
AGTTGATTAACACACATTTTGGAGACCTATATATGCCTAGTACCGGGGCTCTCATGCTGCTGACAGCTTT
GCATACCTGTGACCAGGTCAGTGCCTATGGATTCATCACAAGCAACTACTGGAAATTTTCCGACCACTAT
TTCGAACGAAAAATGAAGCCATTGATATTTTATGCAAACCACGATCTGTCCCTGGAAGCTGCCCTGTGGA
GGGACCTGCACAAGGCCGGCATCCTTCAGCTGTACCAGCGCTGACCCCAATGCACTGAGCGCTTTGCTTC
TTCAAGAGTTGCGGCCCTGATCCTCTCAAGTGGCCAAAAGCTTTTTAACTTTTCAATCTTCACCTTCCC
TTGCCAACAGAGGGCACTGGGGTGAATTCAAGATTTTCATCGAGGTCTGTTCAATATAGGACACCCCAGC
TTGTCCTTGGCTCATCCAAGAACTCTTCTGTATCTAAAACAATACATCTCAATCTTGGCCAAGGGAAAAT
GGACTGCTTTGCTGGATTGGCACTGAGCAACTTTAGGAAATGTCGGTGGAGTGTTCAGCAAGATCAGACA
GCAGTCCAGGTCAAAGGCAAACACACACGCTCCAGCCCAAATCCTCCTGGTGGCACATCCTACCCCAGAT
GCTAAAGTGATTCAAGGACTCCAGGACACCTCTTAAGAGCCTTTCTAAGAACATGATAGGCTTACTTCTG
CTCCATAATAAAGTGGGAGAAAAAAGCCAGAATATAACTTAAGACTAGATAACTGCGTACATGATGGACC
ATTTTTTTTTTTTTGGCTGGGTAGAGAAATCATATAAAACGCAGGCTGTTTAGCATGGAGATGACTCTC
AGAACACTGGGAGGGTCTGGCACTTGATGGGGGTTAGTTGCTTGGCAGCCTGCCTGCCACTGAGGGAAGT
CCCATTAGAGATGTATCACCACCTTGTCACCAACAGGATGATGTCACCAACAGGATGATGTCACCAGGTA
ATAAACCTTCATCCTCAC

FIGURE 346
SEQ ID NO: 338
Genbank ID      : BF310919
Unigene ID(#167) : Hs.355862
Unigene name    : glutamic    pyruvate    transaminase    (alanine
aminotransferase) 2      GPT2
>gi|11258588|gb|BF310919.1|BF310919   601895584F1   NIH_MGC_19   Homo   sapiens
cDNA cl
one IMAGE:4124973 5', mRNA sequence
GCTTACCACTTCAGGATGACTATCCTCCCTCCAGTGGAGAAGCTGAAACACGGTGCTGCAGAAGGTGACA
GACTTCCACATCAACTTCCTGGAGAAGTACGCGTGAGGACGCCTGAGCCCCAGCGGGAGACCTGTCCTTG
GCTCTTCCTCCCAATGCCCGTCAGGCTGAACTCGCCTCCCCGTGACTCTGCCTCGGGCCTCGCAGAGGC
CGCTGGTCACTTCGTCATCATTTTGCCCCTGGAGACGTCTTTCTTTTGTGCCTTGATGTCGAGAGCGCCT
CTCTTTTGAGCAAACAAGCATTCTATATGCAACCAGAGTAGAGGGGACCTGCTCAGCCAGGTGTGACCAG
GGTTCTCTGAATCTGTCACTCGTCAAGCTTCTGGCAACGTTCACTCTCGGGGTTTACAAACCAACTAGCG
ACTGCTGTCGCGGCTGAGACTCGCTCCACACTCCTGCCCCACCCGACCCACCGTGTCCGCGCCCCCGGT
CGTCGCCTTAACCAGTGCCGCACGGCGCCGCCCCCCGCCAAAACCCACCCACCCATGCACCTGCTGAACA
CTCAAACGCCCCTCCACCCGCCCGCAGAACCCATCCCGCCTCCCTCCGACACCGCAACGGCCCCCGCAA
AGCGCCCCACGCCACCTGCAAAACACCCGATAACAGCAACAGCGAAGAGCCATAGAGCCAAGCCAGGGCA
GCACACGCCACCGCCCAACACACACGCCGACAACTCGCGCCACCCACACGACACCCACCAAACAGCACGA
CGCTACAACTCCCGAACAAGCCAGACACACACAACGCCAAAACAGACCACAACCTGCCGAAAAGACGCGA
CACGCCAGAGCCCCACACGATGACTGGACGAACATGGACCATCCGCGCAGCACACAGCCAACAGCACAG
CACGGAACAGCGCACACACCCCGGGCAACNCCCGCGAGGCCACTAGAGAGACAAACACGGAGCGCACCCC
CGCCAACCACGCCACCCCGATGACCCCACGACGCAAGACAGCCCACGCGCCACCCAACAGCGCAGCCTCA
CGCGCCACACCGGCGCGGCCACACCACGGCGGCCACACCAAACCGGAGAGGGAAGGTGACCAACCAAGCG
AGGAACCGACACACAACACACAGAAGACCAAAGCGTAGCGAACAGCGACCGCCACGGCCCGAGCACACAC FIGURE 346 cont'd cc

FIGURE 347
SEQ ID NO: 339
Genbank ID      : AF288395.1
Unigene ID(#167) : Hs.158244
Unigene name    :    nicotinamide    nucleotide    adenylyltransferase    2
    NMNAT2
>gi|12620199|gb|AF288395.1|AF288395 Homo sapiens C1orf15 mRNA, complete cds
ATATAAACTCTAAGGAAGACAGTGATGGAGTGAAGTGGGCTGGGGGCGATAGAGAGGATGGGGTGGGGCA
CCAGGCGAGAGATGCGAAGGAAGCCAGAACGAAAAGAGAGCGACCGAGGAGAGAAGAGAGCAGAGCAATA
CAAAAGCAGCCTCGGATCTAGCCGGAGCTGCAAGCGTTAAGGGGAGGCGGAGAGTGACGCGGTTTGCGTC
TGGAGCGGCTCCTTGGAGTCCACAGCATCCACCGCCGGAGCCTCGCCTTCCTTTCTCCCTCTGCAGACAC
AACGAGACACAAAAAGAGAGGCAACCCCTAGACCACCGCGAAGGACCCATCTGCACCATGACCGAGACCA
CCAAGACCCACGTTATCTTGCTCGCCTGCGGCAGCTTCAATCCCATCACCAAAGGGCACATTCAGATGTT
TGAAAGAGCCAGGGATTATCTGCACAAAACTGGAAGGTTTATTGTGATTGGCGGGATTGTCTCCCCTGTC
CACGACTCCTATGGAAAACAGGGCCTCGTGTCAAGCCGGCACCGTCTCATCATGTGTCAGCTGGCCGTCC
AGAATTCTGATTGGATCAGGGTGGACCCTTGGGAGTGCTACCAGGACACCTGGCAGACGACCTGCAGCGT
GTTGGAACACCACCGGGACCTCATGAAGAGGGTGACTGGCTGCATCCTCTCCAATGTCAACACACCTTCC
ATGACACCTGTGATCGGACAGCCACAAAACGAGACCCCCCAGCCCATTTACCAGAACAGCAACGTGGCCA
CCAAGCCCACTGCAGCCAAGATCTTGGGGAAGGTGGGAGAAAGCCTCAGCCGGATCTGCTGTGTCCGCCC
GCCGGTGGAGCGTTTCACCTTTGTAGATGAGAATGCCAATCTGGGCACGGTGATGCGGTATGAAGAGATT
GAGCTACGGATCCTGCTGCTGTGTGGTAGTGACCTGCTGGAGTCCTTCTGCATCCCAGGGCTCTGGAACG
AGGCAGATATGGAGGTGATTGTTGGTGACTTTGGGATTGTGGTGGTGCCCCGGGATGCAGCCGACACAGA
CCGAATCATGAATCACTCCTCAATACTCCGCAAATACAAAAACAACATCATGGTGGTGAAGGATGACATC
AACCATCCCATGTCTGTTGTCAGCTCAACCAAGAGCAGGCTGGCCCTGCAGCATGGGGACGGCCATGTTG
TGGATTACCTGTCCCAGCCGGTCATCGACTACATCCTCAAAAGCCAGCTGTACATCAATGCCTCCGGCTA
GCAGCCCCTCGTCCTCCGGCAACACAATGGCCCCTCCATCTTTGTCAGCCCCCTGTTTCTCTCCTGCCTC
TCTGTTTCTCCATCTCCTCGTCTTGACTGTTTTCCCTACTTGCTGACTTAACCCCCCATAGTGTGGGGGA
CCTGCAGAGAACCATGGCATTCCCTATTCCACAGTCATCTTTGGACAGACTTTCCTCTAGTCTCCGGGTT
GGGGGTGGGTGAGGGAATGGGGTGGGAGTCGGGGGAAGTGCAGTCCTTGGAGATGTACTGGTGTCCGTCT
CCCAGCATGCTCTAGAGAGGCGGCTCTGGTGCCCATCCTCCCAGCACGCTCTGGGGAGGCGGCTCTGGTG
CCCATCCTCCCAGCATGCTCTAGAGAGGCGGCTCTGGTGCCCCTCCTCCCAGCATGCTCTGGGGAGGCGG
CTCTGGCTCTTGCCTTCCAGCATGCCCTTACTACAAGGGCTATTTTTCTTTTCTTTCTTTTGTTTAT
TTATTTTCTTTGTTCACTCCCTGTAGAACTTGGATGAAATCAGTGTCCATGGTTCTTTATGTTTGTAGT
CTTGATGTGCTCCTGTGGTATTACTTCCCCTCTGATAGGACATTGTAGCCAGCCTCAGCACTCAGTGAGT
TCATCAGGGCCACACCCAGTAGAGAAGGCCAAGCAACCTCCACTTCTTCAGCACCACACACACGCACACA
CACACACACGCACACATGCGTGTGCACCCGCGCACGCACCACATACACACACACATATAGCAGTAGCAGCAGC
AGCAGCAGCAGCAACCTTTGATCAGGAGTGAGATTTTCGGGTTCTGAAACCTGGGACACGAGTCTGT
GAATAGTCGGTTTTCTCAGAATAATTTGAATCTGTTTTCTTAGTTTCAAATGACCATTTCCCTGATGCTC
TGAGCTTATGATCACACAGAGCCAGTCCATCCTCATTTCCTGGTGGCATCTGTTCATTTACCTTTGTGGA
CTGTAGCTGATGGCACAGTGCGGGTTCCCTACCAGCCAGGGGTTTCCAAGGGACCTTTGGAGGCCATGCT
TAGACACATTCCTGTACCTGAGAACAACCACATAGGCAGGACCAGATCCACATCGTGCAGTCGTGTCATA
AAAAAACAAAACAAAACAAAAAAACACTAGGAGTCCACTCAACCCTGGAGGTCTTTGCTAATTGGAATTA
TGTATTGTCTGTTGGGCTGGGAAATGTCTCTTTCATATTGTAAGTCCAGGATGAACTAGGAGAAAGCAAT
TTGTTGCCCTGATGATAACTGATGATTTTCACCCTCTCTAGCTGAGGTAACTCAGACAGTGCATGAGGTC
AGTTTCTTCTTGAGAAGCAGTGCCTTGGTCTTGTTTCTGTGGTTGGTTCTAGCCCCTGCAGAGCCTGGGA
GCTGCAGGAACTGTCTGAGAAAATCTCCCTAATAGGGGAGTGGGTTCCCAGAAGGGAGATCTGGGAGGGG
TCAGGAGCCACTAAGTTGCTTCACTCCTTTTTTCTCTAATTTTCTACCTTCCTCTCTGTTCCTGCAGACA
GTTTTGCCAGCTTTGCTTCTGGTTACTAGGGTCTCATGCGTGTCCTGCTTGGAGAGCCATAAGGAAATTG
CTGTCTTGTGCTTTGTGTCTCTCATCCAGTCTCTGGCTCTTGGATTCTGGTCTTTGAGAAATAGTCCCT
GAGTATTAGGATACTTTTATCAAAATCTAGTACCAGCTACGGCCAGAAAGGGCCAGGTGGGACCTGAAAG
CAAAGACAATGTTCTTTACCACACGTTTCACATCTGCAACATCCTTCAATTGCGGGAAAAGGAACTTGAT
TTAACAGAAGAACATGGTAGAGCAGCATCCAGAAAGTCTGTTATTCCTCTTGGATTTTTTGAAATAATCT
TCAGAGGAAGGAAGGAAATCCTATTTTGGGGTATCAGTGTTTGACTAGGGATCATGAAATAATAAACTG
AAAAAAACTTTAGAGTTCAGTTGATCCAACACTTTCCTTTAAAAGTTGAGGGAGCAGAGGCCCATGGAT
TAAATGGCTGGTCCAGGTCAGCCAGCAGGTGTAGGGCCTGACAAGAACATATTGTTTCCCTGACCCCTAG
GCCGTCACACCACACCCTCCATTTCCTCATGTTGCTGACCAGGTGCCCATATGATTTCTACACTTCCCAA
GCCTTACCCTGGCATCTTTCTTTTAAATTATATCTGTCCCAGGTGCTCTCCACACATAGGATGGTAATGC
CAGTCCCAGGGGAGGGTGTGATAGTAAGGAAGGCCACTGTTAGGTTTCCTTTAGAAATAAAGAGATCTCA

FIGURE 347 cont'd

```
GCAGCTTGGAAGAAATCCCAGAAGCGGAACTCCATCAATCCAAGAAAGAGTTGCTTTGTGGAAGGTGAAG
GAAGACCCACAGAGTGCTCAGGATGATGCTATTGCTGGAGAGCGAAAGATGGAACAGCCTTGTCCAGGCA
GAACAGTCATAAGCCAGGAAATGAAACAAAGGAAAACAGGTGCCTGAATTTCCTGGGGAAACATGGCTTG
TTTAAGGACTTGGAGTTATGGATGGAATTTATGGACCCACGTGAGCAGACCTGAGGAAGGCTCGATTTC
TTTTGTTTCTTGGTCCACTCTGTCACTCTGCTCTGGTCAAGCCCCATTTGGTCTACAGCCCATGAGAAGG
AATGAGGCTGGTTCTGCACTCTCAGCATGCAGTCCGAAAGCATGTGGGAGTGGGGAGGGAAAGTGAGATG
AATTAAGACAAAGAACAGGTGCCATAGAAGTAGATTTCTAGGAATGAAGTGGGGCAGATCTTATCTTTGT
GGATTACAGGCACTGTACTAAAAACAGGTTTCCTATTTAATATAAAAAGAAAGTGAATCTTCTTTTGGAT
AGAATCATCCATTCCCATCGCCGCACCCCCTACCCCCCAAACACACACACACACACACACACACACACAC
ACACACACACACACACACACACGCCCTACTCTTCATTTGCTAGGGGAAGGTCACAGCACAACTAAATCCA
GGACAGGACATTGTGACCATGACCCAGCCACAGTCAATACCAGAAAGATGATTCAGAGTCTGAAGTGGTG
CCCCAGGTGCCAACAGGATAACCTCTACCCCCGACTTTGTCTCTGGGGTCCTGTTCCTTCCTGCAAAGC
CCAATCCAAGACTGGCATGGCTCAGAGGTTGTGAGAAAGGCATGGACTGGAACAATCATGTCCAGAGGGG
TCTGGAGCTTTGTTTCCTGTTCACCAGCAAAAAATGTCTCTCCATTTTTCTGAAAGTGGCTGATGTAAG
AACAGGCAGAAGGAAAACCCTTTTTGTCAATAACTCTGTCCTTAAGGAATGGTCCTCTGGGAGGGCTGTG
CTGCTAGTGGGTACCTCAGTCACACACCCCCAACCCCAGGCAGCCTCTAGAGCCTTCTTGCTTTCATTTT
CCTTGAATGTACATAGGAACAAGGGGGAAAGTCTCTTACTGAAGTGCCTGAAACCCAAAGCTAGAGCTTC
TAGAGACGCCGTTCTTCCTGTCTCAGCTTGGCCAGCCTTTCAACAATGTTCTCTAGTTTCAAGCTCCAGC
TTCTCAGAAAGAATTAAAGAACTTGCTGTTCAAATTAAGTAGAAAGTGAGACTCAATAATAACTGAACTA
CAGCAAAAGGCAGAGAATTACAGGGAGAAAAAACTTGTACTTACCAGCCCAATTCTACTCTCCTCAAACT
GACACACACACACACACACACACACACACACACACACACACACACACACTCTTTTAGGGGACTAAGAGAG
AGAAGCATGTTATTACATTTTACTCATCCAAACAGTAATGCAAAATAAAACGGTAGAATATGAAAAGCT
CAGGATCTCTCCCAAGGCTACCTACTGCAGGAGGGCCAACAGGTGAGATGGGAAGAATGGAAACAGGGAC
CGATTTTGTAGCTCATACAATTAGGACACCTTAGGAATAGCATTGTAGTAATGGTGATGAATATGCTCTG
CCAAATTCATCCAGTCTGCACCATCTTATAGCTGCCCAGCACACTCGACTGTTCATGTGGTCTCTTTGTA
GTGTGAGTTTGGAGTGTCCTATTAGCCTGTTCTGGTTAGGAATGAGTTAACGGCTCTTTCCCTCAACCTT
AGTCTAGTCCCAGGGCTGAGGATTCAGCTGGATCCACATGGTCTTGAGGGTTGGCATGAGGAGGGGGAAG
CTTTTTTGAATCGCTTTTTGATCACATAATCTGCCATTTTAAGAGTAAGATTTGCTTTATGGAAATCAAT
TCATTAATAAAAAATGATATTCAAGTTGCAATACCATTTCACAGTGAAATATTTTGAGTACAATTTTGTT
GCTAGAATAGTCATGGGCAAGAGTTTTATGCAAAATGTTTCAATTATGTTAATAAATAAGACAATGCWAA
AAAAAAAAAAAAAAAAAAAA
```

FIGURE 348
SEQ ID NO: 340
```
Genbank ID       : AI694320
Unigene ID(#167) : Hs.6295
Unigene name     :       zinc finger protein 533 ZNF533
>gi|4971660|gb|AI694320.1|AI694320   wd45d09.x1   Soares_NFL_T_GBC_S1   Homo
sapiens
cDNA clone IMAGE:2331089 3', mRNA sequence
TTTTTTTTTCAAATTTTATTTTTTGTACTTTTATTGAAAGGTACATTTAAAAAAATACACAGACATTTT
ACCATTTACAGGTTGCAGATATAGATGCTCTAAAAGAGTCCACTCTATTTTGTTGTTCTATGATAACTCT
TGCCCCTGATATCACAAACATTCCAGTCTTGTTGATATCGGCTTAAAAAGGGGGGCATGGGAGCATGACC
TGCAATATATTCAGCGAACAGAAAGACAAATTGTTCAATTATAAATTTTTTTATCTTCTGTACATTATTG
CATTAGGGAGCCACAAAATTATGTAGCATCATTACAAATGAAAACAGGTTAAAAATGAAGAAGATACTTA
TATAGAAATACATGGATTCATTGTCTTCTTGCAGAATGCACAAGAGGTGCAAAAATGTGCAATTTAGGAA
GCTCTTTTTCTGTTTGTATACGTTTGCTTAGCAACACAAACCAGTGAGGAAGCTACAAAATAAGTTAAAC
AAAAATAGCAAACAGGTAGTAATTATAGCTATGTTATATGGCTNTCTATTTCATTTAAATATCTCCAAAT
A
```

FIGURE 349
SEQ ID NO: 341
```
Genbank ID       : NM_016359.1
Unigene ID(#167) : Hs.279905
Unigene name     :       nucleolar   and   spindle   associated   protein   1
     NUSAP1
>gi|7705950|ref|NM_016359.1|  Homo  sapiens  nucleolar  and  spindle  associated
prot
```

FIGURE 349 cont'd ein 1 (NUSAP1), mRNA
GGGATTTGAACCNCGCTGACGAAGTTTGGTGATCCATCTTCCGAGTATCGCCGGGATTTCGAATCGCGAT
GATCATCCCCTCTCTAGAGGAGCTGGACTCCCTCAAGTACAGTGACCTGCAGAACTTAGCCAAGAGTCTG
GGTCTCCGGGCCAACCTGAGGGCAACCAAGTTGTTAAAAGCCTTGAAAGGCTACATTAAACATGAGGCAA
GAAAAGGAAATGAGAATCAGGATGAAAGTCAAACTTCTGCATCCTCTTGTGATGAGACTGAGATACAGAT
CAGCAACCAGGAAGAAGCTGAGAGACAGCCACTTGGCCATGTCACCAAAACAAGGAGAAGGTGCAAGACT
GTCCGTGTGGACCCTGACTCACAGCAGAATCATTCAGAGATAAAAATAAGTAATCCCACTGAATTCCAGA
ATCATGAAAAGCAGGAAAGCCAGGATCTCAGAGCTACTGCAAAAGTTCCTTCTCCACCAGACGAGCACCA
AGAAGCTGAGAATGCTGTTTCCTCAGGTAACAGAGATTCAAAGGTACCTTCAGAAGGAAAGAAATCTCTC
TACACAGATGAGTCATCCAAACCTGGAAAAAATAAAAGAACTGCAATCACTACTCCAAACTTTAAGAAGC
TTCATGAAGCTCATTTTAAGGAAATGGAGTCCATTGATCAATATATTGAGAGAAAAAGAAACATTTTGAA
GAACACAATTCCATGAATGAACTGAAGCAGCAGCCCATCAATAAGGGAGGGGTCAGGACTCCAGTACCTC
CAAGAGGAAGACTCTCTGTGGCTTCTACTCCCATCAGCCAACGACGCTCGCAAGGCCGGTCTTGTGGCCC
TGCAAGTCAGAGTACCTTGGGTCTGAAGGGGTCACTCAGCGCTCTGCTATCTCTGCAGCTAAAACGGGT
GTCAGGTTTTCAGCTGCTACTAAAGATAATGAGCATAAGCGTTCACTGACCAAGACTCCAGCCAGAAAGT
CTGCACATGTGACCGTGTCTGGGGGCACCCCAAAAGGCGAGGCTGTGCTTGGGACACACAAATTAAAGAC
CATCACGGGGAATTCTGCTGCTGTTATTACCCCATTCAAGTTGACAACTGAGGCAACGCAGACTCCAGTC
TCCAATAAGAAACCAGTGTTTGATCTTAAAGCAAGTTTGTCTCGTCCCCTCAACTATGAACCACACAAAG
GAAAGCTAAAACCATGGGGCAATCTAAAGAAAATAATTATCTAAATCAACATGTCAACAGAATTAACTT
CTACAAGAAAACTTACAAACAACCCCATCTCCAGACAAAGGAAGAGCAACGGAAGAAACGCGAGCAAGAA
CGAAAGGAGAAGAAAGCAAAGGTTTTGGGAATGCGAAGGGGCCTCATTTTGGCTGAAGATTAATAATTTT
TTAATATCTTGTAAATATTCCTGTATTCTCAACTTTTTTCCTTTTGTAAATTTTTTTTTTTGCTGTCA
TCCCCACTTTAGTCACGAGATCTTTTTCTGCTAACTGTTCATAGTCTGTGTAGTGTCCATGGGTTCTTCA
TGTGCTATGATCTCTGAAAAGACGTTATCACCTTAAAGCTCAAATTCTTTGGGATGGTTTTTACTTAAGT
CCATTAACAATTCAGGTTTCTAACGAGACCCATCCTAAATTCTGTTTCTAGATTTTTAATGTCAAGTTC
CCAAGTTCCCCCTGCTGGTTCTAATATTAACAGAACTGCAGTCTTCTGCTAGCCAATAGCATTTACCTGA
TGGCAGCTAGTTATGCAAGCTTCAGGAGAATTTGAACAATAACAAGAATAGGGTAAGCTGGGATAGAAAG
GCCACCTCTTCACTCTCTATAGAATATAGTAACCTTTATGAAACGGGGCCATATAGTTTGGTTATGACAT
CAATATTTTACCTAGGTGAAATTGTTTAGGCTTATGTACCTTCGTTCAAATATCCTCATGTAATTGCCAT
CTGTCACTCACTATATTCACAAAAATAAAACTCTACAACTCATTCTAACATTGCTTACTTAAAAGCTACA
TAGCCCTATCGAAATGCGAGGATTAATGCTTTAATGCTTTTAGAGACAGGGTCTCACTGTGTTGCCCAGG
CTGGTCTCAAACTCCACCAAATGTACTTCTTATTCATTTTATGGAAAAGACTAGGCTTTGCTTAGTATCA
TGTCCATGTTTCCTTCACCTCAGTGGAGCTTCTGAGTTTTATACTGCTCAAGATCGTCATAAATAAAATT
TTTTCTCATTGTCAAAAAAAAAAAAAAA

FIGURE 350
SEQ ID NO: 342
Genbank ID       : NM_003382.1
Unigene ID(#167) : Hs.170560
Unigene name     :         vasoactive intestinal peptide receptor 2  VIPR2
>gi|4507898|ref|NM_003382.1|  Homo  sapiens  vasoactive  intestinal  peptide
recepto
r 2 (VIPR2), mRNA
CGGGACGAGGGGGCGGCCCCCGCGCTCGGGCGCTCGGCTACAGCTGCGGGCCCGAGGTCTCCGCGCAC
TCGCTCCCGGCCCATGCTGGAGGCGGCGGAACCCGGGGGACCTAGGACGGAGGCGGCGGGCGCTGGGCGG
CCCCCGGCACGCTGAGCTCGGGATGCGGACGCTGCTGCCTCCCGCGCTGCTGACCTGCTGGCTGCTCGCC
CCCGTGAACAGCATTCACCCAGAATGCCGATTTCATCTGGAAATACAGGAGGAAGAAACAAAATGTACAG
AGCTTCTGAGGTCTCAAACAGAAAAACACAAAGCCTGCAGTGGCGTCTGGGACAACATCACGTGCTGGCG
GCCTGCCAATGTGGGAGAGACCGTCACGGTGCCCTGCCCAAAGTCTTCAGCAATTTTTACAGCAAAGCA
GGAAACATAAGCAAAAACTGTACGAGTGACGGATGGTCAGAGACGTTCCAGATTTCGTCGATGCCTGTG
GCTACAGCGACCCGGAGGATGAGAGCAAGATCACGTTTTATATTCTGGTGAAGGCCATTTATACCCTGGG
CTACAGTGTCTCTCTGATGTCTCTTGCAACAGGAAGCATAATTCTGTGCCTCTTCAGGAAGCTGCACTGC
ACCAGGAATTACATCCACCTGAACCTGTTCCTGTCCTTCATCCTGAGAGCCATCTCAGTGCTGGTCAAGG
ACGACGTTCTCTACTCCAGCTCTGGCACGTTGCACTGCCCTGACCAGCCATCCTCCTGGGTGGGCTGCAA
GCTGAGCCTGGTCTTCCTGCAGTACTGCATCATGGCCAACTTCTTCTGGCTGCTGGTGGAGGGGCTCTAC
CTCCACACCCTCCTGGTGGCCATGCTCCCCCTAGAAGGTGCTTCCTGGCCTACCTCCTGATCGGATGGG
GCCTCCCCACCGTCTGCATCGGTGCATGGACTGCGGCCAGGCTCTACTTAGAAGACACCGGTTGCTGGA
TACAAACGACCACAGTGTGCCCTGGTGGGTCATACGAATACCGATTTTAATTTCCATCATCGTCAATTTT
GTCCTTTTCATTAGTATTATACGAATTTTGCTGCAGAAGTTAACATCCCAGATGTCGGCGGCAACGACC
AGTCTCAGTACAAGAGGCTGGCCAAGTCCACGCTCCTGCTTATCCCGCTGTTCGGCGTCCACTACATGGT FIGURE 350 cont'd
GTTTGCCGTGTTTCCCATCAGCATCTCCTCCAAATACCAGATACTGTTTGAGCTGTGCCTCGGGTCGTTC
CAGGGCCTGGTGGTGGCCGTCCTCTACTGTTTCCTGAACAGTGAGGTGCAGTGCGAGCTGAAGCGAAAAT
GGCGAAGCCGGTGCCCGACCCCGTCCGCGAGCCGGGATTACAGGGTCTGCGGTTCCTCCTTCTCCCACAA
CGGCTCGGAGGGCGCCCTGCAGTTCCACCGCGCGTCCCGAGCCCAGTCCTTCCTGCAAACGGAGACCTCG
GTCATCTAGCCCCACCCCTGCCTGTCGGACGCGGCGGGAGGCCCACGGTTCGGGGCTTCTGCGGGGCTGA
GACGCCGGCTTCCTCCTTCCAGATGCCCGAGCACCGTGTCGGGCAGGTCAGCGCGGTCCTGACTCCGTCA
AGCTGGTTGTCCACTAAACCCCATACCTGG

FIGURE 351
SEQ ID NO: 343
Genbank ID        : AW189097
Unigene ID(#167)  : Hs.444393
Unigene name      :       Transcribed sequences
>gi|6463533|gb|AW189097.1|AW189097   xk99h09.x1   NCI_CGAP_Ut4   Homo   sapiens
cDNA cl
one IMAGE:2674913 3' similar to gb:X56411_rna1 ALCOHOL DEHYDROGENASE CLASS
II P
I CHAIN (HUMAN);contains MER12.t2 MER12 repetitive element ;, mRNA sequence
TTATGTACGATTTCATTTATATGAATGTCCAGAGTAGGCAAATCCATAGAGACAGAAAAGATATCAGTGG
TTGCCAGGGGATAATGCAGGGAGGGGAAGAGGAGAATGACTGCTTAAAAGGTTTCCTCTTGGGGTGATGA
AAATGTTCCAGAACTAGATAGTGGTAACAGTTTCACAACATTTTAAATGTACTAAAGTCACTGAATTATA
CACTTTAAAATGGTGAAAATGATGAATTTTAACCATTCATAGCCATGTTTTATGAATTTTACCATTTTTT
AAGTAAAGGGAAAAGAAGGTTCTGAGATTCAAACCTTTGCAATCAAAATAAACTGTCGAATACAGAAGCC
CGTAAACATGTTCTGAATACTATTTAATTTTTCTGCCCATGAAACCAAGCCTAATTCTAAATAATATAAG
AGCCAAAATAAACTGTCTAAGCTGGTATTAACCTTTTTCTTAAATTAAAAATGTTATCAGGTTGATAGGT
GCAGCTAACCACCATGGGACACGTTTACCTATGTAACAAACCTGCACATCCTGCACATGTATCCTGGAAC
TTAAATAAA

FIGURE 352
SEQ ID NO: 344
Genbank ID        : AI827789
Unigene ID(#167)  : Hs.100686
Unigene name      :       breast cancer membrane protein 11    BCMP11
>gi|5448449|gb|AI827789.1|AI827789   wf33a07.x1   Soares_NFL_T_GBC_S1   Homo
sapiens
cDNA clone IMAGE:2357364 3' similar to TR:O88312 O88312 GOB-4. ;, mRNA
sequence
TTCCAGATCAAATTATTATTTATTTCAATAAGACTATTGCGAGGCATTAAAAAAACTAAATAGTAATATT
ACAAAATCTATATACTTGCACATTTAGTATTTGTCAATGTGCCAGAGGTTTTCTTCATGAAATTTGACTT
CTTTGAAGTGAAGGCTTTTTTCTATCATCTCTTATAGCTCTGACTGAATAAGTCTTAATGCTTTCTTCAT
GTTTTCTATCAATAGGGGTAAATCCCGAGGCTTATATGTGTACAATCTGTTAGAGTATCTTCCAGCTATG
TCAGCTCTAACTGTTAAAGAAGGGTCTACAAACATGATTCTAGGCACATATTGCCCATCAGGTGATAAAT
TCTTATCAGTGGTTTCATGCATAAGGTTTAGCATGATGAACTTATTCTGAGCCATTTCTTGTATTTCTTC
ATTTTGGGCAAATACTTTCTTTAGTGCTTGAGAGTATTGACAATCCTCCAGGTGATGAATAACCATTAAT
GGCTTCTTACTTTTTTGAGCATAAAAGAGACCTTGCTCATAAGTTTGTACCCAAGAGATGGCATCTACCC
ATCCTCTTGAGAGTGACTGAGG

FIGURE 353
SEQ ID NO: 345
Genbank ID        : BF196457
Unigene ID(#167)  : Hs.95612
Unigene name      :       desmocollin 2     DSC2
>gi|11084425|gb|BF196457.1|BF196457   hr86d10.x1   NCI_CGAP_Kid11   Homo sapiens
cDNA
 clone IMAGE:3135379 3' similar to SW:DSC2_HUMAN Q02487 DESMOCOLLIN 2A/2B
PRECU
RSOR ;, mRNA sequence
TCTTGGTTCTCAGTGTTGGAAAGTAATATGGTAAAACTTCTCTTCTCCGAGGACAATAGAATAGTATTTG FIGURE 353 cont'd TTGTATAGACTGAACCATCCTCCAAAATTTGGAAGTCAGGATCACTTGAATGAATTAGATTTGCAGCTGT
AAAGCACTCTTTCAGGTTAACTCTACCAACAAGTTTCTCGGCATCTAGTTTGGAGGGAACATGTAATGTC
ACATTTTTGCAGGCATCACTGGCAAATATTAAGATCGCGAGGGTCAGCAGGAGCAGCCGGCAGAGGGCTC
CGTTCCAGGAGCCGGAGGGGCGGGCTGCCTCCATGGAGAGGGCTCGGGGCAGGTCGCGGGCCGAGCGTCG
GGCCGGGGTAGGAGGGCTCCGCGGGGCGAGGGCCGCGGCCGGAGCGCAGTCTGGGCCCGCTGCTCATGAG
GAGCGCGAGGCGGAAGGAGGTGGGGCGCGCGGAGAGGTGCTTTTCTTAGCTTCTCTGAAGCGCCTGCCTC
TCATCCAAGGGGCTTTT

FIGURE 354
SEQ ID NO: 346
Genbank ID       : NM_000196.1
Unigene ID(#167) : Hs.1376
Unigene name     :     hydroxysteroid (11-beta) dehydrogenase 2   HSD11B2
>gi|4504498|ref|NM_000196.1|   Homo   sapiens   hydroxysteroid   (11-beta)
dehydrogenas
e 2 (HSD11B2), mRNA
CGCGCCCCAGGCCGGTGTACCCCCGCACTCCGCGCCCCGGCCTAGAAGCTCTCTCTCCCCGCTCCCCGGC
CCGGCCCCCGCCCCGCCCCGCCCCAGCCCGCTGGGCCGCCATGGAGCGCTGGCCTTGGCCGTCGGGCGGC
GCCTGGCTGCTCGTGGCTGCCCGCGCGCTGCTGCAGCTGCTGCGCTCAGACCTGCGTCTGGGCCGCCCGC
TGCTGGCGGCGCTGGCGCTGCTGGCCGCGCTCGACTGGCTGTGCCAGCGCCTGCTGCCCCGCCGGCCGC
ACTCGCCGTGCTGGCCGCCGGCTGGATCGCGTTGTCCCGCCTGGCGCGCCCGCAGCGCCTGCCGGTG
GCCACTCGCGCGGTGCTCATCACCGGCTGTGACTCTGGTTTTGGCAAGGAGACGGCCAAGAAACTGGACT
CCATGGGCTTCACGGTGCTGGCCACCGTATTGGAGTTGAACAGCCCCGGTGCCATCGAGCTGCGTACCTG
CTGCTCCCCTCGCCTAAGGCTGCTGCAGATGGACCTGACCAAACCAGGAGACATTAGCCGCTTGCTAGAG
TTCACCAAGGCCCACACCACCAGCACCGGCCTGTGGGGCCTCGTCAACAACGCAGGCCACAATGAAGTAG
TTGCTGATGCGGAGCTGTCTCCAGTGGCCACTTTCCGTAGCTGCATGGAGGTGAATTTCTTTGGCGCGCT
CGAGCTGACCAAGGGCCTCCTGCCCCTGCTGCGCAGCTCAAGGGGCCGCATCGTGACTGTGGGGAGCCCA
GCGGGGACATGCCATATCCGTGCTTGGGGGCCTATGGAACCTCCAAAGCGGCCGTGGCGCTACTCATGG
ACACATTCAGCTGTGAACTCCTTCCCTGGGGGGTCAAGGTCAGCATCATCCAGCCTGGCTGCTTCAAGAC
AGAGTCAGTGAGAAACGTGGGTCAGTGGGAAAAGCGCAAGCAATTGCTGCTGGCCAACTGCCTCAAGAG
CTGCTGCAGGCCTACGGCAAGGACTACATCGAGCACTTGCATGGGCAGTTCCTGCACTCGCTACGCCTGG
CCATGTCCGACCTCACCCCAGTTGTAGATGCCATCACAGATGCGCTGCTGGCAGCTCGGCCCCGCCGCCG
CTATTACCCCGGCCAGGGCCTGGGGCTCATGTACTTCATCCACTACTACCTGCCTGAAGGCCTGCGGCGC
CGCTTCCTGCAGGCCTTCTTCATCAGTCACTGTCTGCCTCGAGCACTGCAGCCTGGCCAGCCTGGCACTA
CCCCACCACAGGACGCAGCCCAGGACCCAAACCTGAGCCCCGGCCCTTCCCCAGCAGTGGCTCGGTGAGC
CATGTGCACCTATGGCCCAGCCACTGCAGCACAGGAGGCTCCGTGAGCCTTGGTTCCTCCCCGAAAACCC
CCAGCATTACGATCCCCCAAGTGTCCTGGACCCTGGCCTAAAGAATCCCACCCCCACTTCATGCCCACTG
CCGATGCCCAATCCAGGCCCGGTGAGGCCAAGGTTTCCCAGTGAGCCTCTGCGCCTCTCCACTGTTTCAT
GAGCCCAAACACCCTCCTGGCACAACGCTCTACCCTGCAGCTTGGAGAACTCCGCTGGATGGGAGTCTCA
TGCAAGACTTCACTGCAGCCTTTCACGGACTCTGCAGATAGTGCCTCTGCAAACTAAGGAGTGACTAGG
TGGGTTGGGGACCCCCTCAGGATTGTTTCTCGGCACCAGTGCCTCAGTGCTGCAATTGAGGGCTAAATCC
CAAGTGTCTCTTGACTGGCTCAAGAATTAGGGCCCCAACTACACACCCCCAAGCCACAGGGAAGCATGTA
CTGTACTTCCCAATTGCCACATTTTAAATAAAGACAAATTTTTATTTCTTCTA

FIGURE 355
SEQ ID NO: 347
Genbank ID       : NM_022140.1
Unigene ID(#167) : Hs.104746
Unigene name     :     erythrocyte   membrane   protein   band   4.1   like   4A
    EPB41L4A
>gi|11545876|ref|NM_022140.1|   Homo   sapiens   erythrocyte   membrane   protein
band 4.
1 like 4A (EPB41L4A), mRNA
GACATGGGCTGTTTCTGCGCTGTTCCGGAAGAATTTTACTGCGAAGTTTTGCTCCTGGATGAATCCAAGT
TAACCCTTACCACCCAGCAGCAGGGCATCAAGAAGTCAACGAAAGGTTCCGTTGTCCTTGACCACGTATT
CCATCACGTAAACCTTGTGGAGATAGATTATTTTGGGCTACGTTACTGTGACAGAAGCCATCAGACGTAT
TGGCTGGATCCTGCAAAAACCCTTGCTGAACACAAAGAACTGATCAACACTGGACCTCCATATACTTTGT
ATTTTGGTATTAAATTCTATGCTGAAGATCCATGTAAACTTAAAGAAGAAATAACCAGATATCAGTTTTT FIGURE 355 cont'd

```
CTTGCAGGTGAAGCAAGATGTCCTTCAGGGCCGTCTGCCCTGTCCCGTCAACACTGCTGCTCAGCTGGGA
GCGTATGCCATCCAGTCGGAGCTTGGAGATTATGACCCATATAAACATACTGCAGGATATGTATCTGAGT
ACCGGTTTGTTCCTGATCAGAAGGAAGAACTTGAAGAAGCCATAGAAAGGATTCATAAAACTCTAATGGG
TCAGATTCCTTCTGAGGCTGAGCTGAATTACTTGAGGACTGCCAAATCCCTGGAGATGTATGGCGTTGAC
CTCCATCCCGTCTATGGAGAAAACAAGTCTGAGTATTTCTTAGGATTAACTCCGGTTGGTGTTGTTGTGT
ACAAGAATAAAAAGCAAGTGGGGAAGTATTTCTGGCCTCGGATTACAAAGGTTCACTTCAAGGAGACTCA
ATTTGAACTCAGAGTACTGGGAAAAGATTGTAACGAAACCTCATTCTTTTTTGAAGCTCGGAGTAAAACT
GCTTGCAAGCACCTCTGGAAGTGCAGTGTGGAACATCATACATTTTTTAGAATGCCAGAAAATGAATCCA
ATTCACTGTCAAGAAACTCAGCAAGTTTGGATCCATACGTTATAAGCACCGCTACAGTGGCAGGACAGC
TTTGCAAATGAGCCGAGATCTTTCTATTCAGCTTCCCCGGCCTGATCAGAATGTGACAAGAAGTCGAAGC
AAGACTTACCCTAAGCGAATAGCACAAACACAGCCAGCTGAATCAAACACCATCAGTAGGATAACTGCAA
ACATGGAAAATGGAGAAAATGAAGGAACAATTAAAATTATTGCACCTTCACCAGTAAAAAGCTTTAAGAA
AGCAAAGAATGAAAATAGCCCTGATACCCAAGAAGCAAATCCCTCATGCACTCGTGGGAAGAAAATGGC
CCCCAGAGTGGACTCTACAATTCTCCCAGTGATCGCACTAAGTCGCCAAAGTTCCCTTACACGCGTCGCC
GAAACCCCTCCTGTGGAAGTGACAATGATTCTGTACAGCCTGTGAGGAGGAGGAAAGCCCATAACAGTGG
TGAAGATTCAGATCTTAAGCAAAGGAGGAGGTCACGTTCACGCTGTAACACCAGCAGTGGTAGTGAATCA
GAAAATTCTAATAGAGAACACCGGAAAAAGAGAAACAGAATACGGCAGGAGAATGATATGGTTGATTCAG
CGCCTCAGTGGGAAGCTGTATTAAGGAGACAAAAGGAAAAAAACCAAGCCGACCCCAACAGCAGGCGATC
CAGACACAGATCTCGTTCGAGAAGCCCCGATATCCAAGCAAAAGAAGAGTTATGGAAGCACATTCAAAAA
GAACTTGTGGATCCATCCGGATTGTCCGAAGAACAATTAAAAGAGATTCCATACACTAAAATAGAGACAC
AAGGTGACCCAATCCGCATCACGCATTCTCATTCGCCAAAGCTTTATTAGTGCTTGACACAAGGTGACCC
AATCCGCATCAGGCATTCTCATTCGCCACGAAGTTACCGCCAGTATCGCAGGTCCCAGTGTTCAGATGGG
GAGCGATCAGTTCTCTCGGAAGTGAATTCAAAAACAGATCTTGTACCACCACTTCCGGTGACCCATTCTT
CGGATGCTCAGGGTTCTGGGGATGCTACAGTTCATCAGAGAAGAAATGGGTCTAAAGATAGCCTGATGGA
AGAAAAACCTCAGACATCTACAAACAACCTGGCTGGAAAACACACAGCAAAACAATAAAAACTATACAA
GCTTCCCGCCTCAAG
```

FIGURE 356
SEQ ID NO: 348
Genbank ID      : AI744123
Unigene ID(#167) : Hs.13308
Unigene name    :      hypothetical protein LOC134548        LOC134548
>gi|5112411|gb|AI744123.1|AI744123  wc36e12.x1  NCI_CGAP_Pr28  Homo  sapiens
cDNA c
lone IMAGE:2317294 3', mRNA sequence
```
GAAACAAAACTGAGGACTGTTTATTTCATTGCTCATTCAAAACATTCCATGAAAGACTGCCTTAAGTAAT
TTCAAAGGCTTCACTGATACATATGGGGGTGGGGAGGGAAGCTCCACTACCCCATGCCACAAAACTATTT
GATATAACTAATGACATGCAAACACAATTTGCAAAAGCAGAGCATTATCACAATATGACATTTAAAAAAT
TGGTTGAGTAAACAGATTTCATATCTTTAAAACATAAAATAATTACACTGTATTGAGCCTGGGAAATCTT
GGCAATATCTACAAACTTTCTCATTTACAGATAGGAACAAAGGCCCAGAGAAGTTAAGCCACTCATCCAA
GCTCACTGAGCAGAGATTCTGCATTTGCTATTTTGGAATAAGTTGTCTACTTTCAAATGGTTTTTTAAAA
TGGGTATTACATACTTTTTGTTTGTACAGAACAGTCATATAAAATAGTTGCTCCTTAATTGTATCCATTA
CTATTTAATCGCTCATTTTTCTGTAATACTATTACTTTTTAATAGTCACCTATTTCACTGAAAGGCTCC
ACTGGATTTGAAAACCAGATTCAGAAACATGGCACA
```

FIGURE 357
SEQ ID NO: 349
Genbank ID      : NM_007168.1
Unigene ID(#167) : Hs.58351
Unigene name    :      ATP-binding cassette, sub-family A (ABC1), member 8
        ABCA8
>gi|6005700|ref|NM_007168.1|  Homo sapiens ATP-binding cassette, sub-family
A (A
BC1), member 8 (ABCA8), mRNA
```
CAGAAGTCAAATAGTTAAAGCAAATTCTAGATACATGGTAGAGACCAGGAGAAAATATGAATAACTTTCT
TCTAAACAAGGAGCTCAGTGGATAAACCATACCTCTAGATTCCTTGCTTCCATTTTCCCAGAAACAAGAT
GAGGAAGAGAAAGATCAGTGTGTGTCAACAAACTTGGGCCTTATTATGCAAGAACTTTCTTAAAAAATGG
AGAATGAAAAGAGAGTCCTTAATGGAATGGCTGAATTCATTGCTCCTACTACTTTGTTTGTATATATATC
```

FIGURE 357 cont'd

CTCATAGTCATCAAGTAAATGATTTTTCTTCACTGCTTACCATGGACCTGGGACGGGTAGATACATTTAA
TGAATCCAGATTTTCTGTTGTATACACACCTGTCACCAACACGACCCAACAGATAATGAATAAAGTAGCC
TCTACTCCCTTCCTGGCAGGTAAAGAGGTCTTGGGACTGCCAGATGAGGAAAGTATTAAAGAATTCACAG
CAAATTATCCTGAAGAAATAGTAAGAGTCACCTTTACTAATACATACTCATATCATTTGAAGTTCTTGCT
AGGACATGGAATGCCAGCAAAGAAGGAGCACAAGGACCATACAGCTCATTGTTATGAAACAAATGAAGAT
GTTTACTGTGAAGTTTCAGTATTTTGGAAGGAAGGTTTTGTGGCTCTTCAAGCTGCCATTAATGCTGCTA
TTATAGAAATCACAACAAATCACTCAGTGATGGAGGAGCTGATGTCAGTTACTGGAAAAAATATGAAGAT
GCATTCCTTCATTGGTCAATCAGGAGTTATAACTGATTTGTACCTTTTTTCCTGCATTATTTCATTTTCC
TCATTCATTTACTATGCATCTGTTAATGTCACAAGAGAGAGGAAAAGGATGAAGGCCTTGATGACAATGA
TGGGTCTTCGGGATTCAGCGTTCTGGCTCTCCTGGGGTTTGCTCTATGCTGGTTTCATCTTCATTATGGC
CCTTTTCTTGGCACTTGTTATAAGATCTACCCAGTTTATCATTTTGTCTGGCTTCATGGTAGTCTTCAGC
CTCTTTCTCCTGTATGGATTATCTTTGGTAGCTTTGGCTTTCTTAATGAGCATCTTGGTAAAGAAATCTT
TCCTCACCGGCCTGGTCGTGTTCCTCCTCACTGTCTTTTGGGGGTGTCTGGGGTTCACATCACTGTACAG
ACACCTTCCTGCATCCTTGGAGTGGATTTTAAGCTTGCTTAGTCCCTTTGCCTTCATGCTTGGAATGGCC
CAGCTTTTACACTTGGACTATGATTTGAATTCTAATGCATTTCCTCATCCATCGGACGGCTCAAATCTCA
TTGTAGCAACAAATTTCATGTTGGCATTTGACACTTGCCTCTATCTGGCATTGGCGATTTACTTTGAAAA
AATTTTGCCAAATGAATATGGACATCGACGTCCACCTTTGTTTTTCCTGAAGTCCTCATTTTGGTCTCAA
ACACAAAAGACTGATCACGTGGCCCTTGAAGATGAAATGGATGCCGATCCTTCATTTCATGACTCTTTTG
AACAAGCGCCTCCAGAATTCCAAGGGAAAGAAGCCATCAGAATCAGAAATGTTACAAAAGAATATAAAGG
AAAGCCTGATAAAATAGAAGCCTTGAAAGATCTGGTATTTGACATTTACGAAGGCCAAATCACTGCAATA
CTTGGTCACAGTGGAGCTGGAAAGTCAACACTGCTAAACATTCTTAGTGGGTTGTCTGTTCCCACCAAAG
GTTCAGTCACCATCTATAACAATAAGCTTTCAGAAATGGCTGACCTAGAAAATCTCAGCAAGCTGACCGG
AGTTTGTCCACAATCCAATGTGCAATTTGACTTCCTCACTGTAAGAGAAAACCTCAGACTCTTTGCTAAA
ATAAAAGGGATTCTGCCACAAGAAGTGGATAAAGAGATTTTCCTGTTGGATGAACCAACTGCTGGATTGG
ATCCCTTTTCAAGACACCAAGTATGGAACCTTCTGAAAGAACGCAAAACAGACCGCGTGATCCTCTTCAG
TACCCAGTTCATGGATGAGGCCGACATCCTGGCGGACAGGAAAGTATTTCTCTCCCAAGGGAAGCTAAAG
TGCGCGGGCTCTTCTTTGTTTCTAAAGAAGAAATGGGGGATTGGATATCACTTAAGCTTGCAGTTAAATG
AAATATGTGTTGAGGAAAACATAACATCACTTGTTAAACAGCACATCCCTGATGCCAAATTATCAGCCAA
AAGCGAAGGAAAACTTATTTATACATTACCCTTAGAAAGAACAAATAAATTTCCAGAACTTTACAAGGAT
CTTGATAGCTATCCTGACCTAGGAATTGAGAATTATGGTGTTTCCATGACAACTTTGAATGAAGTATTCC
TGAAGCTAGAAGGAAAATCTACAATTAATGAATCGGACATTGCTATTTTGGGAGAAGTACAAGCGGAAAA
AGCTGACGACACTGAAAGGCTTGTTGAGATGGAACAAGTCCTCTCTTCACTTAACAAGATGAGAAAGACA
ATAGGTGGTGTGGCTCTCTGGCGACAGCAAATCTGCGCAATTGCAAGGGTTCGCTTGTTAAAGTTAAAGC
ATGAAAGAAAAGCTCTTTTAGCACTGCTATTAATTCTAATGGCTGGATTTTGCCCTCTTCTTGTGGAGTA
TACCATGGTGAAAATATATCAAAACAGTTACACCTGGGAACTTTCTCCTCATTTGTATTTCCTTGCTCCT
GGACAACAACCACATGACCCTCTCACTCAACTACTGATCATCAATAAAACAGGGGCAAGCATTGATGACT
TTATACAGTCTGTGGAGCACCAGAACATAGCTTTAGAAGTGGATGCATTTGGAACTAGAAATGGCACAGA
TGACCCATCTTATAATGGAGCCATCACAGTGTTGTAATGAAAAGAATTACAGCTTTTCGTTAGCATGC
AATGCCAAAAGATTGAATTGCTTCCCAGTTCTTATGGACATTGTTAGTAATGGGCTACTTGGAATGGTTA
AACCATCAGTACATATCCGAACTGAAAGAAGTACATTTTGGAGAATGGACAGGACAATCCAATCGGATT
CCTGGCATATATCATGTTCTGGCTGGTTTTAACATCGAGTTGCCCACCTTACATTGCCATGAGCAGCATC
GATGATTATAAGAACAGAGCTCGGTCCCAGCTACGGATTTCCGGACTCTCCCCTTCTGCTTACTGGTTTG
GGCAGGCGCTGGTGGATGTTTCCCTGTACTTCTTGGTCTTCGTTTTTATATATTTAATGAGCTACATTTC
AAACTTCGAAGACATGCTACTTACAATAATTCATATTATTCAAATCCCATGTGCTGTTGGTTATTCCTTT
TCCCTCATCTTCATGACATACGTGATTTCCTTCATCTTTCGCAAGGGGAGAAAAAATAGTGGCATTTGGT
CATTTTGTTTCTATGTTGTCACTGTATTCTCTGTGGCTGGATTTGCGTTCAGTATCTTCGAAAGTGATAT
TCCATTTATCTTCACTTTTTTAATACCACCTGCCACAATGATTGGCTGTTTGTTCTTATCTTCTCATCTT
CTCTTTTCTTCTCTCTTTTCTGAAGAACGAATGGATGTACAGCCATTTCTGGTATTCCTAATTCCTTTCC
TTCATTTATCATTTTTCTTTTTACTCTTCGATGTCTGGAATGGAAGTTTGGAAAGAAATCAATGAGAAA
GGATCCTTTCTTTAGAATTTCTCCAAGAAGTAGTGATGTGTGTCAAAATCCAGAAGAACCAGAAGGAGAG
GATGAAGATGTTCAGATGGAAAGAGTGAGAACAGCAAATGCCTTGAATTCTACTAATTTGATGAGAAGC
CAGTCATCATTGCCAGCTGTCTACGCAAGGAGTATGCAGGGAAGAGGAAAGGCTGTTTTCCAAGAGGAA
GAATAAGATAGCCACGAGAAATGTCTCCTTCTGTGTTAGAAAAGGTGAAGTTTTAGGATTATTAGGACAC
AATGGAGCTGGTAAAAGCACATCCATTAAGGTGATAACTGGAGACACAAAACCAACTGCTGGACAAGTGC
TACTGAAAGGGAGCGGTGGAGGGGATGCCCTGGAGTTCCTGGGGTACTGCCCTCAGGAGAACGCGCTGTG
GCCCAACCTGACAGTGAGGCAGCACCTGGAGGTGTACGCCGTGAAAGGCTGAGGAAAGGGGATGCT
GAGGTTGCCATCACACGGTTAGTGGATGCGCTCAAGCTGCAGGACCAGCTGAAGTCTCCGGTGAAGACCT
TGTCAGAGGGAATAAAGAGAAAGCTGTGCTTTGTCCTGAGCATACTGGGGAACCCGTCAGTGGTGCTTCT
GGATGAGCCGTCGACCGGGATGGACCCCGAGGGGCAGCAGCAAATGTGGCAGGCCATCCGGGCCACCTTT
AGAAACACGGAAAGGGGTGCCCTCCTAACCACCCACTACATGGCAGAGGCTGAGGCCGTGTGTGACCGAG
TGGCCATCATGGTATCTGGGAGGTTGAGATGTATCGGTTCCATCCAACACCTGAAAAGCAAATTTGGCAA

FIGURE 357 cont'd

```
AGATTACCTGCTGGAGATGAAGGTGAAGAACCTGGCACAAGTGGAGCCCCTCCATGCAGAGATCCTGAGG
CTTTTCCCCCAGGCTGCTCGGCAGGAAAGGTACTCCTCTCTGATGGTTTATAAGTTGCCAGTGGAAGATG
TGCAACCTTTAGCCCAAGCTTTCTTCAAATTAGAGAAGGTTAAACAGAGCTTTGACCTAGAGGAGTACAG
CCTCTCACAGTCTACCCTGGAGCAGGTTTTCCTGGAGCTCTCCAAGGAGCAGGAGCTGGGTGATTTTGAG
GAGGATTTTGATCCCTCAGTGAAGTGGAAGCTCCTCCCCAGGAAGAGCCTTAAAACCCCAAATTCTGTG
TTCCTGTTTAAACCCGTGGTTTTTTTAAATACATTTATTTTTATAGCAGCAATGTTCTATTTTTAGAAA
CTATATTATAAGTACAGAAATGGTTCTCCGTGTGGTGGGAGGAGGAGGTTCGGGTGCTGGGTAAGTGCCA
TGTCAGTGTGGACAGAGGCATTTGACTAAGCCAACCTCCTCTCACAGCCTCTGTATCTCTGCAGGCCATA
CTGGTTCCATTGTTCTGTATAATACTGAATAAATAAATTTACTTTTACATGATCGTATAAGTTTCTAGAT
AAGATAAACAAATTCTGTTTAAATTTTTTAATAAAAATCTTAAAACACTTTTTTTCTAACCTAGACTGA
GAAATTCATGTTTACTTTTCTAGGTGTATGATACTTTGTAAAGTTGATACTTTCCTAAGAATTTAACATG
TCATATTTTTGAAATAGATTTAAGTGTGCTTCTTATTGCTAAAAATACTAAATGTCATGGGTCATAGTAT
CTGATATCAATATCGTTGATAACATATCCACAGGTAACACCATGATGTAGGCATAAATGGAAAACAAAAA
CCCTACTATTTCAAATATATTGTACTTTTTTATTTCTGTAAGCCAACTGTGTGCCATTTTCACTGGACTT
TTAAATCTAGACTTTAGTGATGTCTACATTGTAAATGATCTTTTGTGGATATTTGTCACTTGGTTTCAGA
AAGTTCACAAATGTAGCAACAGCTCACATGACTGAGTAGGTAGAAAATGTGAAATAAATCTCATATATAT
AGTTTTG
```

FIGURE 358
SEQ ID NO: 350
Genbank ID      : NM_018474.1
Unigene ID(#167) : Hs.436632
Unigene name    :       chromosome 20 open reading frame 19 C20orf19
>gi|8923814|ref|NM_018474.1| Homo sapiens chromosome 20 open reading frame
19 (
C20orf19), mRNA

```
GGAAAGATTAAGCTCCAGAGAACAGAACCACTGATTTAAAGTGTGACAGTTCCAGCGGATCAGAGGGAGA
AATACTGACACGGGAACATATTGAAGTTGAGGAAAAAAGAGCCAGCCCGCCAGTCTCTCCGATACCAGTT
TCAGAATACTGTGAATCTGAAAATAAGTGGTCTCAAGAGAAGCATTCTCCTTGGGAAGGTGTTTCAGATC
ATCTTGCTCACAGGGAACCAAAGTCACAAAAGCCCTTCAGAAAAATGCAGGAAGAGCAGGAGGGGAAAGTTG
GAGCACCAGCAGTGACCTTACCATTTCAATAAGTGAAGATGATCTGATTTTAGAGAGCCCAGAACCACAG
CCAAATCCAGGTGGCAAGATGGAGGGAGAAGATGGAATAGAGGCCTTAAAATTAATCCATGCTGAGCAAG
AAAGAGTTGCCCTATCCACTGAAAAAATTGTATTTTGCAAACCCTAAGCTCTCCTGATTCAGAAAAGGA
ATCCTCCACTAACGCACCAACAAGAGAACCTGGACAAACACCAGACTCAGACGTACCGAGGGCACAGGTG
GGTCAGCATGTTGCCACCTTGAAAGAACATGATAATTCTGTCAAAGAAGAGGCAACAGCATTATTGAGAA
AAGCCCTTACAGAAGAGTGTGGCCGTAGGTCAGCTATTCACAGTAGTGAATCATCTTGCAGCTTGCCATC
TATTCTGAATGACAATAGTGGAATAAAGGAAGCCAAACCTGCTGTATGGCTCAACAGTGTTCCTACAAGG
GAACAAGAAGTTTCAAGTGGCTGTGGAGACAAGAGCAAGAAAGAAATGTGGCTGCAGATATCCCAATCA
CAGAAACAGAAGCCTATCAGTTGCTGAAGAAGGCCACCCTTCAGGATAATACAAATCAAACTGAAAACAG
GTTTCAAAAGACAGATGCTTCTGTGTCACACTTGTCAGGTTTGAATATTGGCAGCGGTGCATTCGAGACA
AAGACAGCTAACAAAATTGCTTCGGAAGCTAGTTTTTCATCTAGTGAAGGAAGTCCTTTGTCAAGGCATG
AAAACAAAAGAAACCCGTGATCAATTTAAAATCTAATGCCCTCTGGGATGAGTCTGATGACAGTAACTC
AGAAATTGAGGCTGCTTTACGCCCCAGAAACCATAACACCGATGATTCTGATGATTTTTATGACTAACGT
GCTGTGACATTGGTTTCAAATAAAGTCTTTAAACAAACTAAAAAAAAAAAAAAAAA
```

FIGURE 359
SEQ ID NO: 351
Genbank ID      : NM_021255.1
Unigene ID(#167) : Hs.44038
Unigene name    :       pellino homolog 2 (Drosophila)      PELI2
>gi|10864062|ref|NM_021255.1| Homo sapiens pellino homolog 2 (Drosophila)
(PELI
2), mRNA

```
CAGCCACGACGGAGCAGCAGCGGGACTGGCCGCCCCGCGCCCCTTCGCCGCCGTGCCCTTCCCCGGCGC
GCTCACCCCGTTCTCGGGATGGGATTGTAGCGGCGGCGCGGACTCGGCGGGGATCGCGGCGGAGGCGGCG
GCGTCGGCGGCGGCGTCGGCGGCCGAGCGGGGCTCCATGTTTTCCCCTGGCCAGGAGGAACACTGCGCCC
CCAATAAGGAGCCAGTGAAATACGGGGAGCTGGTGGTGCTCGGGTACAATGGTGCTTTACCCAATGGAGA
TAGAGGACGGAGGAAAAGTAGATTTGCCCTCTACAAGCGGCCCAAGGCAAATGGTGTCAAACCCAGCACC
```

FIGURE 359 cont'd

GTCCATGTGATATCCACGCCCCAGGCATCCAAGGCTATCAGCTGCAAAGGTCAACACAGTATATCCTACA
CTTTGTCAAGGAATCAGACTGTGGTGGTGGAGTACACACATGATAAGGATACGGATATGTTTCAGGTGGG
CAGATCAACAGAAAGCCCTATCGACTTCGTTGTCACAGACACGATTTCTGGCAGCCAGAACACGGACGAA
GCCCAGATCACACAGAGCACCATATCCAGGTTCGCCTGCAGGATCGTGTGCGACAGGAATGAACCTTACA
CAGCACGGATATTCGCCGCCGGATTTGACTCTTCCAAAAACATATTTCTTGGAGAAAAGGCAGCAAAGTG
GAAAAACCCCGACGGCCACATGGATGGGCTCACTACTAATGGCGTCCTGGTGATGCATCCACGAGGGGGC
TTCACCGAGGAGTCCCAGCCCGGGGTCTGGCGCGAGATCTCTGTCTGTGGAGATGTGTACACCTTGCGAG
AAACCAGGTCGGCCCAGCAACGAGGAAAGCTGGTGGAAAGTGAGACCAACGTCCTGCAGGACGGCTCCCT
CATTGACCTGTGTGTGGGGCCACTCTCCTCTGGAGAACAGCAGATGGGCTTTTTCATACTCCAACTCAGAAG
CACATAGAAGCCCTCCGGCAGGAGATTAACGCCGCCCGGCCTCAGTGTCCTGTGGGGCTCAACACCCTGG
CCTTCCCCAGCATCAACAGGAAAGAGGTGGTGGAGGAGAAGCAGCCCTGGGCATATCTCAGTTGTGGCCA
CGTGCACGGGTACCACAACTGGGGCCATCGGAGTGACACGGAGGCCAACGAGAGGGAGTGTCCCATGTGC
AGGACTGTGGGCCCTATGTGCCTCTCTGGCTTGGCTGTGAGGCAGGATTTTATGTAGACGCAGGACCGC
CAACTCATGCTTTCACTCCCTGTGGACACGTGTGCTCGGAGAAGTCTGCAAAATACTGGTCTCAGATCCC
GTTGCCTCATGGAACTCATGCATTTCACGCTGCTTGCCCTTTCTGTGCTACACAGCTGGTTGGGGAGCAA
AACTGCATCAAATTAATTTTCCAAGGTCCAATTGACTGACGCCCTTGACAGCCATCTACGACTTTATTAA
CAGGTTACTGTGAAGATTTTGCCACTAACTCTAGATTTTACCTTTTTGTAATGCTGTTTATCAGAGGAGG
GTGACAGGGGCTGGAAATAAAGAGAGGGGACATGGTGATGAAACATGGCAGGAGTGTAACAGATACCAGT
GGTGTGTTGCATGCTCAAAACAGCAGCGTCGTCATTGAAGTCTGCTTGATCCAACCATAATATCTTTGTA
ATAATTGGATTTAAAATGCTATGCTTCTATTTTTAACCTTGGGTTTTTAACCAAGTTTTTTTTTTTTTT
GTAATCTTGGACAAGACTTTAAATCATATTTTACAGATGTAGAAGAAATTTATTCAAAAGTGTGGGCTCA
TGAAGTTCACTTCAGTGCAGTGTGGTGTAGGTGTTACGCGAAGGGCGCACAGTGTCTAGAAATACTTGAT
CGTGGCTCAAACCTGACCAGACAGCAGAGGGGCGGCTCTGTACAGTGTGACTGGTGGACAGATGGCCTTA
GGCACAGGTGGTTTTGAAATCTGGGCTTTTTCTGATTTATTTTCTGACTTGTTGGGGGAGAGAATATT
CATAACTTGTGGGCTTTTTTTTTTTAACTTCAGTGGAATTTACTTTAGATATTCATTCATCAAATACA
TGGGACTTCACAAACAATTTTCCATAACTTTTTAGCCTGTCTTTTGTTATTTCTGCCTAATATGATTTGC
CCCGATACTCATCTTGCACGGCCAGAACTGTTTGGTTGATTAAAATACATCAGCTCTTAAAAACTCATTA
ACTGAGGGTAATTACAGTAGTAGACATGGTCTGGGTACTATACTACCATGTTTATTTGCTGACTGAATTA
AGATTTAAGAATGATTAAAAATAAGCTTTTACTTTTTAAAACCACTTGAGGTTTCATAAAGCTTGGGGTT
TTTTTTTTCCTTTGTTAAGAAAGCCAACCAATCACAATGATATAGTCATTGTTGTGCACTCCCTTTTCA
CCATCTGTCACCTTCCCTTGCAGCTTAAGGAGCCCAGTAAGTTTTGAAAATGTTTGCGAATCAAACTAAA
TTTAAGTGGGATGATTAGATATACACAACACCAAGTGGTACATCTGCAGAGATAATTCAAAATTCCTGCT
TTTGAGAGAGCAAATGAGTGTTTGCTGAGGAATAATTAAATGAGAATTTCATAGGAGCTCCACCATTCCT
GTTACTTTCATTTCATTTTGATTAATAATTCTTGGATGCTTGGCATCGATCGTATCACTGCTCCTAGAAG
GTAAAGATCCTTTAGGACATGAGACTGGTAGAAGCTGGCTGAGATAAAATAAGTATTTATTTAAACTAAT
GTTCTCTTAATTTGACCATTGCAGATTTGGGTGACTTTTTTTTAACCTTTGTACATATACGTAATTTATA
TGATTCTAATGTACTATATCCATACTTGAATTGGTTTTTTCGTATTTTGCCTACTGGCAAATATTTTGCC
TATTTTCAGTCGTTCTAACCTATTTGAATACGCTTTTCCTTAAAGTGATACGATAATATTACTCTTGATT
GCTGCTGCTTAATTTGATGTAATATGTTTAAAGTTCAGCCTCTCAGTTTTAATATAGCTTTATTTTTCAG
TGGAGATCATTGTTTAGGATGAGACATTTTTGGTTTTGGTTTTGTTTGGGTAAATTTTAAATGGTGTGAA
AATCGATGACAACAGTCCTCTTACAGATAGCTTGCTGTATTCTGTATAGCTTACTCTACCTGCAGACAGA
AAATGAAAGAAAAAATGGACTTGCCTAGAATAATATATTGAATGCCTTTTGATTTAGCCAGAGTCTCTG
ATGATTAGCTTTCGCTGATAGAGTATGTCTTTTCAGCCTGTAATTCTTTGGGCCCCAAAGAATGACAAAG
GAGGCACTCGTTCTCTTTTCTTGCTGTATGCCTAGAAAGTGGTTGAAGGATTCTTGATGCCCTAAAACCA
TCTTGTAAGCTAAATGGTCTTGCATCCAGAAAGGCCAGATTTTACCTACCAAGAAAAAAGATATTTTTC
CAGAGAGTTAGGTATATCATAATTTTCCATTTCAAGTCCTGTTTATAAGTCTAGTCATTCTGCAACGTGA
CATATCCCCCAAAATGAAGTTACCTTCCAAGTTGGACACGTCCCGTAGTTGGGCATATGTCTAACTAAAA
GTTTCTGACTTTTAGTAAATTCAGCTTAAATATAAGTTGAAATTTGGGAAATAATTTCCAAGCTCTTGGA
AGGGGTAACAGTGAACCGCCCTCCATGGGCTCCACATCTTTTCCTTTGGCTTCCAAAGTCAGGTCCCGCC
CACCCTGCCTAAGGAACTGCAGAGAGGTGGCAAATCAGCAAAAGGACACCAGGCTCTTCTTGGCCACTT
GTAGGAAGATCCCTTTACAATTTTGACTAAGGAGATTTTTTTTTTCACAGTTGAGTTAGTTTGTGAAAAT
AAAGAACTCTGTAGCTCACCAAGGTGGAGAAACGCAATTCAGAAAGTAATTTCTCCAAGGTCACTTCTT
TTTTTATGTCTTGCCATCACTTTAAAGGACTAGCCCCACTCCCCATGTGTATACACAAGGAAATTGCAG
ACCAATTAGTTGTCTTGGCCTGACTCTAATGCCTTTTGCAAGTAGCTTTCCAGAAGTAAAAGTCCCAGTG
ATGTATTCCCATAGAAATATTTTTCAGTTGTTTATGTCGTTTACTACAAAAAAAAAGATTCAGAGTGGAT
GGAGTACAACTCTGAGTATTTTTCTAGTCCGGAATTTTTTATTAATAATCGGTGCTGCCGGGTCATGCAT
GCTGCAACTCTCAACATTTCCCTTATTTGGTTCAGCTTTTAGCAAAAAGGGCTACAGTTCACCCTGCAGA
GTATTAAGGTTTCTGGATTTTTTTCTCCCAACTGTGGCCCAAAAGAATTAAAATCTGTTAATATAAATAG
AGAACATATTTATCATTCCTCGATAGTTAATTATAGACTTTGGTACCTTTGTGCCTCAGGGAAGCCACGT
GATATAACTGGTTATAGAATTTCAGGGTTAGGGTTTAAAGAAAGGAGAAAGCCATTGGAAAAATGATGGG
CTCCATTAAGGAGACTAATGAATCTGGATGCAGAAATATGTCAGAAACTGGCATAAACATGATTGTAGTA

FIGURE 359 cont'd

```
GAATTTATTTTCCAGTACCAATAGGGAAATTATTTTAAGTTATTACATTTACTGTATTGGGAAACTTGAG
GAGAACTCTTTAGTTCATAAAGCTTCAATGTCTTTTTTTTTTTTTTCATGGAAAAACTCAAACCTCTGT
TATTTGGGAGCTCAGTATTGTGTGGACACTTACGAGAGTTTTCTGCTTAATTGAAGTGTAATATAGGTTG
TAGAATTGTTACCTGCAGTTCTATGGTTTTGTTTCACTTCTTTTCTTTTTTAAAGCCATTCTGTTCTTTG
GATGTGCTTGAAAGGGTGTGTGATTACACCATTGTTAATGCTGGGTAAAAACTATCTTCTTGCAGCCTTG
CCTCATAACAGTGGAATTTCTGATAGACAAACCACAGGACTTTGATTTTAAGCCAAATCCATCTCCATCC
CTTTACTGTCAATCTTCTGTCCCAGTAGTTTAGCCTTTGTGGCTTAGGTTATGATGCGCCTCCTTCTGTG
CGACCAATGAGACGACTTCAGCATCTTTTTAAAATAATCTAAGCATCATTGAAGCAGTAACACAAAAAAA
AGGTTCAGTATTTTCTTTTTAGTATAACTTACATCCTTTCAAATAAGTCTTTGCCCTCATGAAGAATCCC
TAGAGGAAGATAAGGAAAATAAGTATTTTCCAGTTTTGCTTGACAGTTTCTAAACAAACAAAAATAAACT
CAATGAAAGGAAAGATGTTTCTTTTTAGCTGAGATGACAGATTGCTTCTCTGTATTAAATAGTCTAGAAG
TTAAGGGGATGGTCACATTTACCATGTATTGTGTTATTAGCAGTTAAATTTTATGAATATGTTTGTAAAA
TTGTTGTTTTATATTTCATGTCAAATTGAAAAGTTTATTTCTTCACTATTGTACCTGTGGAAATACAAGC
CATTTTACAGGAAAAAATCTTCAAAAACTATTAAATGGATATCAGCCTGAAAAAAAAAAAAAAAAAG
```

FIGURE 360
SEQ ID NO: 352
Genbank ID       : NM_025094.1
Unigene ID(#167) : acc_NM_025094.1
Unigene name     :
>gi|13376655|ref|NM_025094.1| Homo sapiens hypothetical protein FLJ22184 (FLJ22
184), mRNA

```
CCCTAAGCTCACCCCTGACCATACACCCTCTGCAGGCGCTATCTTCTCTGGCCTCCCACTCTCCTCAGGC
ACCTCTCTCTTCCCTGATCATGCCCCCTCTGGAGACCCAATCTTCCCTAGCCCCACCCTCTCTGCAGACA
CCTCCTGCTTCCCTGACCACACCCCTCTGGAGAACCTACCTTCTCTAGCCCCGCCTCCTCTGCAGACAG
CTTCTGCTCCCTGACCACACCCCATCTGGAGACTCCACCTTGTCCAGCCCCATGCCCTCTGCAAGCACC
ACCTTCGCCATTGACCACGCCCCCTCCGGAGACGCCCTCTTCCATAGCCACGCCTCCTCCACAGGCCCCA
CCTGCTCTGGCCTCACCCCCTTTGCAGGGCCTGCCCTCTCCCCCTCTGTCTCCTTTGGCCACGCCCCCTC
CACAGGCCCCACCTGCCCTGGCCTTGCCTCCTCTGCAGGCCCCTCCCTCTCCCCCTGCCTCACCCCCTCT
GTCTCCTTTGGCCACACCCTCTCCACAGGCCCCAAATGCTCTGGCAGTGCACCTTCTGCAGGCCCCTTTC
TCTCCCCCTCCCTCACCCCCAGTGCAGGCCCCTTTCTCTCCCCCTGCCTCACCCCCAGTGTCTCCTTCGG
CCACGCCCCCTTCACAGGCCCCCACCCTCTGCAGCGCACCTCCTCTGCAGGTCCCACCCTCTCCCCCTGC
CTCTCCCCCAATGTCTCCTTCAGCCACGCCCCCTCCACAGGCCCCACCCCCTCTCGCTGCGCCTCCTCTG
CAGGTCCCACCCTCTCCCCCTGCCTCTCCCCAATGTCTCCTTCGGCCACGCCCCCTCCACGGGTCCCAC
CCCTTCTTGCCGCTCCTCCTCTGCAGGTCCCGCCCTCTCCCCCTGCCTCACTCCCAATGTCTCCTTTGGC
TAAGCCCCCTCCACAGGCCCCACCTGCTCTGGCCACACCTCCTCTGCAGGCCCTTCCCTCTCCGCCTGCC
TCATTCCCTGGGCAGGCCCCTTTCTCACCCTCTGCCTCACTCCCAATGTCTCCTTTGGCCACGCCTCCTC
CACAGGCCCCACCTGTTCTGGCAGCGCCCCTTCTGCAGGTCCCTCCCTCTCCCCCTGCCTCACCCACCCT
GCAGGCCCCACGCCGCCCCCCGACCCGGGTCCGGATACCTCCGTCTCGGGCCCACGGCTGACCCTGGCG
TTGGCCCCCGGCCCGCCGCCGCCGCCCTCGCGCAGCCCGTCCAGCACGCTGAGCGGCCCAGACCTGGCCG
GCCACAGCAGCAGCGCCACGAGCACGCCAGAGGAGCTGCGTGGCTACGACAGCGGGCCCGAGGGCGGTGC
CGCAGCCTCCCCGCCCCCGACGCAGAGCTCGCCGCTTGCCACCCGGCTGCCTGGAGTCGAGGCCCCGCT
CCGCCGCCGGCTTTCCGCGGAGCCCCAGGTGCGCCCCTGCCGTGGCCTCCCGCTACCGGACCGGGCTCTG
CTGACGGTCTGTGCACCATCTACGAGACTGAAGGGCCCGAGTCGGCGACCCCCGCCCCTGGCGCACTGGA
TCCGGGGCCCAGTCCCGGCACGAGCGGTGGGAAGGCGGCGGCTGGGGCCGGGGCCGGGCGTCCTCGCGG
AGCCCGAAGCAGGCGCGCCTGGGCGAGCTGCCACTGGGGGCGCTGCAGGCGAGCGTCGTGCAGCACCTGC
TGAGCCGGACGCTGCTGCTGGCGGCTGCCGAGGGTGCCGCGGGCGGCAGCGGCGGGGGCCCAGGAGGTGC
GGAGGGTGGTGGCGTCACAGGGGGCGCCCGGGCTGCACTCAGCGACGCCGAACTCGGCCGCTGGGCCGAA
CTACTGTCTCCCCTGGACGAGTCCCGTGCCAGCATCACCTCGGTCACCAGCTTCTCTCCGGACGACGTGG
CCTCCCCGCAGGGTGACTGGACCGTGGTGGAGGTGGAGACCTTCCACTGAGCCAGACCACAGCCCCGCCT
GCTACACCCCACCCCTGCCTTAGGATCCGCCCCTCCGGGTACGCCGTTTGTTTTAGACCCCGCCTCCACT
GCCCTGGAGCCCCGCTGGGTGGATTAGTCTTAGCTCCCTAGAGCCTGAGCCTTTGGCCTCGGAGGCTCGG
GACCTACCCATAGCTTTGACCTAGGCCCGCCCCTCGAGCTCCGCCCCTTTGGCCTAGGACACGCCCCGTT
TCCCCGAGTCCCGCCCCGTGTGCAGTGTATTGCCCACCCCGCACAGCCTGAGTTTGCAATAAAACTGGGA
CACTGGGACTTGCAAAAAAAAAAAAAAAAAAAAA
```

FIGURE 361
SEQ ID NO: 353
Genbank ID         : AI807356
Unigene ID(#167)   : Hs.127797
Unigene name       :       CDNA FLJ11381 fis, clone HEMBA1000501.
>gi|5393922|gb|AI807356.1|AI807356   wf47c03.x1   Soares_NFL_T_GBC_S1   Homo sapiens
cDNA clone IMAGE:2358724 3', mRNA sequence
TACATGTATCACTTAATCCTCACAACCACCTGAGGATTAATGGCATTTACCTGTTTTACAGATAAGGAAA
ACAATCATTTTTCAATTATGACTATGCCCCCAAACACTGGTTTGGATGGAGCCTTCACTGGTATAGAGAA
TGACCTTCTTCCCTTAGACTAGACTCTGGCTATAATAAAGGATGGTTTAATCATCCCCTGAAGCAATGCA
TAAGATAATCTGCAATGTATCTTCACATACTGTACCTTATTTGATAGGCAAGAGACCCATAAAGGAAGCT
GAGCATGGATTATCAGCTTCATCACAAATCTGAAGAAACTGACATTTATGTTATGTTGCCTTACCCAAGT
TGGGACATCAGAGCAGCAACTAAAATCCAGGTCTTCTTCCTATTACATGCCGTAAAAGGTATTGTTTCTT
TCCCTCCCCTCAAAATTTTCAGTCAAATGTCAGCTTTTAGGAAGAGCCAATCACTCTGAACTAGAATTGT
TCTCTTCACTTAAAATTTCTCAAGCCTAACTTCTTTTTGGGTCCTACAAGCCGGGAAAATACCTCAGAAT
TGGAACCACATGTNTACAGTATAAGAAATGACACAAGTGTGACT

FIGURE 362
SEQ ID NO: 354
Genbank ID         : AV699353
Unigene ID(#167)   : Hs.443428
Unigene name       :       adenylate cyclase 4       ADCY4
>gi|10301324|gb|AV699353.1|AV699353  AV699353  GKC Homo sapiens cDNA clone GKCDJC
06 3', mRNA sequence
AACCCTGGGCTCCAGACACCCCAGAGTCTCTTTATTGAGGTTCTTAGAAGGCGAGTGCAATCTCAGCCTA
TGGTAACTGAAGGAGGTCCAGTTCGTGTTAAGTCTGTGTTCAGGAAGTAGGTGCAGAGCTGCCCTTTGCC
TTTCACCTTGATGACACCCCGGCTGTAGCAGGTGTAGCCCACGGACTGTAAGGCCCATGCTGTCTCCTCA
GTCACTTGGATTTTGCCAAGGACTCCTGTACTCTCCATGCGGCTGGCCACGTTCACTGCGTTGCCCCAAA
TGTCATATTGCGGTTTCTGGGCCCCAATAACTCCAGCTACTACGGGTCCATGGTTCAACCCCACTCGCAA
GCGGAAGTTGGTGAATGAATGCTTGTTGATGACGTCCAGCTTAGACCCCAGGGCCACGGCAAATTCCACC
ATAGTGCCAAGGTGGCTGCAGCTCCGTTCAGCATTCTGGTGTGCATTCTGTTCAGAGGTTGCATTTAAGC
CTGTGGCTTGCATGTATGTGCTGCCGATGGTCTTGATCTTCTCCACCCCACTGAACTTGGGCTTGGAGAG
CAGCTCATCAAAAATAGCCATTATCTTATTTGGGCAGCCTAAACCACTTTATGCCCTATGATTGATGTNG
GATTCAGAGTAGAACTCCTTGAAGTCTGGGACTGAGCGCAAA

FIGURE 363
SEQ ID NO: 355
Genbank ID         : NM_004856.3
Unigene ID(#167)   : Hs.270845
Unigene name       :       kinesin family member 23       KIF23
>gi|13699831|ref|NM_004856.3|  Homo sapiens kinesin-like 5 (mitotic kinesin-like
 protein 1) (KNSL5), mRNA
GCAGAGCACCGCGCCTTAGCCGCGAAGTTCTAGTTCTTGCTGCCGGTCCTAACGTCCCGCAGTCTTCGCC
AGCCAGCCGTCCCGCATGCGCGTTTGGGCGGCGTGGAGCCTGCTGCCATGAAGTCAGCGAGAGCTAAGAC
ACCCCGGAAACCTACCGTGAAAAAGGGTCCCAAACGAACCTTAAAGACCCAGTTGGGGTATACTGTAGG
GTGCGCCCACTGGGCTTTCCTGATCAAGAGTGTTGCATAGAAGTGATCAATAATACAACTGTTCAGCTTC
ATACTCCTGAGGGCTACAGACTCAACCGAAATGGAGACTATAAGGAGACTCAGTATTCATTTAAACAAGT
ATTTGGCACTCACACCACCCAGAAGGAACTCTTTGATGTTGTGGCTAATCCCTTGGTCAATGACCTCATT
CATGGCAAAAATGGTCTTCTTTTTACATATGGTGTGACGGGAAGTGGAAAAACTCACACAATGACTGGTT
CTCCAGGGGAAGGAGGGCTGCTTCCTCGTTGTTTGGACATGATCTTTAACAGTATAGGGTCATTTCAAGC
TAAACGATATGTTTTCAAATCTAATGATAGGAATAGTATGGATATACAGTGTGAGGTTGATGCCTTATTA
GAACGTCAGAAAAGAGAAGCTATGCCCAATCCAAAGACTTCTTCTAGCAAACGACAAGTAGATCCAGAGT
TTGCAGATATGATAACTGTACAAGAATTCTGCAAAGCAGAAGAGGTTGATGAAGATAGTGTCTATGGTGT
ATTTGTCTCTTATATTGAAATATATAATAATTACATATATGATCTATTGGAAGAGGTGCCGTTTGATCCC
ATAAAACCCAAACCTCCACAATCTAAATTGCTTCGTGAAGATAAGAACCATAACATGTATGTTGCAGGAT

FIGURE 363 cont'd

```
GTACAGAAGTTGAAGTGAAATCTACTGAGGAGGCTTTTGAAGTTTTCTGGAGAGGCCAGAAAAAGAGACG
TATTGCTAATACCCATTTGAATCGTGAGTCCAGCCGTTCCCATAGCGTGTTCAACATTAAATTAGTTCAG
GCTCCCTTGGATGCAGATGGAGACAATGTCTTACAGGAAAAAGAACAAATCACTATAAGTCAGTTGTCCT
TGGTAGATCTTGCTGGAAGTGAAAGAACTAACCGGACCAGAGCAGAAGGGAACAGATTACGTGAAGCTGG
TAATATTAATCAGTCACTAATGACGCTAAGAACATGTATGGATGTCCTAAGAGAGAACCAAATGTATGGA
ACTAACAAGATGGTTCCATATCGAGATTCAAAGTTAACCCATCTGTTCAAGAACTACTTTGATGGGAAG
GAAAAGTGCGGATGATCGTGTGTGTGAACCCCAAGGCTGAAGATTATGAAGAAAACTTGCAAGTCATGAG
ATTTGCGGAAGTGACTCAAGAAGTTGAAGTAGCAAGACCTGTAGACAAGGCAATATGTGGTTTAACGCCT
GGGAGGAGATACAGAAACCAGCCTCGAGGTCCAGTTGGAAATGAACCATTGGTTACTGACGTGGTTTTGC
AGAGTTTTCCACCTTTGCCGTCATGCGAAATTTTGGATATCAACGATGAGCAGACACTTCCAAGGCTGAT
TGAAGCCTTAGAGAAACGACATAACTTACGACAAATGATGATTGATGAGTTTAACAAACAATCTAATGCT
TTTAAAGCTTTGTTACAAGAATTTGACAATGCTGTTTTAAGTAAAGAAAACCACATGCAAGGGAAACTAA
ATGAAAAGGAGAAGATGATCTCAGGACAGAAATTGGAAATAGAACGACTGGAAAAGAAAAACAAAACTTT
AGAATATAAGATTGAGATTTTAGAGAAAACAACTACTATCTATGAGGAAGATAAACGCAATTTGCAACAG
GAACTTGAAACTCAGAACCAGAAACTTCAGCGACAGTTTTCTGACAAACGCAGATTAGAAGCCAGGTTGC
AAGGCATGGTGACAGAAACGACAATGAAGTGGGAGAAAGAATGTGAGCGTAGAGTGGCAGCCAAACAGCT
GGAGATGCAGAATAAACTCTGGGTTAAAGATGAAAAGCTGAAACAACTGAAGGCTATTGTTACTGAACCT
AAAACTGAGAAGCCAGAGAGACCCTCTCGGGAGCGAGATCGAGAAAAAGTTACTCAAAGATCTGTTTCTC
CATCACCTGTGCCTTTACTCTTTCAACCTGATCAGAACGCACCACCAATTCGTCTCCGACACAGACGATC
ACGCTCTGCAGGAGACAGATGGGTAGATCATAAGCCCGCCTCTAACATGCAAACTGAAACAGTCATGCAG
CCACATGTCCCTCATGCCATCACAGTATCTGTTCAAATGAAAAGGCACTAGCTAAGTGTGAGAAGTACA
TGCTGACCCACCAGGAACTAGCCTCCGATGGGGAGATTGAAACTAAACTAATTAAGGGTGATATTTATAA
AACAAGGGGTGGTGGACAATCTGTTCAGTTTACTGATATTGAGACTTTAAAGCAAGAATCACCAAATGGT
AGTCGAAAACGAAGATCTTCCACAGTAGCACCTGCCCAACCAGATGGTGCAGAGTCTGAATGGACCGATG
TAGAAACAAGGTGTTCTGTGGCTGTGGAGATGAGAGCAGGATCCCAGCTGGGACCTGGATATCAGCATCA
CGCACAACCCAAGCGCAAAAAGCCATGAACTGACAGTCCCAGTACTGAAAGAACATTTTCATTTGTGTGG
ATGATTTCTCGAAAGCCATGCCAGAAGCAGTCTTCCAGGTCATCTTGTAGAACTCCAGCTTTGTTGAAAA
TCACGGACCTCAGCTACATCATACACTGACCCAGAGCAAAGCTTTCCCTATGGTTCAAAGACAACTAGTA
TTCAACAAACCTTGTATAGTGTATGTTTTGCCATATTTAATATTAATAGCAGAGGAAGACTCCTTTTTTC
ATCACTGTATGAATTTTTTATAATGTTTTTTTAAAATATATTTCATGTATACTTATAAACTAATTCACAC
AAGTGTTTGTCTTAGATGATTAAGGAAGACTATATCTAGATCATGTCTGATTTTTTATTGTGACTTCTCC
AGCCCTGGTCTGAATTTCTTAAGGTTTTATAAACAAATGTCTGTATTTATTAGCTGCAAGAATGCACTTT
AGAACTATTTGACAATTCAGACTTTCAAAATAAAGATGTAAATGACTGGCCAATAATAACCATTTTAGGA
AGGTGTTTTGAATTCTGTATGTATATATTCACTTTCTGACATTTAGATATGCCAAAAGAATTAAAATCAA
AAGCCCTAAGAAATAAAAAAAAAAAAAAAAAAAA
```

FIGURE 364
SEQ ID NO: 356
Genbank ID        : AI968904
Unigene ID(#167)  : Hs.174373
Unigene name      :       hypothetical protein LOC349136        LOC349136
>gi|5765722|gb|AI968904.1|AI968904  wq67e12.x1  NCI_CGAP_GC6  Homo  sapiens cDNA cl
one IMAGE:2476366 3', mRNA sequence

```
TTTCACTTTTAACGCTCAGGCTGTATATTTCAGTTCCCCCCAAGGCCCTCGAGACGGACGATTTGCCAAA
ATAACCAGGTTCAGTGGCTTCTGTAAAAAGTCACTTCCTCTCAGCAGGAAAGGCCCAGTTTCGTGGGGCT
GGGGGAGCTGGGGCAGTCCGCCTGCAGCCCCTGAGGTGGGAAGGGTCCCCAGGACTAGGCCTTTCCCAGC
GGGNGNATTGGGGAGGGGAGGGACAGGAGCCACCTTAAAAGGGAAAAGGGGGGCGGTCCCCAGGGCGAGC
ACTCCCGCT
```

FIGURE 365
SEQ ID NO: 357
Genbank ID        : NM_024036.1
Unigene ID(#167)  : Hs.148438
Unigene name      :       leucine rich repeat and fibronectin type III domain containing 4        LRFN4
>gi|13128987|ref|NM_024036.1|  Homo  sapiens  hypothetical  protein  MGC3103 (MGC310

FIGURE 365 cont'd

3), mRNA
CGCGCCTACCATGCACTGGGTCGGTCCTGACGACCGGTTGGTTGGCAACTCCTCCCGAGCCCGGGCTTTC
CCCAACGGGACCTTAGAGATTGGGGTGACCGGCGCTGGGGACGCTGGGGGCTACACCTGCATCGCCACCA
ACCCTGCTGGTGAGGCCACAGCCCGAGTAGAACTGCGGGTGCTGGCCTTGCCCCATGGTGGGAACAGCAG
TGCCGAGGGGGGCCGCCCGGGCCCTCGGACATCGCCGCCTCCGCTCGCACTGCTGCCGAGGGTGAGCGG
ACGCTGGAGTCTGAGCCAGCCGTGCAGGTGACGGAGGTGACCGCCACCTCAGGGCTGGTGAGCTGGGGTC
CCGGGCGGCCAGCCGACCCAGTGTGGATGTTCCAAATCCAGTACAACAGCAGCGAAGATGAGACCCTCAT
CTACCGGATTGTCCCAGCCTCCAGCCACCACTTCCTGCTGAAGCACCTCGTCCCCGGCGCTGACTATGAC
CTCTGCCTGCTGGCCTTGTCACCGGCCGCTGGGCCCTCTGACCTCACGGCCACCAGGCTGCTGGGCTGTG
CCCATTTCTCCACGCTGCCGGCCTCGCCCCTGTGCCACGCCCTGCAGGCCCACGTGCTGGGCGGGACCCT
GACCGTGGCCGTGGGGGGTGTGCTGGTGGCTGCCTTACTGGTCTTCACTGTGGCCTTGCTGGTTCGGGGC
CGGGGGGCCGGAAATGGCCGCCTCCCCCTCAAGCTCAGCCACGTCCAGTCCCAGACCAATGGAGGCCCCA
GCCCCACACCCAAGGCCCACCCGCCGCGGAGCCCCCGCCCCGGCCGCAGCGCAGCTGCTCTCTGGACCT
GGGAGATGCCGGGTGCTACGGTTATGCCAGGCGCCTGGGAGGAGCTTGGGCCCGACGGAGCCACTCTGTG
CATGGGGGCTGCTCGGGGCAGGGTGCCGGGGGGTAGGAGGCAGCGCCGAGCGGCTGGAAGAGAGTGTGG
TGTGATGGACGGGCAGCTTCCTGTGTGCTCCAAGGGATGAGCCTCGTGGGGCAGAGGGCCCGGGCCGCC
GCCTGGCCTGGGAGTCCCTCCCTGGTTTTTATTCTCAGTACCTCAGGCTCCCTGTGTACTTGGAGGGGC
AGGGAGCCCTTTCCTCGGTTCTGGCCTCCAGACCAGGGTAAGGGCAGGCCCCTCCAACAGGTGCTCACAG
CCACCGAGGCAGGGCTGCAGCCACCCACTGGGAGTCTTGTTTTTATTTATAATAAAATTGTTGGGGACA
CCTCAAAAAAAAAAAAAAAAAAAAAA

FIGURE 366
SEQ ID NO: 358
Genbank ID      : NM_005544.1
Unigene ID(#167) : Hs.390242
Unigene name    :       insulin receptor substrate 1   IRS1
>gi|5031804|ref|NM_005544.1|  Homo  sapiens  insulin  receptor  substrate  1
(IRS1),
mRNA
CGGCGGCGCGGTCGGAGGGGGCCGGCGCGCAGAGCCAGACGCCGCCGCTTGTTTTGGTTGGGGCTCTCGG
CAACTCTCCGAGGAGGAGGAGGAGGAGGGAGGGAGGGAGGGAGAAGTAACTGCAGCGGCAGCGCCCTCCCGAGG
AACAGGCGTCTTCCCCGAACCCTTCCCAAACCTCCCCATCCCTCTCGCCCTTGTCCCCTCCCCTCCTC
CCCAGCCGCCTGGAGCGAGGGGCAGGGATGAGTCTGTCCCTCCGGCCGGTCCCCAGCTGCAGTGGCTGCC
CGGTATCGTTTCGCATGGAAAAGCCACTTTCTCCACCCGCCGAGATGGGCCCGGATGGGGCTGCAGAGGA
CGCGCCCGCGGGCGGCGGCAGCAGCAGCAGCAGCAGCAGCAGCAACAGCAACAGCCGCAGCGCCGCGGTC
TCTGCGACTGAGCTGGTATTTGGGCGGCTGGTGGCGGCTGGGACGGTTGGGGGGTGGGAGGAGGCGAAGG
AGGAGGGAGAACCCCGTGCAACGTTGGGACTTGGCAACCCGCCTCCCCCTGCCCAAGGATATTTAATTTG
CCTCGGGAATCGCTGCTTCCAGAGGGGAACTCAGGAGGGAAGGCGCGCGCGCGCGCGCTCCTGGAGGG
GCACCGCAGGGACCCCCGACTGTCGCCTCCCTGTGCCGGACTCCAGCCGGGGCGACGAGAGATGCATCTT
CGCTCCTTCCTGGTGGCGGCGGCGGCTGAGAGGAGACTTGGCTCTCGGAGGATCGGGGCTGCCCTCACCC
CGGACGCACTGCCTCCCCGCCGGCGTGAAGCGCCCGAAAACTCCGGTCGGGCTCTCTCCTGGGCTCAGCA
GCTGCGTCCTCCTTCAGCTGCCCCTCCCCGGCGCGGGGGCGGCGTGGATTTCAGAGTCGGGGTTTCTGC
TGCCTCCAGCCCTGTTTGCATGTGCCGGGCCGCGGCGAGGAGCCTCCGCCCCCCACCCGGTTGTTTTCG
GAGCCTCCCTCTGCTCAGCGTTGGTGGTGGCGGTGGCAGCATGGCGAGCCTTCCGGAGAGCGATGGCTTC
TCGGACGTGCGCAAGGTGGGCTACCTGCGCAAACCCAAGAGCATGCACAAACGCTTCTTCGTACTGCGCG
CGGCCAGCGAGGCTGGGGCCCGGCGCGCCTCGAGTACTACGAGAACGAGAAGAAGTGGCGGCACAAGTC
GAGCGCCCCAAACGCTCGATCCCCCTTGAGAGCTGCTTCAACATCAACAAGCGGGCTGACTCCAAGAAC
AAGCACCTGGTGGCTCTCTACACCGGGACGAGCACTTTGCCATCGCGGCGGACAGCGAGGCCGAGCAAG
ACAGCTGGTACCAGGCTCTCCTACAGCTGCACAACCGTGCTAAGGGCACCACGACGGAGCTGCGGCCCT
CGGGGCGGGAGGTGGTGGGGGCAGCTGCAGCGGCAGCTCCGGCCTTGGTGAGGCTGGGGAGGACTTGAGC
TACGGTGACGTGCCCCCAGGACCCGCATTCAAAGAGGTCTGGCAAGTGATCCTGAAGCCCAAGGGCCTGG
GTCAGACAAAGAACCTGATTGGTATCTACCGCCTTTGCCTGACCAGCAAGACCATCAGCTTCGTGAAGCT
GAACTCGGAGGCAGCGGCCGTGGTGCTGCAGCTGATGAACATCAGGCGCTGTGGCCACTCGGAAAACTTC
TTCTTCATCGAGGTGGGCCGTTCTGCCGTGACGGGCCCGGGGGAGTTCTGGATGCAGGTGGATGACTCTG
TGGTGGCCCAGAACATGCACGAGACCATCCTGGAGGCCATGCGGGCCATGAGTGATGAGTTCCGCCCTCG
CAGCAAGAGCCAGTCCTCGTCCAACTGCTCTAACCCCATCAGCGTCCCCTGCGCCGGCACCATCTCAAC
AATCCCCGCCCAGCCAGGTGGGCTGACCCGCCGATCACGCACTGAGAGCATCACCGCCACCTCCCCGG
CCAGCATGGTGGGCGGGAAGCCAGGCTCCTTCCGTGTCCGCGCCTCCAGTGACGGCGAAGGCACCATGTC
CCGCCCAGCCTCGGTGGACGGCAGCCCTGTGAGTCCAGCACCAACAGAACCCACGCCCACCGGCATCGG
GGCAGCGCCCGGCTGCACCCCCGCTCAACCACAGCCGCTCCATCCCCATGCCGGCTTCCCGCTGCTCGC

FIGURE 366 cont'd

```
CTTCGGCCACCAGCCCGGTCAGTCTGTCGTCCAGTAGCACCAGTGGCCATGGCTCCACCTCGGATTGTCT
CTTCCCACGGCGATCTAGTGCTTCGGTGTCTGGTTCCCCAGCGATGGCGGTTTCATCTCCTCGGATGAG
TATGGCTCCAGTCCCTGCGATTTCCGGAGTTCCTTCCGCAGTGTCACTCCGGATTCCCTGGGCCACACCC
CACCAGCCCGCGGTGAGGAGGAGCTAAGCAACTATATCTGCATGGGTGGCAAGGGGCCCTCCACCCTGAC
CGCCCCCAACGGTCACTACATTTTGTCTCGGGGTGGCAATGGCCACCGCTGCACCCCAGGAACAGGCTTG
GGCACGAGTCCAGCCTTGGCTGGGGATGAAGCAGCCAGTGCTGCAGATCTGGATAATCGGTTCCGAAAGA
GAACTCACTCGGCAGGCACATCCCCTACCATTACCCACCAGAAGACCCCGTCCCAGTCCTCAGTGGCTTC
CATTGAGGAGTACACAGAGATGATGCCTGCCTACCCACCAGGAGGTGGCAGTGGAGGCCGACTGCCGGGA
CACAGGCACTCCGCCTTCGTGCCCACCCGCTCCTACCCAGAGGAGGGTCTGGAAATGCACCCCTTGGAGC
GTCGGGGGGGCACCACCGCCCAGACAGCTCCACCCTCCACACGGATGATGGCTACATGCCCATGTCCCC
AGGGGTGGCCCCAGTGCCCAGTGGCCGAAAGGGCAGTGGAGACTATATGCCCATGAGCCCCAAGAGCGTA
TCTGCCCCACAGCAGATCATCAATCCCATCAGACGCCATCCCCAGAGAGTGGACCCCAATGGCTACATGA
TGATGTCCCCCAGCGGTGGCTGCTCTCCTGACATTGGAGGTGGCCCCAGCAGCAGCAGCAGCAGCAGCAA
CGCCGTCCCTTCCGGGACCAGCTATGGAAAGCTGTGGACAAACGGGGTAGGGGGCCACCACTCTCATGTC
TTGCCTCACCCCAAACCCCAGTGGAGAGCAGCGGTGGTAAGCTCTTACCTTGCACAGGTGACTACATGA
ACATGTCACCAGTGGGGACTCCAACACCAGCAGCCCCTCCGACTGCTACTACGGCCCTGAGGACCCCCA
GCACAAGCCAGTCCTCTCCTACTACTCATTGCCAAGATCCTTTAAGCACACCCAGCGCCCCGGGGAGCCG
GAGGAGGGTGCCCGGCATCAGCACCTCCGCCTTTCCACTAGCTCTGGTCGCCTTCTCTATGCTGCAACAG
CAGATGATTCTTCCTCTTCCACCAGCAGCGACAGCCTGGGTGGGGATACTGCGGGCTAGGCTGGAGCC
CAGCCTTCCACATCCCCACCATCAGGTTCTGCAGCCCATCTGCCTCGAAAGGTGGACACAGCTGCTCAG
ACCAATAGCCGCCTGGCCCGGCCCACGAGGCTGTCCCTGGGGATCCCAAGGCCAGCACCTTACCTCGGG
CCCGAGAGCAGCAGCAGCAGCAGCAGCCCTTGCTGCACCCTCCAGAGCCCAAGAGCCCGGGGGAATATGT
CAATATTGAATTTGGGGAGTGATCAGTCTGGCTACTTGTCTGGCCCGGTGGCTTTCCACAGCTCACCTTCT
GTCAGGTGTCCATCCCAGCTCCAGCCAGCTCCCAGAGAGGAAGAGACTGGCACTGAGGAGTACATGAAGA
TGGACTGGGGCCGGGCCGGAGGGCAGCCTGGCAGGAGGCACTGGGGGTCGAGATGGGCAGACTGGGCCC
TGCACCTCCCGGGGCTGCTAGCATTTGCAGGCCTACCCGGGCAGTGCCCAGCAGCCGGGGTGACTACATG
ACCATGCAGATGAGTTGTCCCCGTCAGAGCTACGTGGACACCTCGCCAGCTGCCCCTGTAAGCTATGCTG
ACATGCGAACAGGCATTGCTGCAGAGGAGGTGAGCCTGCCCAGGGCCACCATGGCTGCTGCCTCCTCATC
CTCAGCAGCCTCTGCTTCCCCGACTGGGCCTCAAGGGGCAGCAGAGCTGGCTGCCCACTCGTCCCTGCTG
GGGGGCCCACAAGGACCTGGGGGCATGAGCGCCTTCACCCGGGTGAACCTCAGTCCTAACCGCAACCAGA
GTGCCAAAGTGATCCGTGCAGACCCACAAGGGTGCCGGCGGAGGCATAGCTCCGAGACTTTCTCCTCAAC
ACCCAGTGCCACCCGGGTGGGCAACACAGTGCCCTTGGAGCGGGGGCAGCAGTAGGGGCGGTGGCGGT
AGCAGCAGCAGCAGCGAGGATGTGAAACGCCACAGCTCTGCTTCCTTTGAGAATGTGTGGCTGAGGCCTG
GGGAGCTTGGGGGAGCCCCCAAGGAGCCAGCCAAACTGTGTGGGGCTGCTGGGGGTTTGGAGAATGGTCT
TAACTACATAGACCTGGATTTGGTCAAGGACTTCAAACAGTGCCCTCAGGAGTGCACCCCTGAACCGCAG
CCTCCCCCACCCCCACCCCCTCATCAACCCCTGGGCAGCGGTGAGAGCAGCTCCACCCGCCGCTCAAGTG
AGGATTTAAGCGCCTATGCCAGCATCAGTTTCCAGAAGCAGCCAGAGGACCGTCAGTAGCTCAACTGGAC
ATCACAGCAGAATGAAGACCTAAATGACCTCAGCAAATCCTCTTCTAACTCATGGGTACCCAGACTCTAA
ATATTTCATGATTCACAACTAGGACCTCATATCTTCCTCATCAGTAGATGGTACGATGCATCCATTTCAG
TTTGTTTACTTTATCCAATCCTCAGGATTTCATTGACTGAACTGCACGTTCTATATTGTGCCAAGCGAAA
AAAAAAAATGCACTGTGACACCAGAATAATGAGTCTGCATAAACTTCATCTTCAACCTTAAGGACTTAGC
TGGCCACAGTGAGCTGATGTGCCCACCACCGTGTCATGAGAGAATGGGTTTACTCTCAATGCATTTTCAA
GATACATTTCATCTGCTGCTGAAACTGTGTACGACAAAGCATCATTGTAAATTATTTCATACAAAACTGT
TCACGTTGGGTGGAGAGAGTATTAAATATTTAACATAGGTTTTGATTTATATGTGTAATTTTTTAAATGA
AAATGTAACTTTTCTTACAGCACATCTTTTTTTTGGATGTGGGATGGAGGTATACAATGTTCTGTTGTAA
AGAGTGGAGCAAATGCTTAAAACAAGGCTTAAAAGAGTAGAATAGGGTATGATCCTTGTTTTAAGATTGT
AATTCAGAAAACATAATATAAGAATCATAGTGCCATAGATGGTTCTCAATTGTATAGTTATATTTGCTGA
TACTATCTCTTGTCATATAAACCTGATGTTGAGCTGAGTTCCTTATAAGAATTAATCTTAATTTTGTATT
TTTTCCTGTAAGACAATAGGCCATGTTAATTAAACTGAAGAAGGATATATTTGGCTGGGTGTTTTCAAAT
GTCAGCTTAAAATTGGTAATTGAATGGAAGCAAAATTATAAGAAGAGGAAATTAAAGTCTTCCATTGCAT
GTATTGTAAACAGAAGGAGATGGGTGATTCCTTCAATTCAAAAGCTCTCTTTGGAATGAACAATGTGGGC
GTTTGTAAATTCTGGAAATGTCTTTCTATTCATAATAAACTAGATACTGTTGATCTTTTAAAAAAAAAAA
AAAAAAAAAAAAAAAAAA
```

FIGURE 367
SEQ ID NO: 359
Genbank ID      : AI870951
Unigene ID(#167) : Hs.445574
Unigene name    :     Transcribed sequence with weak    similarity to
protein pir:S41161 (H.sapiens) S41161 keratin 9, cytoskeletal - human FIGURE 367 cont'd \>gi|5544919|gb|AI870951.1|AI870951 w169g12.x1 NCI_CGAP_Brn25 Homo sapiens cDNA
clone IMAGE:2430214 3', mRNA sequence
TTTTAAAACAAACAAAACTTTTATGGTCCAAAACAGTTTTTCTCAAGAATCTGCTCTATGCAAACAATAA
CAACTTTTTACAAAGCATTTTCACAGAAAAGGAGACAAGTCCTTCCCCAGCGTGGGAATTGTTCCTCTCG
CACCTCGTTTTCGGGGGAAGAGGGGGCGCTATTCACTAGTGCGGGATGGAAGGCGCACTGGGTCCCTCAG
TTGTTCGGCAGCTCCAAAAGCCCCAGCTTCCCTTCATACCTCAACTTGCCATCTCCCTAAGACCTAAGCT
CCCCTGACCTCACCTGGGTGGAGGAGAAAGCACTTCCAATCCTCTCTGACTCAAGATCCTCCTAGCTGGA
GGGCATGGCAGAGGGCATGATCCAGGCCTATCTCACCCCTCCCCTGGAAAACAGAACCTCTGACCCCAAA
CCTAATCCCCTCG

FIGURE 368
SEQ ID NO: 360
Genbank ID        : NM_004101.1
Unigene ID(#167)  : Hs.42502
Unigene name      :     coagulation factor II (thrombin) receptor-like 2
    F2RL2
\>gi|4758325|ref|NM_004101.1| Homo sapiens coagulation factor II (thrombin) rece
ptor-like 2 (F2RL2), mRNA
CCTGCCTGCACGGCACAGGAGAGCAAACTTCTACAGACAGACCAAGGCTTCCATTTGCTGCTGACACATG
GAACTGAGGTGAAATTGTGCTCCATGATTTTACAGATTTCATAACGTTTAAGAGACGGGACTCAGGTCAT
CAAAATGAAAGCCCTCATCTTTGCAGCTGCTGGCCTCCTGCTTCTGTTGCCCACTTTTTGTCAGAGTGGC
ATGGAAAATGATACAAACAACTTGGCAAAGCCAACCTTACCCATTAAGACCTTTCGTGGAGCTCCCCCAA
ATTCTTTTGAAGAGTTCCCCTTTTCTGCCTTGGAAGGCTGGACAGGAGCCACGATTACTGTAAAAATTAA
GTGCCCTGAAGAAAGTGCTTCACATCTCCATGTGAAAAATGCTACCATGGGGTACCTGACCAGCTCCTTA
AGTACTAAACTGATACCTGCCATCTACCTCCTGGTGTTTGTAGTTGGTGTCCCGGCCAATGCTGTGACCC
TGTGGATGCTTTTCTTCAGGACCAGATCCATCTGTACCACTGTATTCTACACCAACCTGGCCATTGCAGA
TTTTCTTTTTTGTGTTACATTGCCCTTTAAGATAGCTTATCATCTCAATGGGAACAACTGGGTATTTGGA
GAGGTCCTGTGCCGGGCCACCACAGTCATCTTCTATGGCAACATGTACTGCTCCATTCTGCTCCTTGCCT
GCATCAGCATCAACCGCTACCTGGCCATCGTCCATCCTTTCACCTACCGGGGCCTGCCCAAGCACACCTA
TGCCTTGGTAACATGTGGACTGGTGTGGGCAACAGTTTTCTTATATATGCTGCCATTTTTCATACTGAAG
CAGGAATATTATCTTGTTCAGCCAGACATCACCACCTGCCATGATGTTCACAACATTGCGAGTCCTCAT
CTCCCTTCCAACTCTATTACTTCATCTCCTTGGCATTCTTTGGATTCTTAATTCCATTTGTGCTTATCAT
CTACTGCTATGCAGCCATCATCCGGACACTTAATGCATACGATCATAGATGGTTGTGGTATGTTAAGGCG
AGTCTCCTCATCCTTGTGATTTTTACCATTTGCTTTGCTCCAAGCAATATTATTCTTATTATTCACCATG
CTAACTACTACTACAACAACACTGATGGCTTATATTTATATATCTCATAGCTTTGTGCCTGGGTAGTCT
TAATAGTTGCTTAGATCCATTCCTTTATTTTCTCATGTCAAAAACCAGAAATCACTCCACTGCTTACCTT
ACAAAATAGTGAAATGATCTTAGAGAACAAGGACAGCCATCACAGAGAACGTCTGTTTCAAGAACAACA
TAAGCATAGTGCAAGGAGCTCCATTTCCGAGCTCCTAAGAAATATGCTTCAAAGGTCAAACATTACAAAA
GCATTAGTAGTTTGTTTGTTTGTTTTGAGACTGAGTCTCACTTTATCACCCAGACTGGCGTGCAGTGGC
ACTATCTTGGCTCATTGCAACCTCTGCCTCCCAGGTCAGCCTCCCAAGTAGCTGGGATTACACCACCATG
CCCAGCTACTAAAAATACTTGTATTTTTAGTAGAGACGGGGTTTCACCATGTTGACCAGGCTGGTCTTGA
ACTCCTGACCTCAAGTGATCTTCCGGCCTCAGCCTCCCAAAGTGCTGGATTACAGGCGTGAGCCACTGAG
CCAGCCAGCATTAGTAATTTTTAAAAACACTTTATCAGTATTTTAAAAATGTTAATGCAGGAGAAAAGAT
ATCACAACTCTATGGAAAATGACATTTCCATTTGCCTTATTGCTACTTCAAGCTCTTTAAATCACCATCT
TCCCTATTTC

FIGURE 369
SEQ ID NO: 361
Genbank ID        : AB011446.1
Unigene ID(#167)  : Hs.442658
Unigene name      :     aurora kinase B    AURKB
\>gi|5688865|dbj|AB011446.1| Homo sapiens mRNA for Aik2, complete cds
GAATTCGGCACGAAGGAGAGTAGCAGTGCCTTGGACCCCAGCTCTCCTCCCCTTTCTCTCTAAGGATGG
CCCAGAAGGAGAACTCCTACCCCTGGCCCTACGGCCGACAGACGGCTCCATCTGGCCTGAGCACCCTGCC
CCAGCGAGTCCTCCGGAAAGAGCCTGTCACCCCATCTGCACTTGTCCTCATGAGCCGCTCCAATGTCCAG
CCCACAGCTGCCCCTGGCCAGAAGGTGATGGAGAATAGCAGTGGGACACCCGACATCTTAACGCGGCACT

FIGURE 369 cont'd

```
TCACAATTGATGACTTTGAGATTGGGCGTCCTCTGGGCAAAGGCAAGTTTGGAAACGTGTACTTGGCTCG
GGAGAAGAAAAGCCATTTCATCGTGGCGCTCAAGGTCCTCTTCAAGTCCCAGATAGAGAAGGAGGGCGTG
GAGCATCAGCTGCGCAGAGAGATCGAAATCCAGGCCCACCTGCACCATCCCAACATCCTGCGTCTCTACA
ACTATTTTTATGACCGGAGGAGGATCTACTTGATTCTAGAGTATGCCCCCCGCGGGGAGCTCTACAAGGA
GCTGCAGAAGAGCTGCACATTTGACGAGCAGCGAACAGCCACGATCATGGAGGAGTTGGCAGATGCTCTA
ATGTACTGCCATGGGAAGAAGGTGATTCACAGAGACATAAAGCCAGAAAATCTGCTCTTAGGGCTCAAGG
GAGAGCTGAAGATTGCTGACTTCGGCTGGTCTGTCCATGCGACCTCCCTGAGGAGGAAGACAATGTGTGG
CACCCTGGACTACCTGCCCCAGAGATGATTGAGGGCGCATCGACAATGAGAAGGTGGATCTGTGGTGC
ATTGGAGTGCTTTGCTATGAGCTGCTGGTGGGAACCCATTTGAGAGTGCATCACACAACGAGACCTATC
GCCGCATCGTCAAGGTGGACCTAAAGTTCCCCGCTTCTGTGCCCACGGGAGCCCAGGACCTCATCTCCAA
ACTGCTCAGGCATAACCCCTCGGAACGGCTGCCCCTGGCCCAGGTCTCAGCCCACCCTTGGGTCCGGGCC
AACTCTCGGAGGGTGCTGCCTCCCTCTGCCCTTCAATCTGTCGCCTGATGGTCCCTGTCATTCACTCGGG
TGCGTGTGTTTGTATGTCTGTGTATGTATAGGGGAAAGAAGGGATCC
```

FIGURE 370
SEQ ID NO: 362
Genbank ID          : AI141520
Unigene ID(#167)    : acc_AI141520
Unigene name        :
>gi|3648977|gb|AI141520.1|AI141520    qa90a03.x1    Soares_fetal_heart_NbHH19W  Homo s
apiens   cDNA   clone   IMAGE:1693996   3'   similar   to   contains   Alu   repetitive
element;c
ontains element MER22 MER22 repetitive element ;, mRNA sequence

```
TTTTTTTTTGTCAACACATGCATTTTGCTTTATTCATTTGCTTTATCTTATGGATCTCTCCATTTTGTAG
AGTATTCCATTGTATAGCTGTACAGTAATTTAGATAAACTTTTGTATTGATAGCCTTTTCTTTTGGAGAT
GGGGGTCTCACTCTGTCACTCAGGCTGGAGTGCAGTGGCACAATCACAGCTCACTGCAGCCTCAAGCTCC
TGGGCTCATGCCATCCTCCTGCCTCAGCCCCTGAGTAGCTGGGACAACAGGTGCATGCCACCATGCCTTG
CCGAGTTTTTGTATAGATGGGGTTTCACCATGTTGCCCAGGCTGGTCTTGAACTCTGGACTGGTCTGGAC
TTGAGATTCAGACCAGATCTGTAAGCCACTGCACCCGGCCTTGATAGCCATTTGTTTTCATACACAGCAG
CAATTAGTAGCCATTTAAGATATCTGTGCGCCAGCCTACAAGAAATACAAATGTACAGGGTAAAATCCTA
GCTGGATCAAATATGAGCTTTGTAAATTTTTAAAAACTTTTTTATTGAGTT
```

FIGURE 371
SEQ ID NO: 363
Genbank ID          : BG484769
Unigene ID(#167)    : Hs.115838
Unigene name        :       CDNA FLJ44282 fis, clone TRACH2003516
>gi|13417048|gb|BG484769.1|BG484769   602505658F1   NIH_MGC_77   Homo   sapiens
cDNA cl
one IMAGE:4619078 5', mRNA sequence

```
GCCCCTTCCCGTGATCTTCGTGGCTTCCCGCCCAGACGTGTGACCAAGATAGCAAGGAGCAGTCTTTAAG
GCGACACGGCAGAGAGGCAGAAAAAGATGGGCCTTACCGGTTAGTTAAGAAAAAAAGAGGACCTGTGCCT
GTCCCTCTAGCTTTGAACTACAAAGTGGAGGGGAAGTTGTCTGGATTTTCCTGTAGAACTGAGGGCAGGA
CAGGAGGCTCTGCCTGCAGTCAGCAACTTGGAATATTCAGACTTCAGACCAGCATCACAGATTATAACCC
TCCGTAAATCATCTGCATCCCAGCTCCCATCAAAAGCCAGCCTGAAGGACCCATGGACGATGTGACTCCAG
TGTTCTCAACAACATCTTAAGATCAAGTGGGTTTGCACAACATTTGCATCTACTTGGGACAAAGCAAGAA
CAATAAGGACAAAAAAAAAAAAAAAAAAAAAAAAAAATTTGGGGGGGGACAGGGGACCATTCAAGAG
GCTTTGAGAGAACAACTGGTGGGGACCGCAGGCCCAGAAGGATAAGAGCAACACGTGGCCACAGAGGGAC
CACGGGAAAACACGGGCACAGACACAGGGCGGGGATATCAACACAATAAAAAAGCCGGGCGGAAAACGAG
CCTTGTGAAAACTCAAAGGGGGATCAGAGAGGAAAAGGGGAATATAACAGGGGATCCAAGGAAGCGAATT
AAAATTGCCCGGCGGG
```

FIGURE 372
SEQ ID NO: 364
Genbank ID          : AA557324
Unigene ID(#167)    : Hs.439760

FIGURE 372 cont'd

Unigene name    :    likely    ortholog    of    rat    cytochrome    P450    4X1
     CYP4X1
>gi|2327801|gb|AA557324.1|AA557324  n181a02.s1  NCI_CGAP_Br2  Homo  sapiens
cDNA c1
one IMAGE:1057034 3', mRNA sequence
AAGGAATAAGGTGAATTTTTATTAAGTGAAAAAAATCAATAACAATATAGGAATGATCACATCTATACAA
ATACATTGCTACATTTCTACATATAAAATGTATAGGAAAAAGTCTGAAAGAATGCACACCAAATTATTCT
GTTTTTAGGAAAAGCAGTAGGATTGGTCAGGGCATGGAATGTCGGCTAAGTGAAGTGAGATTTAAAATTT
TTATTCTACATGATTTTCTAGTGTTGGGAATTTTTGACAGTGAGCATACATGCACTTATTACTTGCATAA
TTCTGAAAACTATTTTAAAAACAACAGAGAATATATGAAAGTCTATTGGTGTATACAGCATTAATAGTAG
TGAAAGTTTAACAGAAAAGATCTGAAAATCTCCCAAAGTTATATAGAAACAGATCTAGCTGACACACTGT
GTACCTAGAAATGATTTTGGATCTCTTCACAGAGACCCCTATCCCACCAACCTCCAATCCTCCCACCATA
CATTGATCCCTTTCTATCTGCTTGGATCATTAGCTGTAAATTTAACTTCGAAAAACAAAGTACGTTTAAT
CATTGTAC

FIGURE 373
SEQ ID NO: 365
Genbank ID        : BF956762
Unigene ID(#167) : Hs.418271
Unigene name     :    maternally expressed 3    MEG3
>gi|12374037|gb|BF956762.1|BF956762  PM4-NN1209-221100-006-e07  NN1209  Homo
sapie
ns cDNA, mRNA sequence
TTGATCTGAGCCTCCCTTTCTCACCCACCCAAAGCAGCGAGGAGAGAATATGGAAACGTATGACAGGATG
TATATAGCAATACAAACATATTGAATGAATAAATAAAGACATAAATATGTGGGAGAGTGGACCACGCAAG
CACAAAAAGAGGAGAGAAGGCAGCAAGAATTATGACTAATTCAAAACTGGGTTCCTGAGATAGTTAAATA
AATCCTGCACCAAATCCCCAGGGGGAGAAATTAACAAACAAAAGACAGCCCCACACGGACCAGTGTGCA
GAAGGCTCCAGGGAACCGCCAGATTATTGGTTAATCCAATTCTGTGCACCTGAGGTCCATAAATAAAGA
ATAAGTATTGAAATGAAAGAATGACAGAAAGAATGAATGGACCACATGAACGACTGAATTAGAAATGGAA
ATGCCTGGCACAGCCAGGAAGGAGCTGCCCATGGGATTGTCATTCATCTCACTCTGGGGCACCCTGAGGT
CCATAAGCGTGAAAAGAGGCAGGAAGAGAAGGTGTCAGGGAGTCAAAGATAGAGCTAAGGAAAGGCAAAA
ATGAACTAAATGAAAGCGAAGGGAAATAAGAAAACCAATAAAAAGAGACGATACGTGGTGTTCTGTAAGA
GTAGGATCTGTAGGTTACGCCTAAGATGTCAGTATCCTGAAGAGGA

FIGURE 374
SEQ ID NO: 366
Genbank ID        : NM_004701.2
Unigene ID(#167) : Hs.194698
Unigene name     :    cyclin B2    CCNB2
>gi|10938017|ref|NM_004701.2|  Homo sapiens cyclin B2 (CCNB2), mRNA
AATCCTGGAACAAGGCTACAGCGTCGAAGATCCCCAGCGCTGCGGGCTCGGAGAGCAGTCCTAACGGCGC
CTCGTACGCTAGTGTCCTCCCTTTTCAGTCCGCGTCCCTCCCTGGGCCGGGCTGGCACTCTTGCCTTCCC
CGTCCCTCATGGCGCTGCTCCGACGCCCGACGGTGTCCAGTGATTTGGAGAATATTGACACAGGAGTTAA
TTCTAAAGTTAAGAGTCATGTGACTATTAGGCGAACTGTTTTAGAAGAAATTGGAAATAGAGTTACAACC
AGAGCAGCACAAGTAGCTAAGAAAGCTCAGAACACCAAAGTTCCAGTTCAACCCACCAAAACAACAAATG
TCAACAAACAACTGAAACCTACTGCTTCTGTCAAACCAGTACAGATGGAAAAGTTGGCTCCAAAGGGTCC
TTCTCCCACACCTGAGGATGTCTCCATGAAGGAAGAGAATCTCTGCCAAGCTTTTTCTGATGCCTTGCTC
TGCAAAATCGAGGACATTGATAACGAAGATTGGGAGAACCCTCAGCTCTGCAGTGACTACGTTAAGGATA
TCTATCAGTATCTCAGGCAGCTGGAGGTTTGCAGTCCATAAACCCACATTTCTTAGATGGAAGAGATAT
AAATGGACGCATGCGTGCCATCCTAGTGGATTGGCTGGTACAAGTCCACTCCAAGTTTAGGCTTCTGCAG
GAGACTCTGTACATGTGCGTTGGCATTATGGATCGATTTTTACAGGTTCAGCCAGTTTCCCGGAAGAAGC
TTCAATTAGTTGGGATTACTGCTCTGCTCTTGGCTTCCAAGTATGAGGAGATGTTTTCTCCAAATATTGA
AGACTTTGTTTACATCACAGACAATGCTTATACCAGTTCCCAAATCCGAGAAATGGAAACTCTAATTTTG
AAAGAATTGAAATTTGAGTTGGGTCGACCCTTGCCACTACACTTCTTAAGGCGAGCATCAAAAGCCGGGG
AGGTTGATGTTGAACAGCACACTTTAGCCAAGTATTTGATGGAGCTGACTCTCATCGACTATGATATGGT
GCATTATCATCCTTCTAAGGTAGCAGCAGCTGCTTCCTGCTTGTCTCAGAAGGTTCTAGGACAAGGAAAA
TGGAACTTAAAGCAGCAGTATTACACAGGATACACAGAGAATGAAGTATTGGAAGTCATGCAGCACATGG
CCAAGAATGTGGTGAAAGTAAATGAAAACTTAACTAAATTCATCGCCATCAAGAATAAGTATGCAAGCAG FIGURE 374 cont'd
CAAACTCCTGAAGATCAGCATGATCCCTCAGCTGAACTCAAAAGCCGTCAAAGACCTTGCCTCCCCACTG
ATAGGAAGGTCCTAGGCTGCCGTGGGCCCTGGGGATGTGTGCTTCATTGTGCCCTTTTTCTTATTGGTTT
AGAACTCTTGATTTTGTACATAGTCCTCTGGTCTATCTCATGAAACCTCTTCTCAGACCAGTTTTCTAAA
CATATATTGAGGAAAAATAAAGCGATTGGTTTTTCTTAAGGTAAAAAAAAAAAAAAAAAA

FIGURE 375
SEQ ID NO: 367
Genbank ID       : S73751.1
Unigene ID(#167) : Hs.278997
Unigene name     :     carboxylesterase   1   (monocyte/macrophage   serine
esterase 1) CES1
>gi|688112|gb|S73751.1|S73751 Homo sapiens acyl coenzyme A:cholesterol acyltran
sferase mRNA, complete cds
CTAAAGCGAGAACTGTCGCCCTTCACGATGTGGCTCCGTGCCTTTATCCTGGCCACTCTCTCTGCTTCCG
CGGCTTGGGGGCACATCCGTCCTCGCCACCTGTGGTGGACACCGTGCATGGCAAAGTGCTGGGGAAGTT
CGTCAGCTTAGAAGGATTTGCACAGCCTGTGGCCATTTTCCTGGGAATCCCTTTTGCCAAGCCGCCTCTT
GGACCCCTGAGGTTTACTCCACCGCAGCCTGCAGAACCATGGAGCTTTGTGAAGAATGCCACCTCGTACC
CTCCTATGTGCACCCAAGATCCCAAGGCGGGGCAGTTACTCTCAGAGCTATTTACAAACCGAAAGGAGAA
CATTCCTCTCAAGCTTTCTGAAGACTGTCTTTACCTCAATATTTACACTCCTGCTGACTTGACCAAGAA
AACAGGCTGCCGGTGATGGTGTGGATCCACGGAGGGGGGCTGATGGTGGGTGCGGCATCAACCTATGATG
GGCTGGCCCTTGCTGCCCATGAAAACGTGGTGGTTGGTGACCATTCAATATCGCCTGGGCATCTGGGATT
CTTCAGCACAGGGGATGAACACAGCCGGGGGAACTGGGGTCACCTGGACCAGGTGGCTGCCCTGCGCTGG
GTCCAGGACAACATTGCCAGCTTTGGAGGGAACCCAGGCTCTGTGACCATCTTTGGAGAGTCAGCGGGAG
GAGAAAGTGTCTCTGTTCTTGTTTTGTCTCCATTGGCCAAGAACCTCTTCCACCGGGCCATTTCTGAGAG
TGGCGTGGCCCTCACTTCTGTTCTGGTGAAGAAAGGTGATGTCAAGCCCTTGGCTGAGCAAATTGCTATC
ACTGCTGGGTGCAAAACCACCACCTCTGCTGTCATGGTTCACTGCCTGCGACAGAAGACGGAAGAGGAGC
TCTTGGAGACGACATTGAAAATGAAATTCTTATCTCTGGACTTACAGGGAGACCCCAGAGAGAGTCAACC
CCTTCTGGGCACTGTGATTGATGGGATGCTGCTGCTGAAAACACCTGAAGAGCTTCAAGCTGAAAGGAAT
TTCCACACTGTCCCCTACATGGTCGGAATTAACAAGCAGGAGTTTGGCTGGTTGATTCCAATGCAGTTGA
TGAGCTATCCACTCTCCGAAGGGCAACTGGACCAGAAGACAGCCATGTCACTCCTGTGGAAGTCCTATCC
CCTTGTTTGCATTGCTAAGGAACTGATTCCAGAAGCCACTGAGAAATACTTAGGAGGAACAGACGACACT
GTCAAAAAGAAAGACCTGTTCCTGGACTTGATAGCAGATGTGATGTTTGGTGTCCCATCTGTGATTGTGG
CCCGGAACCACAGAGATGCTGGAGCACCCACCTACATGTATGAGTTTCAGTACCGTCCAAGCTTCTCATC
AGACATGAAACCCAAGACGGTGATAGGAGACCACGGGGATGAGCTCTTCTCCGTCTTTGGGGCCCCATTT
TTAAAAGAGGGTGCCTCAGAAGAGGAGATCAGACTTAGCAAGATGGTGATGAAATTCTGGGCCAACTTTG
CTCGCAATGGAAACCCCAATGGGGAAGGGCTGCCCCACTGGCCAGAGTACAACCAGAAGGAAGGGTATCT
GCAGATTGGTGCCAACACCCAGGCGGCCCAGAAGCTGAAGGACAAAGAAGTAGCTTTCTGGACCAACCTC
TTTGCCAAGAAGGCAGTGGAGAAGCCACCCCAGACAGAACACATAGAGCTGTGAATGAAGATCCAGCCGG
CCTTGGGAGCCTGGAGG

FIGURE 376
SEQ ID NO: 368
Genbank ID       : AF280113.1
Unigene ID(#167) : Hs.306220
Unigene name     :     cytochrome P450, family 3, subfamily A, polypeptide
43    CYP3A43
>gi|11225247|gb|AF280113.1|AF280113 Homo sapiens clone 15g cytochrome P450 subf
amily IIIA polypeptide 43 (CYP3A43) mRNA, complete cds, alternatively spliced
ATGGATCTCATTCCAAACTTTGCCATGGAAACATGGGTTCTTGTGGCTACCAGCCTGGTACTCCTCTATA
TTTATGGGACCCATTCACATAAACTTTTTAAGAAGCTGGGAATTCCTGGGCCAACCCCTCTGCCTTTTCT
GGGAACTATTTTGTTCTACCTTAGGGGTCTTTGGAATTTTGACAGAGAATGTAATGAAAAATACGGAGAA
ATGTGGGCCCTTAGGTCCAATGGGATTTCTGAAAAGTGCCTTAAGTTTTGCTGAAGATGAAGAATGGAA
GAGAATACGAACATTGCTATCTCCAGCTTTCACCAGTGTAAAATTCAAGGAAGTAAGAAAATAAGGTGAT
TTATAATTAGAAACTTAAAGGATGAATCTGGAGACAGGTAGTAAGTATCATCATAGTTCCTTTCTAATGG
GTAGTCCACTGAGTTTGAGCTTTCTAAAAAGGGTCTTTTCAGCTGGGCACAGTGGCTCATGCCTGTAATC FIGURE 376 cont'd CCAGCACTTTGGGAGGCCGAGGTGGGTGGATCACCTGAGGTTAGGAGATTGAGACCAGCCTGGCCAACAT
GGTGAAACCCCAACTCTACTAAAAATACAAAAATTAGCTGGGCATGGTGGCGGATGCCTATAATCCTAGC
TGCTCAGAAGGCTAAGGCAGAAGAATTGTTTGAATCTAGAGGCGGAGGTTGCAATGAGCCAAGATTGCGC
CGTTGCACTCCAGCCTGGGCAACAAGAGCGAAACTCTGTCTCAAAAAAAAGGGGCAGGGGGCGGTCTTTT
CTATTTATGTCCTAGAGGACATGGTGAGTCATTACAAAATATCATTTACTGGTCCATGCTGGGCAAAGCC
ATGTCCTTCTGAGACTCGAGTCTGCGTAGTTAACTATGGGTGGTGTTGTGTTTTAGATGGTCCCCATCAT
TTCCCAATGTGGAGATATGTTGGTGAGAAGCCTGAGGCAGGAAGCAGAGAACAGCAAGTCCATCAACTTG
AAAGATTTCTTTGGGGCCTACACCATGGATGTAATCACTGGCACATTATTTGGAGTGAACTTGGATTCTC
TCAACAATCCACAAGATCCCTTTCTGAAAAATATGAAGAAGCTTTTAAAATTGGATTTTTTGGATCCCTT
TTTACTCTTAATATCATCGAGTAGATTTCTTTCAACAGATGATCGACTCCCAGAATTCCAAAGAAACAAA
GTCCCATAAAGCTCTGTCTGATCTGGAGCTTGTGGCCCAGTCAATTATCATCATTTTTGCTGCCTATGAC
ACAACTAGCACCACTCTCCCCTTCATTATGTATGAACTGGCCACTCACCCTGATGTCCAGCAGAAACTGC
AGGAGGAGATTGACGCAGTTTTACCCAATAAGGCACCTGTCACCTACGATGCCCTGGTACAGATGGAGTA
CCTTGACATGGTGGTGAATGAAACGCTCAGATTATTCCCAGTTGTTAGTAGAGTTACGAGAGTCTGCAAG
AAAGATATTGAAATCAATGGAGTGTTCATTCCCAAAGGGTTAGCAGTGATGGTTCCAATCTATGCTCTTC
ACCATGACCCAAAGTACTGGACAGAGCCTGAGAAGTTCTGCCCTGAAAGGTTCAGTAAGAAGAACAAGGA
CAGCATAGATCTTTACAGATACATACCTTTTGGAGCTGGACCCCGAAACTGCATTGGCATGAGGTTTGCT
CTCACAAACATAAAACTTGCTGTCATTAGAGCACTGCAGAACTTCTCCTTCAAACCTTGTAAAGAGACTC
AGATCCCACTGAAATTAGACAATCTACCAACTCTTCAACCAGAAAAACCTATTGTTCTAAAAGTGCACTT
AAGAGATGGGATTACAAGTGGACCCTGA

FIGURE 377
SEQ ID NO: 369
Genbank ID        : R89089
Unigene ID(#167)  : acc_R89089
Unigene name      :
>gi|953916|gb|R89089.1|R89089 yq02f01.s1 Soares fetal liver spleen 1NFLS Homo s
apiens cDNA clone IMAGE:195769 3' similar to SP:S41906 S41906 GENE COR1
PROTEIN
 - GOLDEN ;, mRNA sequence
AATATGTTTCGACAGCAACAAAAGATTCTTCAACAATCTAGAATTGTTCAGAGCCAGAGATTGAAAACAA
TTAAACAGTTATATGAGCAGTTCATAAAGGTTTGTTGTATGTGGTAACACAATACATCGTTATAAAACAT
AATATATNTNTGGAAGTAGAAGATAATTCTNNCTAAGTTTATGGGAAANNACATTTTAGACTTTAACTAC
TTTCCCATTTTGAATTCATTGTTNCTGATTTAAGTGATANATATATTTCNCCTTGAGGGATTCANATGGG
NTTTGCNTGGGGATTATTCAAGACAGGGAAATGGGTAAATNGGGGAATTTNACTTAGGAAATATACTTAT
CCATGGCATAANACCCCTACTTTAATAACCACTTCNGGTCCTAGGTTCNCCGGTTTAAGGTGGAAATTGG
GNCCCCATAATACCCCNTTTTCNGGGGTGGATTTTCCCCNGTTTTTTCCAACCCCCGGGGTTGGTCAATA
GGGA

FIGURE 378
SEQ ID NO: 370
Genbank ID        : BF056746
Unigene ID(#167)  : Hs.516311
Unigene name      :   MRNA;  cDNA   DKFZp686E10196   (from   clone
DKFZp686E10196); complete cds
>gi|10810642|gb|BF056746.1|BF056746 7k20h08.x1 NCI_CGAP_Ov18 Homo sapiens cDNA
clone IMAGE:3476199 3', mRNA sequence
CACAACACCGAGCTTGTTTCTCCACCCACATAGACTGTATTTGTCACTATTATACACAATATGGTGCCAT
CATGCATATTTTGTACATTTGATCAGCCAATATTTATATAAAACTTTCATAAACACTTTCAAACAGTTTT
ACCCCACAGGGTGGGCAGAGGTGCTTGTCAATATAATAAAACTGAACAACAGTGGTAGAAAAAGGTACAC
TTGTACTTATCTTCAAGTTTAAGATGTAAAATTTTTTCTGTTCAATGGCCACTACCTCATATTATTTTTA
GGATCTGGGATCGGACTTAGCAACACATTATGACTTTCAAGAAGTTGAGCTCACTGTTTTGTGGCGTTCT
TTGCAGAACACCATGAACTTCCGGGTGCCCATGTGCTGACAAGTGTCAGAACAGCTGGTGTCCAGCTGA
CGTGAGGCTGGACTTGTGTGATAGGCACGTTGTGGCCATAGCTCCCCACTCTGTGAAATGATGAGATCGA
CATGCCTCCATCCATCAGTAGGATCCCCAGCATGGAGAATTTACACCGTCACCCTTCAAAGAAAGGAGCC
AAGTCCTGGGCACCTNCTCTCACCTTGACT

FIGURE 379
SEQ ID NO: 371
Genbank ID        : Z38645
Unigene ID(#167)  : Hs.476384
Unigene name      :         CAZ-associated structural protein    CAST
>gi|561037|gb|Z38645.1|Z38645 HSC0JE042 normalized infant brain cDNA Homo sapie
ns cDNA clone c-0je04 3', mRNA sequence
CAGAAAGAAACAAGGTTTATTTGATGANTATAAATAAGGCGATCAGCACAAAGTACTTCTCATACACATG
ACAACAAATTTATGAACTGTACATACCTTGTACATTGTTCTACTAGACACGNGGTTACANTGNCTGGCTA
ATACATGCCCACTGGTAGTTTCCAGGGTTCCTTAGTTTTATTTATTTNTTTTTCATATCGATGTCCATAA
TCACATGGTCAATATCACAACCCACATGCCACTCACTTGAAGAAAT

FIGURE 380
SEQ ID NO: 372
Genbank ID        : X07868
Unigene ID(#167)  : acc_X07868
Unigene name      :
>gi|32998|emb|X07868.1|HSIGF27 Human DNA for insulin-like growth factor II (IGF
-2); exon 7 and additional ORF
GACAACTTCCCCAGATACCCCGTGGGCAAGTTCTTCCAATATGACACCTGGAAGCAGTCCACCCAGCGCC
TGCGCAGGGGCCTGCCTGCCCTCCTGCGTGCCCGCCGGGGTCACGTGCTCGCCAAGGAGCTCGAGGCGTT
CAGGGAGGCCAAACGTCACCGTCCCCTGATTGCTCTACCCACCCAAGACCCCGCCCACGGGGGCGCCCCC
CCAGAGATGGCCAGCAATCGGAAGTGAGCAAAACTGCCGCAAGTCTGCAGCCCGGCGCCACCATCCTGCA
GCCTCCTCCTGACCACGGACGTTTCCATCAGGTTCCATCCCGAAAATCTCTCGGTTCCACGTCCCCCTGG
GGCTTCTCCTGACCCAGTCCCCGTGCCCCGCCTCCCCGAAACAGGCTACTCTCCTCGGCCCCCTCCATCG
GGCTGAGGAAGCACAGCAGCATCTTCAAACATGTACAAAATCGATTGGCTTTAAACACCCTTCACATACC
CTCCCCCCAAATTATCCCCAATTATCCCCACACATAAAAAATCAAAACATTAAACTAACCCCCTTCCCCC
CCCCCCACAACAACCCTCTTAAAACTAATTGGCTTTTTAGAAACACCCCACAAAAGCTCAGAAATTGGCT
TTAAAAAAAACAACCACCAAAAAAAATCAATTGGCTAAAAAAAAAAAGTATTAAAAACGAATTGGCTGAG
AAACAATTGGCAAAATAAAGGAATTTGGCACTCCCCACCCCCCTCTTTCTCTTCTCCCTTGGACTTTGAG
TCAAATTGGCCTGGACTTGAGTCCCTGAACCAGCAAAGAGAAAAGAAGGGCCCCAGAAATCACAGGTGGG
CACGTCGCTCGTACCGCCATCTCCCTTCTCACGGGAATTTTCAGGGTAAACTGGCCATCCGAAAATAGCA
ACAACCCAGACTGGCTCCTCACTCCCTTTTCCATCACTAAAAATCACAGAGCAGTCAGAGGGACCCAGTA
AGACCAAAGGAGGGGAGGACAGAGCATGAAAACCAAAATCCATGCAAATGAAATGTAATTGGCACGACCC
TCACCCCCAAATCTTACATCTCAATTCCCATCCTAAAAAGCACTCATACTTTATGCATCCCCGCAGCTAC
ACACACACAACACACAGCACACGCATGAACACAGCACACACACGAGCACAGCACACACGAGCATACAG
CACACACACAAACGCACAGCACACACAGCACACAGATGAGCACACAGCACACACACAAACGCACAGCACA
CACACGCACACACATGCACACACAGCACACAAACGCACGGCACACACACGCACACACAGTGCACACACAG
CACACACGCAAACGCACACGCACACACAAACGCACAGCACACACGCACACACAGCACACACACGAGCACA
CAGCACACAAACGCACAGCACACGCACACACATGCACACACAGCACACTAGCACACAGCACACACACAAA
GACACAGCACACACATGCACACACAGCACACACACGCGAACACAGCACACACGAACACAGCACACACAGC
ACACACACAAACACAGCACACACATGCACACAGCACATGCACACACAGCACACACATGAACACAGCACAC
AGCACACACATGCACACAGCACACGCATGCACAGCACACACATGAACACAGCACACACAAACACACAGCA
CACACATGCACACACAGCACACACACTCATGCGCAGCACATACATGAACACAGCTCACAGCACACACAAACA
CGCAGCACACACGTTGCACACGCAAGCACCCACCTGCACACACACATGCGCACACACACGCACACCCCCA
CAAAATTAGATGAAAACAATAAGCATATCTAAGCAACTACGATATCTGTATGGATCAGGCCAAAGTCCCG
CTAAGATTCTCCAATGTTTTCATGGTCTGAGCCCCCCTCCTGTTCCCATCTCCACTGCCCCTCGGCCCTG
TCTGTGCCCTGCCTCTCAGAGGAGGGGGCTCAGATGGTGCGGCCTGAGTGTGCGGCCGGCGGCATTTGGG
ATACACCCGTAGGTGGGCGGGTGTGTCCCAGGCCTAATTCCATCTTTCCACCATGACAGAGATGCCCTT
GTGAGGCTGGCCTCCTTGGCGCCTGTCCCCACGGCCCCGCAGCGTGAGCCACGATGCTCCCCATACCCC
ACCCATTCCCGATACACCTTACTTACTGTGTGTTGGCCCAGCCAGAGTGAGGAAGGAGTTTGGCCACATT
GGAGATGGCCGGTAGCTGAGCAGACATGCCCCACGAGTAGCCTGACTCCCTGGTGTGCTCCTGGAAGGA
AGATCTTGGGGACCCCCCACCGGAGCACACCTAGGGATCATCTTTGCCCGTCTCCTGGGGACCCCCAA
GAAATGTGGAGTCCTCGGGGGCCGTGCACTGATGCGGGGAGTGTGGGAAGTCTGGCGGTTGGAGGGGTGG
GTGGGGGGCAGTGGGGGCTGGCGGGGGGAGTTCTGGGGTAGGAAGTGGTCCCGGGAGATTTTGGATGGA

FIGURE 380 cont'd

```
AAAGTCAGGAGGATTGACAGCAGACTTGCAGAATTACATAGAGAAATTAGGAACCCCCAAATTTCATGTC
AATTGATCTATTCCCCCTCTTTGTTTCTTGGGGCATTTTTCCTTTTTTTTTTTTTTTGTTTTTTTTTTA
CCCCTCCTTAGCTTTATGCGCTCAGAAACCAAATTAAACCCCCCCCCCATGTAACAGGGGGGCAGTGACA
AAAGCAAGAACGCACGAAGCCAGCCTGGAGACCACCACGTCCTGCCCCCGCCATTTATCGCCCTGATTG
GATTTTGTTTTTCATCTGTCCCTGTTGCTTGGGTTGAGTTGAGGGTGGAGCCTCCTGGGGGGCATGGCCA
TGAGCCCCCTTGGAGAAGTCAGAGGGGAGTGGAGAAGGCATGTCCGGCCTGGCTTCTGGGGACAGTGGCT
GGTCCCCAGAAGTCCTGAGGGCGGAGGGGGGGTTGGGCAGGGTCTCCTCAGGTGTCAGGAGGGTGCTCG
GAGGCCACAGGAGGGGCTCCTGGCTGGCCTGAGGCTGGCCGGAGGGGAAGGGGCTAGCAGGTGTGTAAA
CAGAGGGTTCCATCAGCTGGGGCAGGGTGGCCGCCTTCCGCACACTTGAGGAACCCTCCCCTCTCCCTCG
GTGACATCTTGCCCGCCCCTCAGCACCCTGCCTTGTCTCCAGGAGGTCCGAAGCTCTGTGGGACCTCTTG
GGGGCAAGGTGGGGTGAGGCCGGGGAGTAGGGAGGTCAGGCGGGTCTGAGCCCACAGAGCAGGAGAGCTG
CCAGGTCTGCCCATCGACCAGGTTGCTTGGGCCCCGGAGCCCACGGGTCTGGTGATGCCATAGCAGCCAC
CACCGCGGCGCCTAGGGCTGCGGCAGGGACTCGGCCTCTGGGAGGTTTACCTCGCCCCCACTTGTGCCCC
CAGCTCAGCCCCCTGCACGCAGCCCGACTAGCAGTCTAGAGGCCTGAGGCTTCTGGGTCCTGGTGACGG
GGCTGGCATGACCCCGGGGGTCGTCCATGCCAGTCCGCCTCAGTCGCAGAGGGTCCCTCGGCAAGCGCCC
TGTGAGTGGGCCATTCGGAACATTGGACAGAAGCCCAAAGAGCCAAATTGTCACAATTGTGGAACCCACA
TTGGCCTGAGATCCAAAACGCTTCGAGGCACCCCAAATTACCTGCCCATTCGTCAGGACACCCACCCACC
CAGTGTTATATTCTGCCTCGCCGGAGTGGGTGTTCCCGGGCTGCCTGTCTGACCTCCGTGCCTAGTCGTG
GCTCTCCATCTTGTCTCCTCCCCGTGTCCCCAATGTCTTCAGTGGGGGGCCCCCTCTTGGGTCCCCTCCT
CTGCCATCACCTGAAGACCCCCACGCCAAACACTGAATGTCACCTGTGCCTGCCGCCTCGGTCCACCTTG
CGGCCCGTGTTTGACTCAACTCAGCTCCTTTAACGCTAATATTTCCGGCAAAATCCCATGCTTGGGTTTT
GTCTTTAACCTTGTAACGCTTGCAATCCCAATAAAGCATTAAAAGTCATGATCTTCTGAGGTGTTCCACT
CTCTGACTTGGGTACTGGACTGCCGGAGGGAGGGAAGGGGCTGAGCACCTGGAAGCAGGCAGAGGGGAT
AGAAGAGGGAAGGGGAAGGAAGGCCT
```

FIGURE 381
SEQ ID NO: 373
Genbank ID : NM_014432.1
Unigene ID(#167) : Hs.288240
Unigene name : interleukin 20 receptor, alpha    IL20RA
>gi|7657690|ref|NM_014432.1| Homo sapiens interleukin 20 receptor, alpha (IL20R
A), mRNA

```
TCCAGCTGGGTAGCCGGGGGAGCGCGCGTGGGGGCTCCGCGAGTCGCTCGCCCTTGGTTTCTGGGGAAGC
CTGGGGGACGCGGCTGTGGCGGAGGCGCCCTGGGACTCAGGTCGCCTGGAGCGTGGCACGCAGAGCCCCA
GGCGCGGAGCTGAGGCCGCGCGGCCGCGCTTGGCCCCAGCGGGCGTGGGACTGAGCAGTCTGCTGCCCCC
CGACATGTGACCCAGCCCCGCCGCCCATGCGGGCTCCCGGCCGCCCGGCCCTGCGGCCGCTGCCGCTGCC
GCCGCTGCTGCTGTTGCTCCTGGCGGCGCCTTGGGGACGGGCAGTTCCCTGTGTCTCTGGTGGTTTGCCT
AAACCTGCAAACATCACCTTCTTATCCATCAACATGAAGAATGTCCTACAATGGACTCCACCAGAGGGTC
TTCAAGGAGTTAAAGTTACTTACACTGTGCAGTATTTCATATATGGGCAAAAGAAATGGCTGAATAAATC
AGAATGCAGAAATATCAATAGAACCTACTGTGATCTTTCTGCTGAAACTTCTGACTACGAACACCAGTAT
TATGCCAAAGTTAAGGCCATTTGGGGAACAAAGTGTTCCAAATGGGCTGAAAGTGGACGGTTCTATCCTT
TTTTAGAAACACAAATTGGCCCACCAGAGGTGGCACTGACTACAGATGAGAAGTCCATTTCTGTTGTCCT
GACAGCTCCAGAGAAGTGGAAGAGAAATCCAGAAGACCTTCCTGTTTCCATGCAACAAATATACTCCAAT
CTGAAGTATAACGTGTCTGTGTTGAATACTAAATCAAACAGAACGTGGTCCCAGTGTGTGACCAACCACA
CGCTGGTGCTCACCTGGCTGGAGCCGAACACTCTTTACTGCGTACACGTGGAGTCCTTCGTCCCAGGGCC
CCCTCGCCGTGCTCAGCCTTCTGAGAAGCAGTGTGCCAGGACTTTGAAAGATCAATCATCAGAGTTCAAG
GCTAAAATCATCTTCTGGTATGTTTTGCCCATATCTATTACCGTGTTTCTTTTTTCTGTGATGGGCTATT
CCATCTACCGATATATCCACGTTGGCAAAGAGAAACACCCAGCAAATTTGATTTTGATTTATGGAAATGA
ATTTGACAAAAGATTCTTTGTGCCTGCTGAAAAAATCGTGATTAACTTTATCACCCTCAATATCTCGGAT
GATTCTAAAATTTCTCATCAGGATATGAGTTTACTGGGAAAAGCAGTGATGTATCCAGCCTTAATGATC
CTCAGCCCAGCGGGAACCTGAGGCCCCCTCAGGAGGAAGAGGAGGTGAAACATTTAGGGTATGCTTCGCA
TTTGATGGAAATTTTTTGTGACTCTGAAGAAAACACGGAAGGTACTTCTTTCACCCAGCAAGAGTCCCTC
AGCAGAACAATACCCCCGGATAAAACAGTCATTGAATATGAATATGATGTCAGAACCACTGACATTTGTG
CGGGGCCTGAAGAGCAGGAGCTCAGTTTGCAGGAGGAGGTGTCCACACAAGGAACATTATTGGAGTCGCA
GGCAGCGTTGGCAGTCTTGGGCCCGCAAACGTTACAGTACTCATACACCCCTCAGCTCCAAGACTTAGAC
CCCCTGGCGCAGGAGCACACAGACTCGGAGGAGGGGCCGGAGGAAGAGCCATCGACGACCCTGGTCGACT
GGGATCCCCAAACTGGCAGGCTGTGTATTCCTTCGCTGTCCAGCTTCGACCAGGATTCAGAGGGCTGCGA
GCCTTCTGAGGGGATGGCTCGGAGAGGAGGGTCTTCTATCTAGACTCTATGAGGAGCCGGCTCCAGAC
AGGCCACCAGGAGAAAATGAAACCTATCTCATGCAATTCATGGAGGAATGGGGGTTATATGTGCAGATGG
```

FIGURE 381 cont'd

```
AAAACTGATGCCAACACTTCCTTTTGCCTTTTGTTTCCTGTGCAAACAAGTGAGTCACCCCTTTGATCCC
AGCCATAAAGTACCTGGGATGAAAGAAGTTTTTTCCAGTTTGTCAGTGTCTGTGAGAATTACTTATTTCT
TTTCTCTATTCTCATAGCACGTGTGTGATTGGTTCATGCATGTAGGTCTCTTAACAATGATGGTGGGCCT
CTGGAGTCCAGGGGCTGGCCGGTTGTTCTATGCAGAGAAAGCAGTCAATAAATGTTTGCCAGACTGGGTG
CAGAATTTATTCAGGTGGGTGTACTCTGGCCTCTTGGTTCATTATTTTCAAACAAGCACACTTGTACAAT
TATTTTCTGGGTACTTCCCATATGCACATAGCACTGTAAAAAATATTTCCCAAAGATCACTCATTTTATA
AATACCACTTTTTCAGAATTGGGTTTATTGCGAGCAGGAGGAGATACTTAAAACATGCACATATACCAGG
TTGGTGGTAAGTTGGTCACATGTGAAAACCTCAACTATTTAATCATCATGATTCATATTTTGAGTGAATA
CATCAGGCACAGACCTTCATGATATCACACACTCTTGGCTACTTTAAGAGGCCATCTTTAATACTTTATG
AGTAGTTCTGGAGTGTAAACATAAACGAGTATTCTTTTGTAGTCAGAAAAGTGTCCTCTCAATAATTTAG
TAGGGGCTTATTGTCTCTCAAAACTAACCTAAAAGAAAATGACACATTTTATAATAGAATATTACATTTA
TTTCTGGAAGTGTGTTTTCAAAAAGATATTTACATAGTCTGTAAACTAGAAAGTGTTAGGTAAAGCTCTA
GGTTACTGTGTTACTATTATAATATTAAACATTCGAATAGGCAGTCGTTCAAAGACTCTTTGGAATATCT
ATGAATGAATATCCTCTATTCTTATAATATTAAAACCCATAAGTAAATATAGGACATACAAGAGAAATGA
GTTAAATGACTATGTAAGGGAGAGTTTATTAAAATTTGATGAAATTTACTGTAGGAACTAAACTATGCCA
TAAAACAATAGCTTTCTAGTTCATTTCCAGTAACTGTTCCCATCTCCTTTACCACTTGTTAAGAAAATTA
AATTCTTCAGTCACGCTGCTTTAAAATGGGACAAAATCTATTAAGTTGAACCATATATAATTGTGGATAT
TTGGCTGTTTTTAATCTGACAAGCAGTAACTTCATATGGTTTGCCTTAATATATATTTGTTTTAGTCATG
AACTCATAATCCATTGATGCTCTTTCATGAAGAGATATGACCCATATTTCCTTATTGATATTATTGGT
ACAGGCAGACAACCCTGGTAGGAGAGATGGATTCTGGGGTCATGACCTTTCGTGATTATCCGCAAATGCA
AACAGTTTCAGATCTAATGGTTTAATTTAGGGAGTAATTATATTAATCAGAGTGTTCTGTTATTCTCAAT
CTTTATAGAAACGATTCTGCTGGTTTTGAAGAACAGATGTATTACACTAACTGTAAAAGTAGTTCAAGAG
TGAGAAAGAATAAATTGTTATTAAGAGCAAAAGAAAAATAAAGTGATTGATGATA
```

FIGURE 382
SEQ ID NO: 374
Genbank ID        : N74607
Unigene ID(#167)  : Hs.234642
Unigene name      :        aquaporin 3 AQP3
>gi|1231892|gb|N74607.1|N74607 za55a01.s1 Soares fetal liver spleen 1NFLS Homo
sapiens cDNA clone IMAGE:296424 3', mRNA sequence
```
AGGCACATATTTATTTTATTTTTTTTAATATAAAAGTAAAAGAGTACATTGTTGAGTAGAGGATTAAAGG
AGTGACGACCCTTTCTAAAGTGGGGTCTCCCATCCCGGATCCCTAAGACTGTAACATCTGCTACATACAT
TAAAAACAAAACAAAACAAAAGCAAACATGAAACTTATGACCTGACTTCACTCCACCCTTCATGCCTGCA
TTATGACAGAAACACGTCCCACTGCTCCTACTTATGTATGTACATCCAGAGCTCCAAACCTAAGCTGTGG
CCCCCTCCTCCCAGCCCTACCCACATCCACCCTACTTCCCAAAAGCCTGTAGAAGCCCCACTTAGAAAA
AAAGGGCAGACATACACATACACAGAAACACATATCTATCTGGCAGCTCCTCCATGTGAAGCCCCTGGAA
ACATACACACCCNGGGACTTTTCCTCTCCTTATGGCACAGATGGGACAGGNTGGCCTTTCCCCTGTT
```

FIGURE 383
SEQ ID NO: 375
Genbank ID        : T58044
Unigene ID(#167)  : acc_T58044
Unigene name      :
>gi|659905|gb|T58044.1|T58044 yb26c10.s1 Stratagene fetal spleen (#937205) Homo
 sapiens cDNA clone IMAGE:72306 3' similar to contains L1 repetitive element, m
RNA sequence
```
AACTTTTAGANGAGATGGGGTCTCACTGTGTTGCCCAGACTGGTCTCCAAGTCCTGGGCTCAAGTGATCC
TCCCGCCTCGGCCTCCCAAAGTGCTGGGATGACAGGCATGAGCACCGCGCTGGCCTGATTTGAATGTTAA
TGTGTCACACATGCATCTTCCCTGGAAGATCTTGGCAAAATGCTTGTCTCTCTGGTCTTTTAAACATGAC
TTGGTGCTGAAAGACACACTGCTGGGACCCAAGTTCCCTCCCACATGGACGGGATGGAGGCTGGAGCCAA
GGTTTCAGGGAAACGTATGTGGCCTGTGCCCCTGGGGTGTGATCATGGGGCACACACATTTATCTGGGCA
GGGCAACCTTGGCTTCTTGAGGGGGTCATGGGGCACAGAGGGAGGGACCCATCTTGGTTGACACTTGAGG
GACCCAGTGTTTGCCCCACCAGCCAGGGGAGGATTAAGGGATGAGGATTNAGTTTTTGCCCACACCCCCT
TCCAGATTGAGCTTCAAGAAAGGAGGCCCAGCCTTAGCCCCTTTAACTT
```

FIGURE 384
SEQ ID NO: 376
Genbank ID       : AI222435
Unigene ID(#167) : Hs.90250
Unigene name     :       CDNA FLJ36413 fis, clone THYMU2010816
>gi|3804638|gb|AI222435.1|AI222435   qh04g12.x1   Soares_NFL_T_GBC_S1   Homo sapiens
cDNA clone IMAGE:1843750 3', mRNA sequence
AATTCTTATAGATGTTTATTAGTTGTTAGATTTAAAAAAAAAACAGGGCTTATAATTAAAGCAATTGACT
AATGATCTCACAGCCTCAAGGTTGTATGCAAACCTAGATTAGAAATACTTTGTCTCTAAAAATAACAAAA
TGACCATAACATTTTTTTCTTACAAGTTTGAAGTGGTCAATTATGGGTAACACATACATTCCTAAGGAA
ATCTGAAATGGTCTTGAAGAATAAGTTTCTTTGAAATGGTAAGTAACACAAAAAGTGTACTTCTTTTTTT
GGAAAATGATTCACAAATAACCCCTTTAAACCAACAATTGGTGATTTATATTCTGGTCAGGATTTTGGAG
TCTGGGCAATGCCATTACTTAGCTGTTTTGACTATGAGAACTTTTACAAATTTATTCTGACTTCTATGAT
CTTTAATCTCTTTTCTACACCTGAAAAATAATAAAGATTGTAAACTAGATGTCCTCAAAGATTC

FIGURE 385
SEQ ID NO: 377
Genbank ID       : NM_005558.1
Unigene ID(#167) : Hs.18141
Unigene name     :       ladinin 1    LAD1
>gi|5031844|ref|NM_005558.1| Homo sapiens ladinin 1 (LAD1), mRNA
GCGGGATTCCGGGCCGGGCCGGCCTGGGCTGCAATCAATGCGGCTTTGTCTGGGACGCCCACATCCCAGA
GGCCATTCCCGGGTCGGCAAATCGGAGCGCGGCGGGGCGCGCGGGGGTGAGATAAGCGGCCATGTGATCC
CACCTGGGCTGGAAGGGGAGGGGCGCCAGGTGAGGCGGCGCCGGTGGGGCGCGGGCGGCCACGCGGGGC
TCCTGCAGCATGGCTGTCAGCAGGAAGGACTGGTCCGCGCTGTCCAGCCTTGCCCGGCAGAGGACTCTGG
AGGATGAGGAGGAACAGGAGCGCGAGCGCAGGCGGCGGCACCGCAACCTGAGCTCCACCACGGACGATGA
GGCTCCCAGGCTCAGCCAGAATGGAGACCGGCAGGCCTCTGCTTCTGAGAGACTACCGAGCGTGGAAGAA
GCAGAGGTGCCCAAGCCACTGCCCCCAGCCTCCAAAGATGAGGACGAGGACATCCAGAGCATCCTCAGAA
CACGGCAGGAGCGGAGGCAGAGGCGGCAGGTGGTGGAGGCTGCACAGGCCCCCATCCAGGAGAGGCTGGA
GGCAGAGGAGGGGAGGAACAGCTTGAGCCCTGTGCAGGCCACACAGAAACCCCTAGTCTCCAAGAAGGAA
CTGGAAATCCCACCTCGCCGGAGACTGAGTCGGGAACAGCGGGCCCCTGGCCCCTGGAGGAGGAGAGCT
TGGTGGGCAGGGAGCCAGAAGAGAGGAAGAAAGGGGTTCCAGAAAAGTCCCCAGTCTTGGAGAAGTCCTC
CATGCCAAAGAAGACGGCACCTGAAAAGAGCCTGGTCTCCGATAAAACCTCCATCTCTGAGAAGGTGCTG
GCCTCAGAGAAGACATCTCTATCAGAGAAGATAGCAGTGTCAGAGAAAAGAAACAGCTCAGAGAAGAAGT
CTGTTCTAGAAAAAACCAGTGTCTCTGAGAAGTCGCTGGCCCCAGGGATGGCACTGGGCTCAGGAAGGAG
GCTGGTGTCTGAGAAAGCTTCCATCTTTGAGAAGGCACTGGCCTCAGAGAAGAGCCCAACTGCAGATGCT
AAGCCGGCCCCAAAGAGGGCCACAGCCTCAGAGCAGCCCTGGCGCAGGAGCCGCCAGCCTCTGGGGGAA
GCCCAGCCACCCAAGGAGCAGAGAGGAAGGCCCTCCCTGGGAAGAACCTGCCCTCTTTGGCAAAGCA
GGGGGCTTCAGACCCTCCGACTGTGGCCTCCCGCCTCCCACCCGTCACACTCCAGGTGAAAATCCCCAGC
AAGGAGGAAGAGGCAGATATGTCCTCACCCACACAGCGAACCTACAGCAGCTCCCTCAAACGCTCCAGCC
CCAGGACCATCTCCTTTCGGATGAAACCCAAGAAGAAAACTCGGAAACAACCCTAACTCGCAGTGCCAG
CATGAAGCTCCCAGACAACACAGTGAAGTTGGGAGAGAAGCTGGAGAGATACCACACGGCCATACGGAGA
TCAGAATCTGTCAAGTCTCGGGGTCTGCCTTGCACTGAGTTATTCGTGGCTCCTGTGGGTGTAGCCAGCA
AGCGCCACCTCTTTGAGAAGGAACTGGCGGGCAGAGCCGAGCAGAACCAGCCTCCAGCCGGAAGGAGAA
CTTGAGGCTCTCAGGGGTTGTGACATCAAGGCTCAACCTGTGGATCAGCAGGACCCAGGAATCTGGAGAT
CAGGACCCCCAGGAGGCACAGAAAGCATCATCTGCAACCGAGAGGACTCAGTGGGGACAGAAATCTGACT
CCTCGCTGGACGCTGAGGTGTGACAAGCCCGCCAAGACAGACCTGCAAGTCTTCGTCTCAAGGGACCTC
CCTCATGCCAGGCCCCTGCCTCTCACAGCAGCACCCTTTCCTCTCATTGTCCCTGTTCCCTTGTTGGCTG
TGGATCTGTTTGGCCAGGGTCCCTGGGGTCAGGAATATTTGCAAGACTCAGCCAGCTCCTTCCCAGCCCA
GCCTCTTGGGGCTGGGACTTTCTCACCCTGCGGCAGGCACAACAGATGCTGGGACCCAGTCTCTGCCCAG
GTCACAGCACAAGTGCACATCAGCACTATGTGGCCTATGTCCTGCCCAGAGACCTCTGCTCCTTCCTGCT
CACATCCACAGTCAGGGCACGGCGCCCCTCAAGAACTCCAGAGTCACCTGTCTCATCGGCTCCCAACAAG
TGCCTCTTTGTCTATGATGTCCCCCTTCTCTGAGGCCTGGACCCACCCATCTTTGTCCCTGGGGGCTGCT
CCCAGCCACTGAGGCCCGCTCTGGCCAGGGGAGAAGGAGCTGCCGTGCGTCTTCCCTGTGCCCCGTCTCC
CTGCTTGGTTCTCCCCTCCCTTCCCTGGCCGGCTGCCATGGCCAGGAGCTAAGTGCCTTTTTGTGTGCAA
CCACTTACCCTTTCTCTGAAAAACCTGTTCTCAGGAAGGATCTGATAAACTCATTTACTCTC

FIGURE 386
SEQ ID NO: 378
Genbank ID      : NM_003981.1
Unigene ID(#167) : Hs.344037
Unigene name    :     protein regulator of cytokinesis 1   PRC1
>gi|4506038|ref|NM_003981.1| Homo sapiens protein regulator of cytokinesis
1 (P
RC1), mRNA
GTTTGCGGGTGGTTGTTGCTCTCGGGGCCGTGTGGAGTAGGTCTGGACCTGGACTCACGGCTGCTTGGAG
CGTCCGCCATGAGGAGAAGTGAGGTGCTGGCGGAGGAGTCCATAGTATGTCTGCAGAAAGCCCTAAATCA
CCTTCGGGAAATATGGGAGCTAATTGGGATTCCAGAGGACCAGCGGTTACAAAGAACTGAGGTGGTAAAG
AAGCATATCAAGGAACTCCTGGATATGATGATTGCTGAAGAGGAAAGCCTGAAGGAAAGACTCATCAAAA
GCATATCCGTCTGTCAGAAAGAGCTGAACACTCTGTGCAGCGAGTTACATGTTGAGCCATTTCAGGAAGA
AGGAGAGACGACCATCTTGCAACTAGAAAAAGATTTGCGCACCCAAGTGGAATTGATGCGAAAACAGAAA
AAGGAGAGAAAACAGGAACTGAAGCTACTTCAAGAGCAAGATCAAGAACTGTGCGAAATTCTTTGTATGC
CCCACTATGATATTGACAGTGCCTCAGTGCCCAGCTTAGAAGAGCTGAACCAGTTCAGGCAACATGTGAC
AACTTTGAGGGAAACAAAGGCTTCTAGGCGTGAGGAGTTTGTCAGTATAAAGAGACAGATCATACTGTGT
ATGGAAGAATTAGACCACACCCCAGACACAAGCTTTGAAAGAGATGTGGTGTGTGAAGACGAAGATGCCT
TTTGTTTGTCTTTGGAGAATATTGCAACACTACAAAAGTTGCTACGGCAGCTGGAAATGCAGAAATCACA
AAATGAAGCAGTGTGTGAGGGGCTGCGTACTCAAATCCGAGAGCTCTGGGACAGGTTGCAAATACCTGAA
GAAGAAAGAGAAGCTGTGGCCACCATTATGTCTGGGTCAAAGGCCAAGGTCCGGAAAGCGCTGCAATTAG
AAGTGGATCGGTTGGAAGAACTGAAAATGCAAAACATGAAGAAAGTGATTGAGGCAATTCGAGTGGAGCT
GGTTCAGTACTGGGACCAGTGCTTTTATAGCCAGGAGCAGAGACAAGCTTTTGCCCCTTTCTGTGCTGAG
GACTACACAGAAAGTCTGCTCCAGCTCCACGATGCTGAGATTGTGCGGTTAAAAAACTACTATGAAGTTC
ACAAGGAACTCTTTGAAGGTGTCCAGAAGTGGGAAGAAACCTGGAGGCTTTTCTTAGAGTTTGAGAGAAA
AGCTTCAGATCCAAATCGATTTACAAACCGAGGAGGAAATCTTCTAAAAGAAGAAAAACAACGAGCCAAG
CTCCAGAAAATGCTGCCCAAGCTGGAAGAAGAGTTGAAGGCACGAATTGAATTGTGGGAACAGGAACATT
CAAAGGCATTTATGGTGAATGGGCAGAAATTCATGGAGTATGTGGCAGAACAATGGGAGATGCATCGATT
GGAGAAAGAGAGAGCCAAGCAGGAAAGACAACTGAAGAACAAAAAACAGACAGAGACAGAGATGCTGTAT
GGCAGCGCTCCTCGAACACCTAGCAAGCGGCGAGGACTGGCTCCCAATACACCGGGCAAAGCACGTAAGC
TGAACACTACCACCATGTCCAATGCTACGGCCAATAGTAGCATTCGGCCTATCTTTGGAGGGACAGTCTA
CCACTCCCCCGTGTCTCGACTTCCTCCTTCTGGCAGCAAGCCAGTCGCTGCTTCCACCTGTTCAGGGAAG
AAAACACCCCGTACTGGCAGGCATGGAGCCAACAAGGAGAACCTGGAGCTCAACGGCAGCATCCTGAGTG
GTGGGTACCCTGGCTCGGCCCCCCTCCAGCGCAACTTCAGCATTAATTCTGTTGCCAGCACCTATTCTGA
GTTTGCGAAGGATCCGTCCCTCTCTGACAGTTCCACTGTTGGGCTTCAGCGAGAACTTTCAAAGGCTTCC
AAATCTGATGCTACTTCTGGAATCCTCAATTCAACCAACATCCAGTCCTGAGAAGCCCTGATCAGTCAAC
CAGCTGTGGCTTCCTGTGCCTAGACTGGACCTAATTATATGGGGGTGACTTTAGTTTTTCTTCAGCTTAG
GAGTGCTTGAAACCTTGGCCAGGTTCCATGACCATGGGCCTAACTTAAAGATGTGAATGAGTGTTACAGT
TGAAAGCCCATCATAGGTTTAGTGGTCCTAGGAGACTTGGTTTTGACTTATATACATGAAAAGTTTATGG
CAAGAAGTGCAAATTTTAGCATATGGGGCCTGACTTCTCTACCACATAATTCTACTTGCTGAAGCATGAT
CAAAGCTTGTTTTATTTCACCACTGTAGGAAAATGATTGACTATGCCCATCCCTGGGGGTAATTTTGGCA
TGTATACCTGTAACTAGTAATTAACATCTTTTTTGTTTAGGCATGTTCAATTAATGCTGTAGCTATCATA
GCTTTGCTCTTACCTGAAGCCTTGTCCCCACCACACAGGACAGCCTTCCTCCTGAAGAGAATGTCTTTGT
GTGTCCGAAGTTGAGATGGCCTGCCCTACTGGCAAAGAGGTGACAGGAAGGCTGGAGCAGCTTTGTTAA
ATTGTGTTCAGTTCTGTTACACAGTGCATTGCCCTTTGTTGGGGTATGCATGTATGAACACACATGCTT
GTCGGAACGCTTTCTCGGCGTTTGTCCCTTGGCTCTCATCTCCCCATTCCTGTCCTGTCCTACTTTGCCTGAG
TTCTTCTACCCCCGCAGTTGCCAGCCAGATTGGGAGTCTGTTTGTTCCAATGGGTTGAGCTGTCTTTGTC
GTGGAGATCTGGAACTTTGCACATGTCACTACTGGGGAGGTGTTCCTGCTCTAGCTTCCACGATGAGGCG
CCCTCTTTACCTATCCTCTCAATCACTACTCTTCTTGAAGCACTATTATTTATTCTTCCGCTGTCTGCCT
GCAGCAGTACTACTGTCAACATAGTGTAAATGGTTCTCAAAAGCTTACCAGTGTGGACTTGGTGTTAGCC
ACGCTGTTTACCTCATACAGTACGTGTCCTGTTTTTAAAATATACAATTATTCTTAAAAATAAATTAAAA
TCGTATACTTACATTTCAAAAAAAAAAAAAAAAA

FIGURE 387
SEQ ID NO: 379
Genbank ID      : AW009884
Unigene ID(#167) : Hs.431156

FIGURE 387 cont'd

```
Unigene name       :     protein phosphatase 2 (formerly 2A), regulatory
subunit A (PR 65), beta isoform        PPP2R1B
>gi|5858662|gb|AW009884.1|AW009884   ws88g09.x1   NCI_CGAP_Co3   Homo   sapiens
cDNA cl
one IMAGE:2505088 3' similar to gb:M65254 PROTEIN PHOSPHATASE PP2A, 65 KD
REGUL
ATORY SUBUNIT, BETA (HUMAN);, mRNA sequence
TTTTTCAATATGTGTGGTACTTTATTTTTTATGTTCTTTTTTTAAATCTGGGGTATTAGTCTGTGCTTTG
GGAGAAATGCACTAGCTCTGCAATTCCCAGCTGGGCAAGTGTGTCTCTAGTATCTCCACGCAACTGATAC
ACTGGTCCCTTCCCCATGTCCTCTCCAGGCACTGTGGGTCTTGGGAAGTGGTTCTTGTCAGCCCGAGGGA
CACTGGGTTCTCCACTGTCCTTCACAGGAAATTCTAGCTTCCTCAGCCTTTGTGCCACCACACTTATAGC
TTCCTGTGCAAAGTATTTGACATCCATGTCTTCATCTTGACCTAACTTCTGTAGTACTGGCTTCACTTCT
CCCTGTAAAGCATTGGTATCTAGAATTGGTCCAATCTTTTGTAGAGATTTGGCCACATTGAAGCGAACAT
TTGCTACTTGGTCTCCTGCCATTTTTAATACGATGGGCAGCATTTGCTTAGTAGTTATTTCCTGACCACA
GGCCTCAGACAGTGCATTAATGCAGAATAAAGTGGTCATTCTATGCAAGTAATTAGGATGATTTGCCATT
ACTAACACTT
```

FIGURE 388
SEQ ID NO: 380
```
Genbank ID         : NM_004418.2
Unigene ID(#167)   : Hs.1183
Unigene name       :    dual specificity phosphatase 2       DUSP2
>gi|12707563|ref|NM_004418.2| Homo sapiens dual specificity phosphatase 2
(DUSP
2), mRNA
GGAGTCGACCGCTCGGGCAGCGCACCGCCACGAGAGCCCGGGACGCGGGAAAGACCGAAAGGAAGAGGAA
GAGGCACCGGTGGCCATGGGGCTGGAGGCGGCGCGCGAGCTGGAGTGCGCGGCGCTGGGCACGCTGCTGC
GGGATCCGCGGGAGGCGGAACGCACGCTGCTGCTGGACTGCCGCCCCTTCCTGGCCTTCTGCCGGCGCCA
CGTGCGCGCCGCGCGGCCAGTGCCTTGGAACGCGCTGCTGCGGCGCCGCGCGCGCGGCCCTCCTGCCGCC
GTTCTCGCCTGCCTGCTGCCCGACCGCGCGCTGCGGACGCGCCTGGTCCGCGGGGAGCTGGCGCGGGCCG
TGGTGCTGGACGAGGGCAGTGCCTCGGTGGCGGAGCTCCGGCCCGACAGCCCGGCTCATGTGCTGCTGGC
CGCGCTGCTGCACGAGACCCGCGCGGGGCCCACTGCCGTGTACTTCCTGCGAGGAGGCTTCGACGGCTTC
CAGGGCTGCTGTCCCGATCTGTGCTCTGAGGCCCCCGCCCCTGCGCTGCCGCAACAGGGGACAAAACCA
GCCGCTCCGACTCCAGGGCTCCTGTCTACGACCAGGGTGGCCCTGTGGAGATCTTGCCCTACCTGTTCCT
GGGCAGCTGCAGTCACTCGTCAGACCTGCAGGGCTGCAGGCCTGTGGCATCACAGCCGTCCTCAACGTG
TCCGCCAGCTGCCCCAACCACTTTGAGGGCCTTTTCCGCTACAAGAGTATCCCTGTGGAGGACAACCAGA
TGGTGAGATCAGTTGCCTGGTTCCAAGGAGGCCATAGGCTTCATTGACTGGGTGAAGAACAGCGGAGGCCG
GGTGCTGGTGCACTGCCAGGCGGGTATCTCGCGCTCTGCCACCATCTGTCTGGCATACCTCATGCAGAGT
CGCCGTGTGCGGCTGGACGAGGCCTTTGACTTCGTTAAGCAGCGCCGGGGGGTCATCTCCCCCAACTTCA
GTTTCATGGGGCAGCTGCTGCAGTTTGAGACCCAGGTGCTGTGTCACTGAGGTGGTGCCCCTCTGCCTGC
CTGCCCCACTGTGCTGGCAGGAGCTGACTGTGGACTGGTGGGCTCCCCTCTGGGCCAGCACAGTCCCCTC
ACCTCCGGCAGGGCTGCTACCTCCTCAGAGTTTCAGAAGCCCCCACATGGGGCTCTAGGAATGCCGGCA
TGCTGGTCTTTCCGACCTGGTGCTCTTCTGCTGGGGACTGAGGCTGGCCCTCATTCGGGGTCGGGAACC
AAGGGTGTGTCTGCTCTTTCCCTCCCCATCCTCTGGCAGAAATCAGCTAGACGCTATACCGTGGACTCTC
CCTGGTCCACCACCATGTTGAAGCCCTTGGCAGCCTGAGAGCTCCAAGGAACAAGCTGTGACAACCAGGA
GCCCTGTCTGTGGGTTCGTCTGCCCAGGGCCTGGAGCCCAAGCCCTGTTCCTGGGGAAGCTGGGGACT
TGGGAAGTGATGGGTGTGTCATGTTGCGTGTGTCTGTCTGAGCCTTTCACACCTGTGCTGGCGCTGGA
AAATTATTTGTGCTCAGCTGACATTTAACACTTCCTCCCCCGCTTCCTCCTAGCCCTGTGGGCAGGGGTT
GGAAACTTAGCACTTTATATTTATACAGAACATTCAGGATTTGTCAATAAAATATTGTTATATTTAAAAA
AAAAAAAAAAAAAAAAAAAAAA
```

FIGURE 389
SEQ ID NO: 381
```
Genbank ID         : AF333388.1
Unigene ID(#167)   : acc_AF333388.1
Unigene name       :
>gi|13310411|gb|AF333388.1|AF333388 Homo sapiens metallothionein 1H-like
protei
```

FIGURE 389 cont'd n mRNA, complete cds
CCTCTTCTCTTCTCGCTTGGGAACGCCGGTCTCACCTCGGCTTGCAATGGACCCCAACTGCTCCTGCGCC
GCTGGAGGCTCCTACGCCTGCGCCGGCTCCTGCAAGTGCAAAAAGTGCAAATGCACCTCCTGCAAGAAGA
GCTGCTGCTCCTGTTGCCCCCTGGGCTGTGCCAAGTGTGCCCAGGGCTGCATCCGCAAAGGGGCTTCGGA
AAAGTGCAGCTGCTGTGCCTGATGTCGGGACTGCCCTGCTCTCGGATGAAAACAGAATGACACGTAAAGT
CCGGGATTTTTTTTTCTACAACTCCGACTCATTTGC

FIGURE 390
SEQ ID NO: 382
Genbank ID      : NM_007181.1
Unigene ID(#167) : Hs.95424
Unigene name    :    mitogen-activated   protein   kinase   kinase   kinase
kinase 1    MAP4K1
>gi|6005809|ref|NM_007181.1| Homo sapiens mitogen-activated protein kinase
kina
se kinase kinase 1 (MAP4K1), mRNA
GTCTTTATTTCAGTCCCGGATCCGCGGGCGCAGGCCCAGCTCAGGCCCCCAGGGATGGACGTCGTGGACC
CTGACATTTTCAATAGAGACCCCCGGGACCACTATGACCTGCTACAGCGGCTGGGTGGCGGCACGTATGG
GGAAGTCTTTAAGGCTCGAGACAAGGTGTCAGGGGACCTGGTGGCACTGAAGATGGTGAAGATGGAGCCT
GATGATGATGTCTCCACCCTTCAGAAGGAAATCCTCATATTGAAAACTTGCCGGCACGCCAACATCGTGG
CCTACCATGGGAGTTATCTCTGGTTGCAGAAACTCTGGATCTGCATGGAATTCTGTGGGCTGGTTCTCT
CCAGGACATCTACCAAGTGACAGGCTCCCTGTCAGAGCTCCAGATTAGCTATGTCTGCCGGGAAGTGCTC
CAGGGACTGGCCTATTTGCACTCACAGAAGAAGATACACAGGGACATCAAGGGAGCTAACATCCTCATCA
ATGATGCTGGGGAGGTCAGATTGGCTGACTTTGGCATCTCGGCCCAGATTGGGGCTACACTGGCCAGACG
CCTCTCTTTCATTGGGACACCCTACTGGATGGCTCCGGAAGTGGCAGCTGTGGCCCTGAAGGGAGGATAC
AATGAGCTGTGTGACATCTGGTCCCTGGGCATCACGGCCATCGAACTGGCCGAGCTACAGCCACCGCTCT
TTGATGTGCACCCTCTCAGAGTTCTCTTCCTCATGACCAAGAGTGGCTACCAGCCTCCCCGACTGAAGGA
AAAAGGCAAATGGTCGGCTGCCTTCCACAACTTCATCAAAGTCACTCTGACTAAGAGTCCCAAGAAACGA
CCCAGCGCCACCAAGATGCTCAGTCATCAACTGGTATCCCAGCCTGGGCTGAATCGAGGCCTGATCCTGG
ATCTTCTTGACAAACTGAAGAATCCCGGGAAAGGACCCTCCATTGGGGACATTGAGGATGAGGAGCCCGA
GCTACCCCCTGCTATCCCTCGGCGGATCAGATCCACCCACCGCTCCAGCTCTCTGGGGATCCCAGATGCA
GACTGCTGTCGGCGGCACATGGAGTTCAGGAAGCTCCGAGGAATGGAGACCAGACCCCCAGCCAACACCG
CTCGCCTACAGCCTCCTCGAGACCTCAGGAGCAGCAGCCCAGGAAGCAACTGTCAGAGTCGTCTGACGA
TGACTATGACGACGTGGACATCCCCACCCCTGCAGAGGACACACCTCCTCCACTTCCCCCCAAGCCCAAG
TTCCGTTCTCCATCAGACGAGGGTCCTGGGAGCATGGGGGATGATGGGCAGCTGAGCCCGGGGGTGCTGG
TCCGGTGTGCCAGTGGGCCCCCACCAAACAGCCCCGTCCTGGGCCTCCCCCATCCACCAGCAGCCCCCA
CCTCACCGCCCATTCAGAACCCTCACTCTGGAACCCACCCTCCCGGGAGCTTGACAAGCCCCCACTTCTG
CCCCCCAAGAAGGAAAAGATGAAGAGAAAGGGATGTGCCCTTCTCGTAAAGTTGTTCAATGGCTGCCCCC
TCCGGATCCACAGCACGGCCGCCTGGACACATCCCTCCACCAAGGACCAGCACCTGCTCCTGGGGGCAGA
GGAAGGCATCTTCATCCTGAACCGGAATGACCAGGAGGCCACGCTGGAAATGCTCTTTCCTAGCCGGACT
ACGTGGGTGTACTCCATCAACAACGTTCTCATGTCTCTCTCAGGAAAGACCCCCCACCTGTATTCTCATA
GCATCCTTGGCCTGCTGGAACGGAAAGAGACCAGAGCAGGAAACCCCATCGCTCACATTAGCCCCCACCG
CCTACTGGCAAGGAAGAACATGGTTTCCACCAAGATCCAGGACACCAAAGGCTGCCGGGCGTGCTGTGTG
GCGGAGGGTGCGAGCTCTGGGGGCCCGTTCCTGTGCGGTGCATTGGAGACGTCCGTTGTCCTGCTTCAGT
GGTACCAGCCCATGAACAAATTCCTGCTTGTCCGGCAGGTGCTGTTCCCACTGCCGACGCCTCTGTCCGT
GTTCGCGCTGCTGACCGGGCCAGGCTCTGAGCTGCCCGCTGTGTGCATCGGCGTGAGCCCCGGCGGCCG
GGGAAGTCGGTGCTCTTCCACACGGTGCGCTTTGGCGCGCTCTCTTGCTGGCTGGGCGAGATGAGCACCG
AGCACAGGGGACCCGTGCAGGTGACCCAGGTAGAGGAAGATATGGTGATGGTGTTGATGGATGGCTCTGT
GAAGCTGGTGACCCCGGAGGGGTCCCCAGTCCGGGGACTTCGCACACCTGAGATCCCCATGACCGAAGCG
GTGGAGGCCGTGGCTATGGTTGGAGGTCAGCTTCAGGCCTTCTGGAAGCATGGAGTGCAGGTGTGGGCTC
TAGGCTCGGATCAGCTGCTACAGGAGCTGAGAGACCCTACCCTCACTTTCCGTCTGCTTGGCTCCCCCAG
GCTGGAGTGCAGTGGCACGATCTCGCCTCACTGCAACCTCCTCCTCCCAGGTTCAAGCAATTCTCCTGCC
TCAGCCTCCCGAGTAGCTGGGATTACAGGCCTGTAGTGGTGGAGACACGCCCAGTGGATGATCCTACTGC
TCCCAGCAACCTCTACATCCAGGAATGAGTCCCTAGGGGGGTGTCAGGAACTAGTCCTTGCACCCCCTCC
CCCATAGACACACTAGTGGTCATGGCATGTCCTCATCTCCCAATAAACATGACTTTAGCCTCTGCAAAAA
AA

FIGURE 391
SEQ ID NO: 383
Genbank ID        : NM_000685.2
Unigene ID(#167)  : Hs.197063
Unigene name      :       angiotensin II receptor, type 1    AGTR1
>gi|6715581|ref|NM_000685.2| Homo sapiens angiotensin receptor 1 (AGTR1), trans
cript variant 1, mRNA
GACCCAAGAAGCAGCAACGCCCCTCACTATAAATTCGGAGCTGCCTCCTCGCCAATGATTCCAGCGCCTG
ACAGCCAGGACCCCAGGCAGCAGCGAGTGACAGGACGTCTGGACCGGCGCGCCGCTAGCAGCTCTGCCGG
GCCGCGGCGGTGATCGATGGGGAGCGGCTGGAGCGGACCCAGCGAGTGAGGGCGCACAGCCGGGACGCCG
AGGCGGCGGGCGGGAGACCCGCACCAGCGCAGCCGGCCCTCGGCGGGACGTGACGCAGCGCCCGGGGCGC
GGGTTTGATATTTGACAAATTGATCTAAAATGGCTGGGTTTTTATCTGAATAACTCACTGATGCCATCCC
AGAAAGTCGGCACCAGGTGTATTTGATATAGTGTTTGCAACAAATTCGACCCAGGTGATCAAAATGATTC
TCAACTCTTCTACTGAAGATGGTATTAAAAGAATCCAAGATGATTGTCCCAAAGCTGGAAGGCATAATTA
CATATTTGTCATGATTCCTACTTTATACAGTATCATCTTTGTGGTGGGAATATTTGGAAACAGCTTGGTG
GTGATAGTCATTTACTTTTATATGAAGCTGAAGACTGTGGCCAGTGTTTTTCTTTTGAATTTAGCACTGG
CTGACTTATGCTTTTTACTGACTTTGCCACTATGGGCTGTCTACACAGCTATGGAATACCGCTGGCCCTT
TGGCAATTACCTATGTAAGATTGCTTCAGCCAGCGTCAGTTTCAACCTGTACGCTAGTGTGTTTCTACTC
ACGTGTCTCAGCATTGATCGATACCTGGCTATTGTTCACCCAATGAAGTCCCGCCTTCGACGCACAATGC
TTGTAGCCAAAGTCACCTGCATCATCATTTGGCTGCTGGCAGGCTTGGCCAGTTTGCCAGCTATAATCCA
TCGAAATGTATTTTTCATTGAGAACACCAATATTACAGTTTGTGCTTTCCATTATGAGTCCCAAAATTCA
ACCCTTCCGATAGGGCTGGGCCTGACCAAAAATATACTGGGTTTCCTGTTTTCCTTTTCTGATCATTCTTA
CAAGTTATACTCTTATTTGGAAGGCCCTAAAGAAGGCTTTATGAAATTCAGAAGAACAAACCAAGAAATGA
TGATATTTTTAAGATAATTATGGCAATTGTGCTTTTCTTTTTCTTTTCCTGGATTCCCCACCAAATATTC
ACTTTTCTGGATGTATTGATTCAACTAGGCATCATACGTGACTGTAGAATTGCAGATATTGTGGACACGG
CCATGCCTATCACCATTTGTATAGCTTATTTTAACAATTGCCTGAATCCTCTTTTTATGGCTTTCTGGG
GAAAAAATTTAAAAGATATTTCTCCAGCTTCTAAAATATATTCCCCAAAAGCCAATCCCACTCAAAC
CTTTCAACAAAATGAGCACGCTTTCCTACCGCCCCTCAGATAATGTAAGCTCATCCACCAAGAAGCCTG
CACCATGTTTTGAGGTTGAGTGACATGTTCGAAACCTGTCCATAAAGTAATTTTGTGAAAGAAGGAGCAA
GAGAACATTCCTCTGCAGCACTTCACTACCAAATGAGCATTAGCTACTTTTCAGAATTGAAGGAGAAAT
GCATTATGTGGACTGAACCGACTTTTCTAAAGCTCTGAACAAAAGCTTTTCTTTCCTTTTGCAACAAGAC
AAAGCAAAGCCACATTTTGCATTAGACAGATGACGGCTGCTCGAAGAACAATGTCAGAAACTCGATGAAT
GTGTTGATTTGAGAAATTTTACTGACAGAAATGCAATCTCCCTAGCCTGCTTTTGTCCTGTTATTTTTA
TTTCCACATAAAGGTATTTAGAATATATTAAATCGTTAGAGGAGCAACAGGAGATGAGAGTTCCAGATTG
TTCTGTCCAGTTTCCAAAGGGCAGTAAAGTTTTCGTGCCGGTTTTCAGCTATTAGCAACTGTGCTACACT
TGCACCTGGTACTGCACATTTTGTACAAAGATATGCTAAGCAGTAGTCGTCAAGTTGCAGATCTTTTTGT
GAAATTCAACCTGTGTCTTATAGGTTTACACTGCCAAAACAATGCCCGTAAGATGGCTTATTTGTATAAT
GGTGTTACTAAAGTCACATATAAAAGTTAAACTACTTGTAAAGGTGCTGCACTGGTCCCAAGTAGTAGTG
TCCTCCTAGTATATTAGTTTGATTTAATATCTGAGAAGTGTATATAGTTTGTGGTAAAAGATTATATAT
CATAAAGTATGCCTTCCTGTTTAAAAAAGTATATATTCTACACATATATATATGTATATCTATATCT
CTAAACTGCTGTTAATTGATTAAAATCTGGCAAAGTTATATTTACTTTAAAATAAAATAATTTTATTGCG
GGAATTC

FIGURE 392
SEQ ID NO: 384
Genbank ID        : AA766126
Unigene ID(#167)  : acc_AA766126
Unigene name      :
>gi|2817364|gb|AA766126.1|AA766126 oa27f10.s1 NCI_CGAP_GCB1 Homo sapiens cDNA c
lone IMAGE:1306219 3' similar to gb:M21121 T-CELL SPECIFIC RANTES PROTEIN PRECU
RSOR (HUMAN);, mRNA sequence
ATCACTGTTTTAATTATGGCATTTCCCCACTGGGAACATTCCTTACAATCAAAAGAAGTGTTATACATAC
TTAACACTTCTGTTCTTACAATATATTCAGCAGTATCAGTTACAACCATTTGGGTATGTGAACTGTTCGC
TAAATAAAACATCATACAGTAAGTTTCAAGGGCCACAATGGTATGGCCTCTTCTACCACAGACAAATAGA
TTAATTTTGGCAGGCGTTGGAAATCTGGTAGGTCATGGTAGCTTCATCAGAAACATGCAGTCCTTTCCTT
CGTTAGAGGCATCAGTTCTTAGACTGCTGGAGGGCTTCAGTGTAGTAAATCTATATACATAGTCCCCAAT FIGURE 392 cont'd

TTTTTTTTTTTTGATTTTGAGATGGAGTCTCGCTCTGTTGCCCAGGCT

FIGURE 393
SEQ ID NO: 385
Genbank ID      : NM_003051.1
Unigene ID(#167) : Hs.75231
Unigene name    :      solute   carrier   family   16   (monocarboxylic   acid
transporters), member 1 SLC16A1
>gi|4506982|ref|NM_003051.1|   Homo   sapiens   solute   carrier   family   16
(monocarboxy
lic acid transporters), member 1 (SLC16A1), mRNA
TCTACACTTAAAATGCCACCAGCAGTTGGAGGTCCAGTTGGATACACCCCCCAGATGGAGGCTGGGGCT
GGGCAGTGGTAATTGGAGCTTTCATTTCCATCGGCTTCTCTTATGCATTTCCCAAATCAATTACTGTCTT
CTTCAAAGAGATTGAAGGTATATTCCATGCCACCACCAGCGAAGTGTCATGGATATCCTCCATAATGTTG
GCTGTCATGTATGGTGGAGGTCCTATCAGCAGTATCCTGGTGAATAAATATGGAAGTCGTATAGTCATGA
TTGTTGGTGGCTGCTTGTCAGGCTGTGGCTTGATTGCCAGCTTCTTTCTGTAACACCGTACAGCAACTATA
CGTCTGTATTGGAGTCATTGGAGGTCTTGGGCTTGCCTTCAACTTGAATCCAGCTCTGACCATGATTGGC
AAGTATTTCTACAAGAGGCGACCATTGGCCAACGGACTGGCCATGGCAGGCAGCCCTGTGTTCCTCTGTA
CTCTGGCCCCCCTCAATCAGGTTTTCTTCGGTATCTTTGGATGGAGAGGAAGCTTTCTAATTCTTGGGGG
CTTGCTACTAAACTGCTGTGTTGCTGGAGCCCTCATGCGACCAATCGGGCCCAAGCCAACCAAGGCAGGG
AAAGATAAGTCTAAAGCATCCCTTGAGAAAGCTGGAAAATCTGGTGTGAAAAAAGATCTGCATGATGCAA
ATACAGATCTTATTGGAAGACACCCTAAACAAGAGAAACGATCAGTCTTCCAAACAATTAATCAGTTCCT
GGACTTAACCCTATTCACCCACAGAGGCTTTTGCTATACCTCTCTGGAAATGTGATCATGTTTTTTGGA
CTCTTTGCACCTTTGGTGTTTCTTAGTAGTTATGGGAAGAGTCAGCATTATTCTAGTGAGAAGTCTGCCT
TCCTTCTTTCCATTCTGGCTTTTGTTGACATGGTAGCCCGACCATCTATGGGACTTGTAGCCAACACAAA
GCCAATAAGACCTCGAATTCAGTATTTCTTTGCGGCTTCCGTTGTTGCAAATGGAGTGTGTCATATGCTA
GCACCTTTATCCACTACCTATGTTGGATTCTGTGTCTATGCGGGATTCTTTGGATTTGCCTTCGGGTGGC
TCAGCTCCGTATTGTTTGAAACATTGATGGACCTTGTTGGACCCCAGAGGTTCTCCAGCGCTGTGGGATT
GGTGACCATTGTGGAATGCTGTCCTGTCCTCCTGGGGCCACCACTTTTAGGTCGGCTCAATGACATGTAT
GGAGACTACAAATACACATACTGGGCATGTGGCGTCGTCCTAATTATTTCAGGTATCTATCTCTTCATTG
GCATGGGCATCAATTATCGACTTTTGGCAAAAGAACAGAAAGCAAACGAGCAGAAAAAGGAAAGTAAAGA
GGAAGAGACCAGTATAGATGTTGCTGGGAAGCCAAATGAAGTTACCAAAACAGCAGAATCTCCGGACCAG
AAAGACACAGAAGGAGGGCCCAAGGAGGAGGAAAGTCCAGTCTGAATCCATGGGGCTGAAGGGTAAATTG
AGCAGTTCATGACCCAGGATATCTGAAAATATTCTACTGGCCTGTAATCTACCAGTGGTGCTCAATGCAA
ATAGTAGACATTTGTGTGGAAATCATACCAGTTGTTCATTGATGGGATTTTTGTTTGACTCCTTACCAAT
AGCCTGAATTTGAGGAGGGAATGATTGGTAGCAAAGGATGGGGGAAAGAAGTAGGTTCTGTTTTGTTTTG
TTTTAATCTTAGCTTTTAATAGTGTCATAAAGATTATAATATGTGCCTTAAGTTTTAGTCTTTAGAACTC
TAGAGAGCCTTAACTTCTTAAACCATTTTTGCTGAATTCATCTATTTCGAGTGTTGTGTTAAAAGGAAAA
ATAACAACTAACTTGTTTGAGGCAAATCTAAAATTTAAAATTAATCTTGCTTCATTGTTACATGTAATAT
ATTTCAGACATTTTCACTGGAAGATTTATGAACAGAAATATTGGTTGAAAGTTAGAGATTTTACAAAATG
CTGACAAAAATATTTTCCTAGCATCAGTAGATTTCTGGCATATGTTTCTGCTAGCTATATATTTAGGAAA
TTCAAAGCATAAAACTTTGGCAACATCTTGGCTGTTCTAGACACAGTGTACTTGTCAACCCCTCTCAGGT
ACCTTTTCTTGGGATGCTTATTAGAAGCCAAGTAAAGTGCTTAAGGTTTGTTTTCATTAAATTAGCTATT
TCTGCTCCCCTGTTCAAAGATGCATTTTGAGTGTTTATAGATCACTGCCCTTTTTGAAATCACCTGGTAT
TATTTTTCTTACTGGAAAAGTTAGTATTAAAATCTACAGAACTACATATTTGTGCCTCCTTGGTAAATAC
AACACATCTAATTAAATGTAGACAGATATTTCAAACATCAGCTGAATTCACTTAAGTTTTTCCAAAACCT
CAGTTAAACTGTGAAGCTATTGGAATTTTTTTTCCTGGAATTTTTCCCCTTTGATTCACAGTGGTCCCA
TTTATATCTGCTTCTAGCTTAGTGCTATGTGTGAGATATGTGTGTGTTTGGTGTTTTT

FIGURE 394
SEQ ID NO: 386
Genbank ID      : AI935710
Unigene ID(#167) : Hs.530456
Unigene name    :      Transcribed sequences
>gi|5674580|gb|AI935710.1|AI935710   wo99g11.x1   NCI_CGAP_Kid11   Homo   sapiens
cDNA
clone IMAGE:2463524 3', mRNA sequence
TTTTTTTTGTTTTTGATATGCAGATTTAAAAATACTAGGGCGATTTTAATAGATGATAAATCTCCAGTAT

FIGURE 394 cont'd

```
CACAAGGATTAGGGAAAGCAAAAGACCTGAAAAGTAATACCAGTTCTCAGTTCTCTAACTCTCAAAAGGC
ATTCCACAGGTAAATTCGGTGAAAGGGCCGGCAATTGTTCAAATGTTTAAATAAGAAGAAGTTGTAGTTC
TCACATTTCCAGTTCTCTTACAGGTGTGTGTATTTGGAAAGATAATACTCTCTAATGTTGGTCTTTTCCA
TTGTTCAGGTTTATCCTGTTGTTAAGTAATAAGCAGCAATCCAAATACAAACATATTGTACAACAGCTAT
TAATGAACATCACCTGAGTTCAGTGTGCCTGACAGCTGACACTTAGTTAATTTCTCCATGAAACAAGAAC
AGTGAAACTTCCACAGATGAGAAAACAGAATCATCAGTGGCACTGGGATGTAAACCCAAGTACCTGCTTT
GCATTTCATTTGCTCTGTTTTTCAGAACTACACTNTACGACATGA
```

FIGURE 395
SEQ ID NO: 387
Genbank ID         : AI375083
Unigene ID(#167)   : Hs.31522
Unigene name       :      leucine rich repeat and fibronectin type III domain
containing 5       LRFN5
>gi|4175073|gb|AI375083.1|AI375083   ta56b09.x1   Soares_total_fetus_Nb2HF8_9w Homo
sapiens cDNA clone IMAGE:2048057 3', mRNA sequence

```
AAACATTTATTTGTTAAAGTGATATAGATTATTCAAGATTCTACAGTCTGTTAAATCATGGATGGCAATG
TAAGATGGATTGATACAGAACTTGATGCCAATGTAGGCTTTTTTTCTTTTTTAAAAAAAAAATACTTGTA
GGCCAGAAGAAAAAAAAATTTGGTTTTAAAAGAGGATGAACCATGGTCTAATGGAGCCAGTTCCGCCGTC
ATCAGAGACTTTCACCTTGGCTCCTGTAGACAATTTCTTCTACGACACCAGTTCAACAATTAGCCTTTGT
GAATTGAAACATTTTTGAATTTTATCCAGTAAAAATATCAGTGGCAAATTTTTTCAGGAGAGAGAGGAGA
AGTGGTGCTCTTCAGATTAACTCCAGCCTCTGTGTTTCCTGGACAATCTGGTCAACATTAGTCAGCAAAG
CATTTGGCTTTATATGTGCTCTTTTAGACGTGGGCCCCTCTGTGACAGAATCG
```

FIGURE 396
SEQ ID NO: 388
Genbank ID         : NM_018846.1
Unigene ID(#167)   : Hs.376793
Unigene name       :      SBBI26 protein      SBBI26
>gi|9055325|ref|NM_018846.1|   Homo sapiens SBBI26 protein (SBBI26), mRNA

```
CGGACGCGTGGGCGGACGCGTGGGCGAGCCACCGCCGCCTGCCGCGCGTTCCAGAGCTGGGCGCTGCAGC
TGCACTGCCGATCGCCGTGTTTGGTCGATAGAATCCCCAGTGTGCCCAGAGAGTGCGACCCCTCGCCCGG
CCCGGCGAGCCCCGGGCGTGAACCGAGCTGAGGGAGGATGGCAGCCTCTGGGGTGGAGAAGAGCAGCAAG
AAGAAGACCGAGAAGAAACTTGCTGCTCGGGAAGAAGCTAAATTGTTGGCGGGTTTCATGGGCGTCATGA
ATAACATGCGGAAACAGAAAACGTTGTGTGACGTGATCCTCATGGTCCAGGAAAGAAAGATACCTGCTCA
TCGTGTTGTTCTTGCTGCAGCCAGTCATTTTTTTAACTTAATGTTCACAACTAACATGCTTGAATCAAAG
TCCTTTGAAGTAGAACTCAAAGATGCTGAACCTGATATTATTGAACAACTGGTGGAATTTGCTTATACTG
CTAGAATTTCCGTGAATAGCAACAATGTTCAGTCTTTGCTGGATGCAGCAAACCAATATCAGATTGAACC
TGTGAAGAAAATGTGTGTTGATTTTTTGAAAGAACAAGTTGATGCTTCAAATTGTCTTGGAGAAGCAGAA
AAAGTTGATCAGAGCCTTCCAGAGTGTGGTATGCTTTTCACTGTGTGATGATCCTTAGTGGCACATGAAT
GAACGTCCAGATGTTTGTGCAGTAGCCCACCCTTATCTGCAGGATACGTTCCAAGACCCCCAGTGAATGC
CTGAAACTGCAGATAGTACTGAATCCTATATATACTGTGTTTTTATGATACATACATGCCTATGATGAA
GTTTAATTTCTAAATTAGACAGTAAAAGATTAACAACAATAATAATAAAATAGAACAACTTTAAAAAAAA
AAAAAAAAAAAA
```

FIGURE 397
SEQ ID NO: 389
Genbank ID         : AI677701
Unigene ID(#167)   : Hs.201619
Unigene name       :      RNA-binding    region    (RNP1,    RRM)    containing    6
       RNPC6
>gi|4887883|gb|AI677701.1|AI677701   wd33d11.x1   Soares_NFL_T_GBC_S1   Homo
sapiens
cDNA clone IMAGE:2329941 3', mRNA sequence

```
AAAAATTATATTTAATACAAGTGAATAGATTAGAAGATCTGAAATGTTATAAAGCAATATACACAACGAA
TAAATAATTTGCACAGGAGAGTCATGTCTACATTACATAACACTGTCTAGTATGGGAATACTTAAAGTAA
```

FIGURE 397 cont'd

ATCCAGTGATAATGGAGAAAGTCCATAAAAATGCTAACCTGTCTTCCCTTGTATGAAATTGTTCAAGTAT
AAAAATCCAATTCAGTGTAAAATAGGATTCAATTTAGTTTAAGAATAAAAATTGCAAGTATTGCAGTTTC
AGAAGAAAAATGTAAAGCAGCATTTAAAAACTACATAATAGTGTTAAACTAATGAATTACCAATAAATGA
AATCTACACAGGCAAAATCAGAGGAGGAAGCATGAAACTAGCAATATATCGTTTAAAAAAAAATCTAAAA
ACTAAACTAAAATGTGTTAATGTAAGAGTACTCTCTTATACAGTGCACATATGAATTTAAATAAATCCAA
GTCAACATCTTTAGNTGAATAG

FIGURE 398
SEQ ID NO: 390
Genbank ID       : NM_006623.1
Unigene ID(#167) : Hs.3343
Unigene name     :       phosphoglycerate dehydrogenase      PHGDH
>gi|5729973|ref|NM_006623.1|  Homo  sapiens  phosphoglycerate  dehydrogenase
(PHGDH
), mRNA
CACCTTTCCGCGGGCCGCGGGGATGGCGGCGCAGGGCGTAGGGCCTGGGCCGGGGTCGGCGGCGCCCCG
GGGCTGGAGGCGGCCCGGCAGAAGCTGGCGCTGCGGCGGAAGAAGGTGCTGAGCACCGAAGGAGATGGAG
CTGTACGAGCTGGCGCAGGCGGCGGGCGGCGCTATCGACCCCGACGTGTTCAAGATCCTGGTGGACCTGC
TGAAGCTGAACGTGGCCCCCCTCGCCGTCTTCCAGATGCTCAAGTCCATGTGTGCCGGGCAGAGGCTAGC
GAGCGAGCCCCAGGACCCTGCGGCCGTGTCTCTGCCCACGTCGAGCGTGCCCGAGACCGAGGGAGAAAC
AAAGGCAGCGCTGCCCTCGGGGGAGCATTGGCCCTGGCGGAACGCAGCAGCCGCGAAGGATCCAGCCAGA
GGATGCCACGCCAGCCCAGCGCTACCAGGCTGCCCAAGGGGGCGGGCCTGGGAAGAGCCCTACACGGGG
CAGCACCTAGGATGGGGCAGAGACTTGTTGCATCTTTGTCCCCAGCAAAGGCTACATGTTACCTCCTTCA
ATTGATAATAAACCTTTCTGAGATGCAAACTCGAGAATACTGCCCAGTTACTCTAGCGCGCCAGGCCGAA
CCGCAGCTTCTTGGCTTAGGTACTTCTACTCACAGCGGCCGATTCCGAGGCCAACTCCAGCAATGGCTTT
TGCAAATCTGCGGAAAGTGCTCATCAGTGACAGCCTGGACCCTTGCTGCCGGAAGATCTTGCAAGAGGGA
GGGCTGCAGGTGGTGGAAAAGCAGAACCTTAGCAAAGAGGAGCTGATAGCGGAGCTGCAGGACTGTGAAG
GCCTTATTGTTCGCTCTGCCACCAAGGTGACCGCTGATGTCATCAACGCAGCTGAGAAACTCCAGGTGGT
GGGCAGGGCTGGCACAGGTGTGGACAATGTGGATCTGGAGGCCGCAACAAGGAAGGGCATCTTGGTTATG
AACACCCCCAATGGGAACAGCCTCAGTGCCGCAGAACTCACTTGTGGAATGATCATGTGCCTGGCCAGGC
AGATTCCCCAGGCGACGGCTTCGATGAAGGACGGCAAATGGGAGCGGAAGAAGTTCATGGGAACAGAGCT
GAATGGAAAGACCCTGGGAATTCTTGGCCTGGGCAGGATTGGGAGAGAGGTAGCTACCCGGATGCAGTCC
TTTGGGATGAAGACTATAGGGTATGACCCCATCATTTCCCCAGAGGTCTCGGCCTCCTTTGTGTTCAGC
AGCTGCCCCTGGAGGAGATCTGGCCTCTCTGTGATTTCATCACTGTGCACACTCCTCCTGCCCTCCAC
GACAGGCTTGCTGAATGACAACACCTTTGCCCAGTGCAAGAAGGGGGTGCGTGTGGTGAACTGTGCCCGT
GGAGGGATCGTGGACGAAGGCGCCCTGCTCCGGGCCCTGCAGTCTGGCCAGTGTGCCGGGGCTGCACTGG
ACGTGTTTACGGAAGAGCCGCCACGGGACCGGGCCTTGGTGGACCATGAGAATGTCATCAGCTGTCCCCA
CCTGGGTGCCAGCACCAAGGAGGCTCAGAGCCGCTGTGGGGAGGAAATTGCTGTTCAGTTCGTGGACATG
GTGAAGGGGAAATCTCTCACGGGGGTTGTGAATGCCCAAGCCCTTACCAGTGCCTTCTCTCCACACACCA
AGCCTTGGATTGGTCTGGCAGAAGCTCTGGGGACACTGATGCGAGCCTGGGCTGGGTCCCCCAAAGGGAC
CATCCAGGTGATAACACAGGGAACATCCCTGAAGAATGCTGGGAACTGCCTAAGCCCCGCAGTCATTGTC
GGCCTCCTGAAAGAGGCTTCCAAGCAGGCGGATGTGAACTTGGTGAACGCTAAGCTGCTGGTGAAAGAGG
CTGGCCTCAATGTCACCACCTCCCACAGCCCTGCTGCACCAGGGAGCAAGGCTTCGGGGAATGCCTCCT
GGCCGTGGCCCTGGCAGGCGCCCCTTACCAGGCTGTGGGCTTGGTCCAAGGCACTACACCTGTACTGCAG
GGGCTCAATGGAGCTGTCTTCAGGCCAGAAGTGCCTCTCCGCAGGGACCTGCCCCTGCTCCTATTCCGGA
CTCAGACCTCTGACCCTGCAATGCTGCCTACCATGATTGGCCTCCTGGCAGAGGCAGGCGTGCGGCTGCT
GTCCTACCAGACTTCACTGGTGTCAGATGGGGAGACCTGGCACGTCATGGGCATCTCCTCCTTGCTGCCC
AGCCTGGAAGCGTGGAAGCAGCATGTGACTGAAGCCTTCCAGTTCCACTTCTAACCTTGGAGCTCACTGG
TCCCTGCCTCTGGGGCTTTTCTGAAGAAACCCACCCACTGTGATCAATAGGGAGAGAAAATCCACATTCT
TGGGCTGAACGCGGGCCTCTGACACTGCTTACACTGCACTCTGACCCTGTAGTACAGCAATAACCGTCTA
ATAAAGAGCCTACCCCCAAAAAAAAAA

FIGURE 399
SEQ ID NO: 391
Genbank ID       : NM_012411.1
Unigene ID(#167) : Hs.87860
Unigene name     :       protein tyrosine phosphatase, non-receptor type 22
(lymphoid) PTPN22

FIGURE 399 cont'd

>gi|6912613|ref|NM_012411.1| Homo sapiens protein tyrosine phosphatase, non-rec
eptor type 22 (lymphoid) (PTPN22), mRNA
TCCCTCAACCTACTTATAGACTATTTTTCTTGCTCTGCAGCATGGACCAAAGAGAAATTCTGCAGAAGTT
CCTGGATGAGGCCCAAAGCAAGAAAATTACTAAAGAGGAGTTTGCCAATGAATTTCTGAAGCTGAAAAGG
CAATCTACCAAGTACAAGGCAGACAAAACCTATCCTACAACTGTGGCTGAGAATGCCAAGAATATCAAGA
AAAACAGATATAAGGATATTTTGCCCTATGATTATAGCCGGGTAGAACTATCCCTGATAACCTCTGATGA
GGATTCCAGCTACATCAATGCCAACTTCATTAAGGGAGTTTATGGACCCAAGGCTTATATTGCCACCCAG
GGTCCTTTATCTACAACCCTCCTGGACTTCTGGAGGATGATTTGGGAATATAGTGTCCTTATCATTGTTA
TGGCATGCATGGAGTATGAAATGGGAAGAAAAAGTGTGAGCGCTACTGGGCTGAGCCAGGAGAGATGCA
GCTGGAATTTGGCCCTTTCTCTGTATCCTGTGAAGCTGAAAAAAGGAAATCTGATTATATAATCAGGACT
CTAAAAGTTAAGTTCAATAGTGAAACTCGAACTATCTACCAGTTTCATTACAAGAATTGGCCAGACCATG
ATGTACCTTCATCTATAGACCCTATTCTTGAGCTCATCTGGGATGTACGTTGTTACCAAGAGGATGACAG
TGTTCCCATATGCATTCACTGCAGTGCTGGCTGTGGAAGGACTGGTGTTATTTGTGCTATTGTTGATTAT
ACATGGATGTTGCTAAAAGATGGGATAATTCCTGAGAACTTCAGTGTTTTCAGTTTGATCCGGGAAATGC
GGACACAGAGGCCTTCATTAGTTCAAACGCAGGAACAATATGAACTGGTCTACAATGCTGTATTAGAACT
ATTTAAGAGACAGATGGATGTTATCAGAGATAAACATTCTGGAACAGAGAGTCAAGCAAAGCATTGTATT
CCTGAGAAAAATCACACTCTCCAAGCAGACTCTTATTCTCCTAATTTACCAAAAAGTACCACAAAAGCAG
CAAAAATGATGAACCAACAAAGGACAAAAATGGAAATCAAAGAATCTTCTTCCTTTGACTTTAGGACTTC
TGAAATAAGTGCAAAAGAAGAGCTAGTTTTGCACCCTGCTAAATCAAGCACTTCTTTTGACTTTCTGGAG
CTAAATTACAGTTTTGACAAAAATGCTGACACAACCATGAAATGGCAGACAAAGGCATTTCCAATAGTTG
GGGAGCCTCTTCAGAAGCATCAAAGTTTGGATTTGGGCTCTCTTTTGTTTGAGGGATGTTCTAATTCTAA
ACCTGTAAATGCAGCAGGAAGATATTTTAATTCAAAGGTGCCAATAACACGGACCAAATCAACTCCTTTT
GAATTGATACAGCAGAGAGAAACCAAGGAGGTGGACAGCAAGGAAAACTTTTCTTATTTGGAATCTCAAC
CACATGATTCTTGTTTTGTAGAGATGCAGGCTCAAAAAGTAATGCATGTTTCTTCAGCAGAACTGAATTA
TTCACTGCCATATGACTCTAAACACCAAATACGTAATGCCTCTAATGTAAAGCACCATGACTCTAGTGCT
CTTGGTGTATATTCTTACATACCTTTAGTGGAAAATCCTTATTTTTCATCATGGCCTCCAAGTGGTACCA
GTTCTAAGATGTCTCTTGATTTACCTGAGAAGCAAGATGGAACTGTTTTTCCTTCTTCTCTGTTGCCAAC
ATCCTCTACATCCCTCTTCTCTTATTACAATTCACATGATTCTTTATCACTGAATTCTCCAACCAATATT
TCCTCACTATTGAACCAGGAGTCAGCTGTACTAGCAACTGCTCCAAGGATAGATGATGAAATCCCCCCTC
CACTTCCTGTACGGACACCTGAATCATTTATTGTGGTTGAGGAAGCTGGAGAATTCTCACCAAATGTTCC
CAAATCCTTATCCTCAGCTGTGAAGGTAAAAATTGGAACATCACTGGAATGGGGTGGAACATCTGAACCA
AAGAAATTTGATGACTCTGTGATACTTAGACCAAGCAAGAGTGTAAAACTCCGAAGTCCTAAATCAGGTA
AAAAATTTCTCTTGGCTTTAGATGACATTTAGCCCTAAGATTGGAAGAATGGTTCGTTAAGTTTAGAGTAA
TTCACTTCAGGAAGTTACTTGGTTCCCATAATAGCTTCCAGTATTCATTGATTTATTTCTGGCTTTCCCA
GACTAGAAATTTTGTAAAGAGTCATGGGGGAAGCTAGGGCTAACCAGAAAATAAAATAAAAATAATGGGA
TAAAAAATCGGAACTACTGTTTTCCCCCTAGTCGGAGCACATCCGG

FIGURE 400
SEQ ID NO: 392
Genbank ID       : AF074979.1
Unigene ID(#167) : Hs.141492
Unigene name     :   regulator of G-protein signalling 20    RGS20
>gi|3523159|gb|AF074979.1|AF074979 Homo sapiens regulator of G protein signalin
g-Z (RGSZ1) mRNA, complete cds
ATGGGATCAGAGCGGATGGAGATGCGGAAGCGGCAGATGCCCGCCGCCCAGGACACACCAGGCGCCGCCC
CAGGCCAGCCCGGAGCGGGGAGTCGCGGGTCCAACGCATGCTGCTTCTGCTGGTGCTGCTGTTGTAGCTG
CTCGTGTCTCACTGTTAGAAACCAGGAAGATCAGAGGCCCACAATAGCTTCCCACGAACTCAGAGCAGAT
CTTCCAACCTGGGAAGAAAGCCCTGCTCCTACTCTGGAAGAAGTCAACGCCTGGGCTCAGTCATTTGACA
AATTAATGGTCACTCCAGCAGGAAGGAATGCATTCCGTGAATTCCTCCGAACAGAATTCAGTGAGGAAAA
TATGCTCTTCTGGATGGCCTGTGAGGAACTGAAAAAGGAAGCTAATAAAAACATTATTGAAGAGAAAGCA
AGGATAATCTATGAAGACTACATTTCTATACTTTCTCCTAAGGAGGTGAGCTTAGACTCCCGGGTGAGAG
AAGTGATCAACAGAAACATGGTGGAGCCATCCCAACACATATTCGATGATGCTAACTTCAGATTTACAC
CCTGATGCACAGAGACTCATATCCTCGATTCATGAACTCTGCTGTCTATAAGGACTTGCTTCAGTCCTTA
TCGGAGAAATCTATTGAAGCATAGGATTTTTCAAATATATTTATTATTAATAAAATAATAAAAGAATTCA
TGGGCTACAACTAGCACAGGGAATTTAGAGGTTGTAGCATCTTCTGCTGGAGTAATACTCAGGCTATTCT
AATAACAGATGATTCCTTCAACAGACTGCTATATATTCACCATGTAAACTGCAGCCACCTTTAGTGATAC
TTTTGAAAAAAAAAAATAAAGGGATATGGCTGTTGTAGAAAGATAGCGTATTTGCATTTACAATAACAGT
AGCATGTTGTCAGTGGCCAAGGCTACACAGAAGGCTCCCTGCTGCCCGGAGCAGGTACATCCACCAGAGC

FIGURE 400 cont'd

```
AAAGGGAACCACTTTTATTTTGCATGAGTTTGGTAACTGATTACTCTCCCCTCAAAGAAAAGACATTCAG
GTGTTTCTCAACGACATCTTCTGTCCAGCAAGCTCGGTTTGAATACGTCACTTACCAGTGCCATTGCAGG
ACCCAAATTCACAGTTCATAAAAGATGTGACCACTACATGTAAAAATAGCATTCTACTTGATCTTACAGT
ATGTATGTATGTATGTATGGAGACATATGTGTGTGTGTGGATGTCTACATGGTTAATGGAAAGCACTGTG
CTCTGAAGTGGATCAGTCTCAAGTGTCTGGTAACAGCAGCAGTGCTTAGAAAATTCTTTTGTTGAAAAGA
GTTACTGTTATTATCAGAATTTGCCAACCTAAAGAATGAATTTTTAAATTCATAACTTGGTCATGTTCAC
AACAAAACTGTCAAATAAGCATATTTCCATTTTTATTACTGAAAGAAATATGGGCATTTTCATTCTTTAA
AGAAATAAAGCACAAGAATTTTATCTC
```

FIGURE 401
SEQ ID NO: 393
Genbank ID        : NM_004221.1
Unigene ID(#167)  : Hs.943
Unigene name      :       natural killer cell transcript 4    NK4
>gi|4758811|ref|NM_004221.1| Homo sapiens natural killer cell transcript 4 (NK4
), mRNA

```
TCTAAAGCTCAGTGGAGCTGGGTCATCTCAGGCCTTGGCTCCTTGAACTTTTGGCCGCCATGTGCTTCCC
GAAGGTCCTCTCTGATGACATGAAGAAGCTGAAGGCCCGAATGGTAATGCTCCTCCCTACTTCTGCTCAG
GGGTTGGGGGCCTGGGTCTCAGCGTGTGACACTGAGGACACTGTGGGACACCTGGGACCCTGGAGGGACA
AGGATCCGGCCCTTTGGTGCCAACTCTGCCTCTCTTCACAGCACCAGGCCATAGAAAGATTTTATGATAA
AATGCAAAATGCAGAATCAGGACGTGGACAGGTGATGTCGAGCCTGGCAGAGCTGGAGGACGACTTCAAA
GAGGGCTACCTGGAGACAGTGGCGGCTTATTATGAGGAGCAGCACCAGAGCTCACTCCTCTACTTGAAA
AAGAAAGAGATGGATTACGGTGCCGAGGCAACAGATCCCCTGTCCCGGATGTTGAGGATCCCGCAACCGA
GGAGCCTGGGGAGAGCTTTTGTACAAGGTCATGAGATGGTTCCAGGCCATGCTGCAGCGGCTGCAGACC
TGGTGGCACGGGGTTCTGGCCTGGGTGAAGGAGAAGGTGGTGGCCCTGGTCCATGCAGTGCAGGCCCTCT
GGAAACAGTTCCAGAGTTTCTGCTGCTCTCTGTCAGAGCTCTTCATGTCCTCTTTCCAGTCCTACGGAGC
CCCACGGGGGGACAAGGAGGAGCTGACACCCCAGAAGTGCTCTGAACCCCAATCCTCAAAATGAAGATAC
TGACACCACCTTTGCCCTCCCCGTCACCGCGCACCCACCCTGACCCCTCCCTCAGCTGTCCTGTGCCCCG
CCCTCTCCCGCACACTCAGTCCCCCTGCCTGGCGTTCCTGCCGCAGCTCTGACCTGGTGCTGTCGCCCTG
GCATCTTAATAAAACCTGCTTATACTTCCCTGGCAGGGAGATACCATG
```

FIGURE 402
SEQ ID NO: 394
Genbank ID        : NM_014668.1
Unigene ID(#167)  : Hs.438037
Unigene name      :       GREB1 protein    GREB1
>gi|7662187|ref|NM_014668.1| Homo sapiens GREB1 protein (GREB1), mRNA

```
GATGTCTTGGACATGCTCTGGCTGGCTAATCTCCATGTTCTAGCCGACTGAAAATACGGTGGCCAAGTGG
ATGGTGTGCTTATTTGCAGTCTAAAGAAATTTCCTTTTGATGTGGCAGAAAATCGAGGATGTGGAGTGGA
GACCCCAGACTTACTTGGAGCTGGAGGGTCTGCCTTGCATCCTGATCTTCAGTGGGATGGACCCGCATGG
GGAGTCCTTGCCGAGGTCTTTGAGGTACTGTGACCTGCGATTGATAAACTCCTCCTGCTTGGTGAGAACA
GCCTTGGAGCAGGAGCTGGGCCTGGCTGCCTACTTTGTGAGCAACGAGGTTCCCTTGGAGAAGGGGGCTA
GGAACGAGGCCTTGGAGAGTGATGCTGAGAAGCTGAGCAGCACAGACAACGAGGATGAGGAGCTGGGGAC
AGAAGGCTCTACCTCGGAGAAGAGAAGCCCATGAAAAGGGAGAGGTCCCGCTCCCACGACTCAGCATCC
TCATCCCTCTCCTCCAAGGCTTCCGGTTCAGCGCTCGGTGGCGAGTCCTCGGCTCAGCCCACAGCACTCC
CCCAGGGAGAGCATGCCAGGTCGCCCCAGCCCCGTGGCCCCGCAGAGGAGGGCAGAGCCCCTGGTGAGAA
ACAGAGGCCCCGGGCAAGTCAGGGGCCACCCTCGGCCATCAGCAGGCACAGTCCCGGGCCGACGCCCCAG
CCCGACTGTAGCCTCAGGACCGGCCAGAGGAGCGTCCAGGTGTCGGTCACCTCGTCGTGCTCCCAGCTGT
CCTCCTCCTCGGGCTCATCCTCCTCGCCGCCAGCCACCCATTGTCTTCTTGCCAAGCTCGTGTACGACATGGTT
GTGTCCACTGACAGCAGTGGCCTGCCCAAGGCCGCCTCCCTCCTGCCCTCCCCCTCGGTCATGTGGGCCA
GCTCTTTCCGCCCCCTGCTCAGCAAGACCATGACATCCACCGAGCAGTCCCTCTACTACCGGCAGTGGAC
GGTGCCCCGGCCCAGCCACATGGACTACGGCAACCGGGCCGAGGGCCGCGTGGACGGCTTCCACCCCCGC
AGGCTGCTGCTCAGCGGCCCCCCTCAGATCGGGAAGACAGGTGCCTACCTGCAGTTCCTCAGTGTCCTGT
CCAGGATGCTTGTTCGGCTCACAGAAGTGGATGTCTATGACGAGGAGGAGATCAATATCAACCTCAGAGA
AGAATCTGACTGGCATTATCTCCAGCTTAGCGACCCCTGGCCAGACCTGGAGCTGTTCAAGAAGTTGCCC
TTTGACTACATCATTCACGACCCGAAGTATGAAGATGCCAGCCTGATTTGTTCGCACTATCAGGGTATAA
```

FIGURE 402 cont'd

```
AGAGTGAAGACAGAGGGATGTCCCGGAAGCCGGAGGACCTTTATGTGCGGCGTCAGACGGCACGGATGAG
ACTGTCCAAGTACGCAGCGTACAACACTTACCACCACTGTGAGCAGTGCCACCAGTACATGGGCTTCCAC
CCCCGCTACCAGCTGTATGAGTCCACCCTGCACGCCTTTGCCTTCTCTTACTCCATGCTAGGAGAGGAGA
TCCAGCTGCACTTCATCATCCCCAAGTCCAAGGAGCACCACTTTGTCTTCAGCCAACCTGGAGGCCAGCT
GGAGAGCATGCGACTACCCCTCGTGACAGACAAGAGCCATGAATATATAAAAAGTCCGACATTCACTCCA
ACCACCGGCCGTCACGAACATGGGCTCTTTAATCTGTACCACGCAATGGACGGTGCCAGCCATTTGCACG
TGCTGGTTGTCAAGGAATACGAGATGGCAATTTATAAGAAATATTGGCCCAACCACATCATGCTGGTGCT
CCCCAGTATCTTCAACAGTGCTGGAGTTGGTGCTGCTCATTTCCTCATCAAGGAGCTGTCCTACCATAAC
CTGGAGCTCGAGCGGAACCGGCAGGAGGAGCTGGGAATCAAGCCGCAGGACATCTGGCCTTTCATTGTGA
TCTCTGATGACTCCTGCGTGATGTGGAACGTGGTGGATGTCAACTCTGCTGGGGAGAGAAGCAGGGAGTT
CTCCTGGTCGGAAAGGAACGTGTCTTTGAAGCACATCATGCAGCACATCGAGGCGGCCCCCGACATCATG
CACTACGCCCTGCTGGGCCTGCGGAAGTGGTCCAGCAAGACCCGGGCCAGCGAGGTGCAAGAGCCCTTCT
CCCGCTGCCACGTGCACAACTTCATCATCCTGAACGTGGACCTGACCCAGAACGTGCAGTACAACCAGAA
CCGGTTCCTGTGTGACGATGTAGACTTCAACCTGCGGGTGCACAGCGCCGGCCTCCTGCTCTGCCGGTTC
AACCGCTTCAGCGTGATGAAGAAGCAGATCGTGGTGGGCGGCCACAGGTCCTTCCACATCACATCCAAGG
TGTCTGATAACTCTGCCGCGGTCGTGCCGCCCAGTACATCTGTGCCCCGGACAGCAAGCACACGTTCCT
CGCAGCGCCCGCCCAGCTCCTGCTGGAGAAGTTCCTGCAGCACCACAGCCACCTCTTCTTCCCGCTGTCC
CTGAAGAACCATGACCACCCAGTGCTGTCTGTCGACTGTTACCTGAACCTGGGATCTCAGATTTCTGTTT
GCTATGTGAGCTCCAGGCCCCACTCTTTAAACATCAGCTGCTCGGACTTGCTGTTCAGTGGGCTGCTGCT
GTACCTCTGTGACTCTTTTGTGGGAGCTAGCTTTTTGAAAAAGTTTCATTTTCTGAAAGGTGCGACGTTG
TGTGTCATCTGTCAGGACCGGAGCTCACTGCGCCAGACGGTCGTCCGCCTGGAGCTCGAGGACGAGTGGC
AGTTCCGGCTGCGCGATGAGTTCCAGACCGCCAATGCCAGGGAAGACCGGCCGCTCTTTTTTCTGACGGG
ACGACACATCTGAGGAAGACAGCGGCGAGTTTTCTGAAGAGATGAGTGCTCAGAGCCCTCATGCTGTTGA
GGCTAAAGGGAGGCCTGGAACGGTGGGGCGTTTGACTGGAATGGACCCCAGGGACTGTCCAGGTGCAGCC
CCTCCTAGTACACATGGGCCCCCGAGGCCGTGGTCCTGGGAGCCAGGAAGACTCCGCAGTGGGTGAGAAT
GAAAACTTGAGACTCCCAAGTTCTGGGCCAGCCCATTGCTCTGGGCTGTTTTAAAGCCCATTTCACGAGG
AACAAAGATTTACTTCCTGTCCTGCCATTCGTGTGCTTCCATGGACAAACCTGATTTTTTTCTCTTAGTT
CTAAAGAATCTTGGGTTATTTTGTAGCGGTGCCAGTATTTCAGTAGATGGGATTTCAGCCAAGTAGGTTC
CCCTGTAACCTCCTACAAAGCAATATTCCAAAGGAACATTTTAACTGTAAAGGCTGGAGACAAGAAAAAA
TAAGTAGATCGTTTTAATAACAATTATTTAATTGCCTATAAGTTTGCTGTTTCAGAGGCTAGCCCAAAGG
CATCAAATTTAATAAAGTTAAACAAATTGATTTACTTCAGAGCAAATATGATCCTATTAAAATAATATAG
GGTAAATACCCTACCTCTTAGAAAGGGCAAAAATGCAAAGAAGCTTTCTTTAAAACTAAAAGGGTTTTTT
GGGGGGGGGAGTTGGCGGGAGGAAATAAGGCTAACAGAGGTTGACCTAAAATTAGCCTTACAAAGGAGAA
AGGACCACATTGCTTACTTGAAACAGACAATGAAAACAACCAAAGTGATATATAAAATAGTTGATGAGAA
CTAGACTTATGACTGTAGTTTACTAGAGTTTAGTTTTCAGTTGCTGAAGTAGCTCATTTTCTCTTACTAA
TGTTTGGTTCCTCAGGGAAGAATCTCACTTGACTAGAGAGGAGGTGGGAACAGAAGAGAGAAGGAGGCAG
GGAGATGTATTTCTTAGGGCTCACCCCTTCACAGACTGACAGAATGGTTTTGTTTTGTTTTGTTTGTTT
TGTTTTGTTTTGAGATGGACTCTAGCTCTGTCACCCAGGCTGGAGTGCAGTGGTGCGATCTCGGCTCAC
TGCAAGCTCCGCCTCCCGGGTTCTCACCATTCTCCTGCCTCAGCCTCCCGAGTAGCTGGGACTACAGGCG
CCCACCACCACGCCCGGCTAATTTTTGTATTTTTTAGTAGAGACGGGGTTTCACCATGTTAGCCAGGAT
GGTCTCGATCTCCTGACCTCGTGATCCGCCCGCCTCGGCCTCCCAAAGTGCTGGGATTACAGGCGTGAGC
CACCGTGCCTGCCCCAGAATGGTTTTTAAAGCCACAGTTGAGAGGCCACCCATTGCCCGGCGCCTGGACA
GTGATCATCTTGTTCATCTTGTTCAGTCCTTCTTGTGTGATTGGAATTATTCATCCCCTTTGAAAGATG
AGAAGGTTGAGATGCAAAGAGTCTACCTTTCCAAGTTCTCACTGCTGGAAAGAGCTAGAAGCACAGTTCA
AAGTTCTGGCTTCTGGACTCTGCAGTCCAGGTCTCCCTTCTCCCACTTGCCTACCCTCAATGCCACACTG
TTTTTGAAGTGGCCCATAACTTGAAGGAAAAGTTTAAAGACAGTTCAATTTAATCATCAGAATGCATTCT
TTTTTTTTTCGGAGACGGAGTTTCACTCTTGCTGCCCAGGCTGGAGTGCAATGGTGCAATGATCTCGGCT
CACTGCAACCTCTGCCTCCTGGGTTCAAGTGATTCTCCAGCCTCAGCCTCCCGAGTAGCTGGGATTATGG
GCGCCCACCACCATGCCCAGCTAATTTTTGTATTTTTTTTTTAGTAGAGATGGGGTTTCGCCAGGTTG
GCCAGGCTGGTCTTGTGAACTCCTGGCCTCAGGTGATCTGCCCACCTCATCCTCCAAAAGTGCTGGGATT
ACAGGCATGAGCCACTGCGCCTGGCCTCAGAATGCATTCTTACACATCTATCCTAGACATTTATAAGCAC
TCTAATGGATAACAATCCAAGAATAAATGATTGTAAAAGATGATGCCGAAGAGTTGATGTCAATCTTTTT
TTCCTAAGAAAAAAGTCCGCGAGTATTAAATATTTAGATCAATGTTTATAAAATGATTACTTTGTATAT
CTCATTATTCCTATTTTGGAATAAAAACTGACCTTCTTTAATCATATACTTGTCTTTTGTAAATAGCAGC
TTTTGTGTCATTCTCCCCACTTTATTAGTTAATTTAAATTGGAAAAAACCCTCAAACTAATATTCTTGTC
TGTTCCAGTCTTATAAATAAAACTTATAATGCATG
```

FIGURE 403
SEQ ID NO: 395
Genbank ID       : NM_020386.1

FIGURE 403 cont'd

Unigene ID(#167) : Hs.36761
Unigene name    :      HRAS-like suppressor    HRASLS
>gi|9966858|ref|NM_020386.1| Homo sapiens HRAS-like suppressor (HRASLS), mRNA CGTTTCAGCGTGGCGGCGCTGGTGCTGGCGTTGGCCCTGGAGGACGGCCCCGAGTGATGGCTGGCGCCTG
CCTCCCGGGTGTCTCCCGGGTACAGATGGAGTCGTCCCGCGGCCGCCGGCGGCAAGGTCGGCAGCTGCGA
GGCCAAGAGAGACCCCAGGACACACACAGCTGCCTCCCGGTGCGAGAAGAAGACCCCGGCTTGAGAGTGA
GATGGCGTTTAATGATTGCTTCAGTTTGAACTACCCTGGCAACCCCTGCCCAGGGGACTTGATCGAAGTG
TTCCGTCCTGGCTATCAGCACTGGGCCCTGTACTTGGGTGATGGTTACGTTATCAACATAGCACCTGTAG
ATGGCATTCCTGCGTCCTTTACAAGCGCCAAGTCTGTATTCAGCAGTAAGGCCCTGGTGAAAATGCAGCT
CTTGAAGGATGTTGTGGGAAATGACACATACAGAATAAACAATAAATACGATGAAACGTACCCCCCTCTC
CCTGTGGAAGAAATCATAAAGCGGTCAGAGTTTGTAATTGGACAGGAGGTGGCCTATAACTTACTTGTCA
ACAACTGTGAACATTTTGTGACATTGCTTCGCTATGGAGAAGGAGTTTCAGAGCAGGCCAACCGAGCGAT
AAGTACCGTTGAGTTTGTGACAGCTGCTGTTGGTGTCTTCTCATTCCTGGGCTTGTTTCCAAAAGGACAA
AGAGCAAATACTATTAACAATTTACCAAAGAGATATTGATATTGAAGGAATTTGGGAGGAGGAAAAGAA
ACCTGGGGTGAATACTTATTTTCAGTGCATCATTACTGTTCCAGATTCCTATGATGGATGGCAGACTCTT
TAATAAATTGCTTACTGATATTATCTT

FIGURE 404
SEQ ID NO: 396
Genbank ID      : NM_004456.1
Unigene ID(#167) : Hs.444082
Unigene name    :      enhancer of zeste homolog 2 (Drosophila)   EZH2
>gi|4758323|ref|NM_004456.1| Homo sapiens enhancer of zeste homolog 2 (Drosophi
(la) (EZH2), mRNA GAATTCCGGGCGACGCGCGGGAACAACGCGAGTCGGCGCGCGGGACGAAGAATAATCATGGGCCAGACTG
GGAAGAAATCTGAGAAGGGACCAGTTTGTTGGCGGAAGCGTGTAAAATCAGAGTACATGCGACTGAGACA
GCTCAAGAGGTTCAGACGAGCTGATGAAGTAAAGAGTATGTTTAGTTCCAATCGTCAGAAAATTTTGGAA
AGAACGGAAATCTTAAACCAAGAATGGAAACAGCGAAGGATACAGCCTGTGCACATCCTGACTTCTGTGA
GCTCATTGCGCGGGACTAGGGAGTGTTCGGTGACCAGTGACTTGGATTTTCCAACACAAGTCATCCCATT
AAAGACTCTGAATGCAGTTGCTTCAGTACCCATAATGTATTCTTGGTCTCCCCTACAGCAGAATTTTATG
GTGGAAGATGAAACTGTTTTACATAACATTCCTTATATGGGAGATGAAGTTTTAGATCAGGATGGTACTT
TCATTGAAGAACTAATAAAAAATTATGATGGGAAAGTACACGGGGATAGAGAATGTGGGTTTATAAATGA
TGAAATTTTTGTGGAGTTGGTGAATGCCCTTGGTCAATATAATGATGATGACGATGATGATGATGGAGAC
GATCCTGAAGAAAGAGAAGAAAAGCAGAAAGATCTGGAGGATCACCGAGATGATAAAGAAAGCCGCCCAC
CTCGGAAATTTCCTTCTGATAAAATTTTGGAGGCCATTTCCTCAATGTTTCCAGATAAGGGCACAGCAGA
AGAACTAAAGGAAAAATATAAAGAACTCACCGAACAGCAGCTCCCAGGCGCACTTCCTCCTGAATGTACC
CCCAACATAGATGGACCAAATGCTAAATCTGTTCAGAGAGAGCAAAGCTTACACTCCTTTCATACGCTTT
TCTGTAGGCGATGTTTTAAATATGACTGCTTCCTACATCCTTTTCATGCAACACCCAACACTTATAAGCG
GAAGAACACAGAAACAGCTCTAGACAACAAACCTTGTGGACCACAGTGTTACCAGCATTTGGAGGGAGCA
AAGGAGTTTGCTGCTGCTCTCACCGCTGAGCGGATAAAGACCCCACCAAAACGTCCAGGAGGCCGCAGAA
GAGGACGGCTTCCCAATAACAGTAGCAGGCCCAGCACCCCCACCATTAATGTGCTGGAATCAAAGGATAC
AGACAGTGATAGGGAAGCAGGGACTGAAACGGGGGAGAGAACAATGATAAAGAAGAAGAAGAGAAGAAA
GATGAAACTTCGAGCTCCTCTGAAGCAAATTCTCGGTGTCAAACACCAATAAAGATGAAGCCAAATATTG
AACCTCCTGAGAATGTGGAGTGGAGTGGTGCTGAAGCCTCAATGTTTAGAGTCCTCATTGGCACTTACTA
TGACAATTTCTGTGCCATTGCTAGGTTAATTGGGACCAAAACATGTAGACAGGTGTATGAGTTTAGAGTC
AAAGAATCTAGCATCATAGCTCCAGCTCCCGCTGAGGATGTGGATACTCCTCCAAGGAAAAAGAAGAGGA
AACACCGGTTGTGGGCTGCACACTGCAGAAAGATACAGCTGAAAAAGGACGGCTCCTCTAACCATGTTTA
CAACTATCAACCCTGTGATCATCCACGGCAGCCTTGTGACAGTTCGTGCCCTTGTGTGATAGCACAAAT
TTTTGTGAAAAGTTTTGTCAATGTAGTTCAGAGTGTCAAAACCGCTTTCCGGGATGCCGCTGCAAAGCAC
AGTGCAACACCAAGCAGTGCCCGTGCTACCTGGCTGTCCGAGAGTGTGACCCTGACCTCTGTCTTACTTG
TGGAGCCGCTGACCATTGGGACAGTAAAAATGTGTCCTGCAAGAACTGCAGTATTCAGCGGGCTCCAAA
AAGCATCTATTGCTGGCACCATCTGACGTGGCAGGCTGGGGATTTTTATCAAAGATCCTGTGCAGAAAA
ATGAATTCATCTCAGAATACTGTGGAGAGATTATTTCTCAAGATGAAGCTGACAGAAGGGAAAGTGTA
TGATAAATACATGTGCAGCTTTCTGTTCAACTTGAACAATGATTTTGTGGTGGATGCAACCCGCAAGGGT
AACAAAATTCGTTTTGCAAATCATTCGGTAAATCCAAACTGCTATGCAAAAGTTATGATGGTTAACGGTG
ATCACAGGATAGGTATTTTTGCCAAGAGAGCCATCCAGACTGGCGAAGAGCTGTTTGTTGATTACAGATA
CAGCCAGGCTGATGCCCTGAAGTATGTCGGCATCGAAAGAGAAATGGAAATCCCTTGACATCTGCTACCT
CCTCCCCCTCCTCTGAAACAGCTGCCTTAGCTTCAGGAACCTCGAGTACTGTGGGCAATTTAGAAAAAGA

FIGURE 404 cont'd

```
ACATGCAGTTTGAAATTCTGAATTTGCAAAGTACTGTAAGAATAATTTATAGTAATGAGTTTAAAAATCA
ACTTTTTATTGCCTTCTCACCAGCTGCAAAGTGTTTTGTACCAGTGAATTTTTGCAATAATGCAGTATGG
TACATTTTTCAACTTTGAATAAAGAATACTTGAACTTGAAAAAAAAAAAAAAAAAA
```

FIGURE 405
SEQ ID NO: 397
Genbank ID        : AL356755
Unigene ID(#167)  : acc_AL356755
Unigene name      :
>gi|10862770|emb|AL356755.12| Human DNA sequence from clone RP5-964F7 on chromo
some 20. Contains the gene encoding GFR receptor alpha 4 protein (GFRA4), the 3
' end of a gene for a novel disintegrin and reprolysin metalloproteinase family
 protein, ESTs, STSs, GSSs and CpG islands, complete sequence

```
ACACAAATGCTCCCACAGGGGACTCTCCTACGGATCACATGTTAAAGACTGGAGGGACTGTGGGTCCCTG
AGTCACCCCTTAGAGGCCGGCCGCCTGATCAGTAAGAGCTGTGCTGGCCTTTGCATCACTGGAAAGCAAA
CTCACTCTGCTGATCCACTGAGATTTGGGGCTTTGTTACACTAGTTAGCTTTTCTTATTCTCACTAATAT
ACAAATCAGCACTTTGAAGTGCAGTGCACATGTAACCAAACCCTTAAGTACATGGCACTGGCTCAGCGTG
TGGCCAGGTGGCGAGCAGTGATAAGACAGGTGCAGCTGGCAGGACAACTGAGGTCCCTGCCAGGCGGAGC
AAAACATCTGGTAAGGCCGTTTCACTCGATAACTCGGAAAACAAACTCCATGTCTGCTGACTTTTTGACT
TGAGGGGAATAAACAACAACAACAACAACAAATATGTGTTGATTGTTACTGGCTGCTTTTGGCGAGGCAT
CACGAGAAAAGTTTACTTCAAGAAAGAATTAGCCAGTTTACAAGCAGAAGGGAAAAGATGGAAGATG
TTAACCAGGGCCTTGCAATTCTGGAAAAGCCAACTGCTTCTAGTCTCCAACCAGTAAGAGGTGCAGGTGA
GCAACAAAGGCCCCATGAGACTTAGTTGAACACAGTGACTGGGCCTCATGGTGACCATCCAATGAAGGGT
GTGGTCTTCCCACTGGAGCATGGAAACTGCAAAGCCACCAGCTTGAGGGAGGGGCACGTGGTTAAGGAAG
CAAAGAAAAAGCTGACATGAGAACTGTTTCCAGGAACAAACCATGAATGTAGTCACTGACCCTGGACCTG
CCTGGAAATAAATAAAGATGTAGTAAATTTAAGAAACCATTAGCAAAGCCTTAAAAAAAAAAAAAAAAAA
AAAAAAAAACGGTGGCAATTGAGGAAGTCTTAAATCCAACCTTCAGGCAGGAAAATGGTTGTGAAAGCTGT
GTCCAGCGAGGGCTTTACAAGCTCAGATGTGGGCCCAAGAGCAGAACTGGGCCTGAGCGAGGACTCCCCC
CAGCCCAGGACAGGGCCCAGCAGGATTGCAAAAACACCGCAGAGCAGCAATTGCTGCATCTGCACCCGCT
CCTTCCTGGGTAGGAGGGCCTAGGAGGGTGTCCTGCCTGTTCTCATCACTACCTGCTGGGTGGGAGGTGG
ATTAAGCTGTCTTGTTAATTCAGGATTGTGGACTTCAAAGAGCCACCTGAGGGAGGCTGCATCACCTGGA
GGTCTGGGCGGGGTGTGACCTCGTATTGTCCCCCTAGGAGAGGGTGCCTGTGACCCATGTAGGAGAGGAA
GCACAAAACTGGTTTTGGTGATCAGAATAGCAAACTGGGCCAGATGCTTACCACACATTTCCTCTTCCTG
AGTCCACAGCTTCGACTGCATGGCCTGGGCCCGTGGCATCTACCCAGATGCCTTGGGACCAGCCCTCACC
AATGATGTGTCATTTCAAGGCCATTCACAGTAACAGTGTCTCCTCCACTGTCTCCATCAACCTTGAAGGC
TTATGGTGAAGATGGTAATACAACAGGATTGAAGGAGACTGGGTCCCTGAATGACTTTGTGGAACAGAGC
ACTATAGGCCAAAGGTAGTAGAATTAGGTATCTTGTTTTATGCTGCTTAAGTGAATTAATTAATTCTCTA
GATTTATTCACCTAGTTATTCAACAAATTTTTATTGAGCACATCAGGGCTAGGGCATTGTGTCAGGATCA
GAGATTTTGCAATGAACAAAACAGAAAACTCCATGTCCTCCAGGGGAGTTGATAATAAAATGTCAGATAA
GCTCTGTGAAGAAAGGTAAAAGTAGGGTTAGGGGGTAGAAAGTGCTGGGGGGATTGCTACTTAACATAGTG
TGGCCAGGGGAAGCCATTCTGCTAAGGTGACAGCTGAGCAGAACGATGAGTGGAGGGGGCAGGAAGGAAT
GTGGAGGTCTGGGAGAAGAGCATTCCAAACAGGGATGGCAGGTGCAGAGGCCCTGAGGGGGCAGCATGCC
TGGTAGGCCTGCTGGATATTTCTGAGAATGAAAAAGTCCATTCCCAGTTGTTTGCGTGGAGAACCTAACC
CAGTTATAAACACAAAGTACTTGAGAGCTGGTTTAATATACAGCCAGCTTTCCAGCAGTGCAACTACTGT
GTACATCAAGGGAAAACTGAACTTCGTTTTCCTTAAAACTTATCATCAGCTGGTCATCATTTTGACAAAT
TCTGTCAACAACAGCAGTGTCATTCCTGGCATCTGTATGGGTCACGTCTGAACAGACACACGCCCTGCAG
CCCTGCAGGTACCAGCTGTATAACAAGAACTCCCTTCCACCCTGTGTCCTGGAAACAAGAAAGCCATAGA
CCGGAAGATCCCGATGGCTATCTCAAATGTGCTGGATGGAGTTGCCAGGGCCCACTGGCATGCCCTGTAA
GCCTTTCCTTCCACGTTTGGTTCCTGCCCCTTGAAGACTCCATTTCTGAGTTTGTGTGTGTTTTACTTTC
TAGTGTGTGTCCTCATCTTAATTTTTCTCTCTCTTCTGCCTTGAACTGAAGGTTCGCTTGGGTGTGGA
GAGACAGGCCCCCAGCAGGACAGCTTCCCAGACATCCTCCAGGGCTTCCCAGCAGCCCGGCAAG
GCAGGGCTGTGCCTTTCTGCTTCAGCTCACAAGCATGCCCAGGCTCACTGGCAAGCTGCTGTCTGGTTGAG
AGACTGCTCCTAAAGCCCTGCACAGCCCTGTCCTCCTGGCCCTCTGGAAATTCCACCAACCCGTGTCCA
CATTTCATGCAAAATGAGCTGGTTCTGTGAGCATGGCCCGGCCTGACTCGCTTAGTGGGCGGTAAGTGG
TTTCCACTTCAACCTTGCACCTAATCACCGGGCTCCACACCAGGATGGACATTCATGAGCCGTGAAGTTT
CCAGTAATAAATCCACAGATGCTTCCAGCACCTGCCTTTTCGCATCACCTCCACTCCCAGCCACCTGCCA
GGCAACAGGTAACAGAGACCCAGTCACAGGAGGGCAGTGTGGGGCAGGACTGCAGTCTCCCAAAGCCCA
```

FIGURE 405 cont'd

```
TGCACAAAACCGACAGCGCCCTGGCAGGACAAGGAGGCTGACATTCAGATGTGGAGGAACAACGCATGAC
CCATTCCTGGTCATGGGGGCCACAGCTGGACTCAGCCTTGAGGCTTGGCCAGACTTAACACCGTGTATAA
ACCAGGACCTTTTTAGGTAGAGTAATGGAAACCAAACTCTAATGATCTTAGACAGTGCTATTAGTCTCCT
GGAGCTGCCAGAACAAATTACCGCAACTTCAGTGTCTTGAAACAAGAGAAACTGATTCTCACAGTTCTGG
AGACCAGAAGTCTGAAATGCAGGTGTTGCCAGGGCTGTAGTCTCTGGAGACTCTAGGGGAATCTGTGCCT
ACCTCCTCCAGCTTCCAGTGGCTCCTGACATTCCTTGGCTTGTGGCTGCATCACCCCAATCCCTATCTCT
GTCTTCCCCTGGTCTTTTGCTCAAAATGTCTGTGTTTAGTTTCCCTGTAGACACCTCTGCATCACTCTCA
TGAGATGCAGAGGTGCGACATACAGGTGTTGAGAGCCCACTTAGATAATCCAGGATAAGCTCCTCTCAAG
ATCTGTAACTTGGCTGGGTGCAGTGTCTCACGCCTGTAATCCCAGCACTTTGGGAGGCCAAGGCGGGAGG
TTCACTTGAGGTCAGGAGTTGGAGAACAGCCTGGGCACCATGGGGAGACCCTGTCTCTACTAAAAATAGC
CAGGCGTGGTGGCACACACCTGTGGTCCCAGCTACTCAGGAGGCTGAGGTAGGAGGATTGCTTGAGCCTG
GGAGTTTGAGGCTGCAGTGGGCTATGACTGCACCACTGAATTCCAGCTTGGGTGACAGAGTGAGACTGTC
AAAAAAAAAAAAAAAAAACATAAAACATAACTTAAATCACATCTCTTGCCACAGAAAGTAATACTCTTTTG
CCTACATATAAGGTAATATTTACAGGATCCAGGGGTTAGGATGTGGACATATCTTTGGGACCACTGACAG
CCATGAAGCAATCTCATAATTTTCAAATAGGTTCTGTCCTTTTTATCTTTCCAGTCTTTTGGAAAGCATA
TGCCTATATTTTCAATCCACAATTCTATTTTTATTTGAGGTCATTTCATTTCTGGTTTTTATTTTTTATT
GAGACAGGGTCTCACTCTGTCACAGGCTGGAATACACTAGCACAATCATGGCTCACTGCAGCCAACTTCT
GGGCTGAAGTGATCCTCCAGCCTCAGCCTCCTGAGTAGCTGGAACTACAGACACACATCACCATGCCTGG
CTGATTCATTTTTTAATTTTTTCTAGAGACAGGCTCTATGTTGCCCAGGCTGGTCTCAAACTCCTGGCCC
CATGCAAACCTCCCGCTTCGGCCTCCCAATGTGCTGGGATTATAGGAGTAAGCCGCCTTACCCAGCCTCC
AGTTTTATTGTGTTTTGTTTTGTTTTGTTTGAGACAGAGTCACGCTCTGTCACCAGGCTGGAGTGCAGTG
GCACGATCTCGGCTCACTGCAACCTCTGCCTTGCGGGTTCAAGCGATTCTCCTGCCTCAGCCTCCCGAGT
AGCTCGGATTATAGGCATGCACCACCACGCCTGGCTAAATTTTGTATTTTTAGTAGAGACGGGGTTTCA
CCATGTTGGTGAACACAAAGTATTTGAGAGCTGGTTTAATATACAGCCAGCTTTCCAGAAATGCAACTAC
TGTGTTCATCAAGGGAAAACTGAACTTCGTTTTCCTTAAAACTTATCACCAGCTGGTCATCATTTTGACA
AATTCTGTCAACAACAGCCATGTCATTCCTGGCATCTGTATTGGTCACATCTGAACGACACACGCCCTGC
ATGCAGCCCTGCAGGTACTGGCTGTATAACACGCCTGGCAAGAATTCCCTTCCACCCTGTGTCCCGGAAA
CAAGAAAGTGATTGTGATCCGCTCACCTCAGCCTCCCAAAGTGCTGGGATTACAGGCGTGAGCCACTGCA
CTCGGCTTCCTCCAGTTTTTTTTTTTTTCAATGCTTATATTTTACTCTAATTAACTGAGTCAAAAATGG
AGAATAGTTGAATACACTTTCATGTAAGGCGAATCATTTAGCCGATACTTAACTCTGCATTTGGGCTACC
ATGCCGCTGTGGTTAGCGGGGCAAGGTGATGAGCCCTGTCTCAACACACACACCCCGCCTCTCCCCAGCC
CACTTACACGTGTCCATTCCCACGCAGGTGTGGGGGCCTTAGAGGATTCCCTCTTCTTCGTAAAGTGAGA
ATGGGCTAGACTCGGCTTCACTGCCCAACAACTCCTTTTTTTCCTTTGGGAAACTGTCCTTCCCATTCCA
TATAACCTTCATGGGCTGAGATCACTCACCGAGCTACAGGAAGAGGCCCATTACTATGGCCCCATCAGGG
TTCTGCCTGGGACAGTCCATAAATGCTGGAAGAGAGAGGTGCCTTTCCCTACTGAGGCTGCTAAAAGGAG
ACACTGCAAACTGGGGCTGCTGGTGGCAATCTTACACTCTCAGTGAAAGCCTGCCTGGCTGCAGGGGAAA
CCAATGCACAGACCAGCAGGGGCAACATCATTTGAACCCCTGGAGACAGCTGTGCCTGAAGCCCACATGG
CTCAGGCACATGCTCAAGCCACTCTGATTTGCTTGTTACAGTCAAGAGAGTCCTTGGCCGGGCACAGTGG
CTCATGCCTGTAATCCCAGCACTTTGGGAGGCCGAGGCAGGCGGATCACCTGAGGTCAGGAGTTCAAGAC
CAGCCTGACCAACATGGTGAAACCCCGTTTCTACTAAAAATACAAAAATTAGCCGGGCATGGTGGCATGT
CCCTGTAATCCCAGTTGTTAGGGAGGCTGAGGTGGGAGAATCGCTTGAACCTGGGAGGTGGAGGTTGCAG
TGAGCCAAGATTGCACCACTGCACTCCAGGCTAGCTAACAAAGCGAGGCTCTGACTCAAAAAAAGGGAGT
CCTGACTGAAGCTGAGAGGCTGGTGGACAGCTGTCAGCAAGCAGTGTTTGTGGGTCTGATGTGAGCTGCG
AAGTCCACACCTGATTTCAGAGCTGGTGGCTCTTTTTCCAATCAGGACAGCTCCAGGCCTGAGTTTTGGT
GTGGTCTGTACCTAACCGCTGTGTCTTAGGTCAGGATCTCTAGAAGCCAAGCCCAAGACAGGAGTTCTCA
AATGCCATGATTTACTGAGGGAATGCCTTTGGGGAACCTGCCAGTGAGGAGAGCTGGAGGAGGCGGGCA
GGGGCGGGAGCTGAGCCAGGTGGGGGTCCCTGCTGGAGTCTAGCCTCAGCTTGACCCCACAGGGGCTCTG
GAGCAGGAACAGCACACTGCATTGTCCCTTGAGGCAGTCACTGGCTGCAGTTGCCTCTGGGAGCAGAGTA
AAAGTGGACAGGCATTTCTGGGAGTACAATTCCCTAGAGAAGGGGACAGCTCTGAGCTGTGTTACCAGCC
ACCATTTCCAGGGGCTCGGGGGATGCGCTGCACTGGCCCAGAGAGGTCTCTGAGCAAGGCCCCCACAACCT
CCACTTCAACCTCCTGCCAAACCTCAAGCAGATTGAGAAGGAGCCGCTAGAGACACAGGAACCCTTTCCT
CATCAGAAGTCTCCAAGCTTTGGAGGAAGAAGGAGGCAGGCAGGAGGCGGGAGGATCGTTTCACCCCAGG
GGTTCAGGGCTGCAGTGGACTATGATCATGCCACTGCACTACTGCCTGGTGACAGAGTGAGACCCTGTCT
CAAAAACAAACAGACAAAAAAAATCAATGCTCTTAGCATCTGCTGGGTCCACATTGGGCAGTGTGTGTGA
CGTGGTCCAGCTGCAAGGGAGGCTGGGAAATGCAGTTTCATTATCTGAGTACTAGTGGAGAAAGAAGAGA
CGAAAGCAATGAGAATCCCTGCCATGAGGAAGTGAGAGCTGATTCATTTCAGCTTCCTTAGGTGAGGTGA
TGGGGCCCAGACAGGTTCTGAGGCCACTGGAGGTCACACAGGCCAGCAGGGATACACCCAGTGGTAGACC
CTGGTCTCCAGGCTCCCAGGACACAGACCACATAAAAGCAAGGTCAGTCTCAGCACACAGATTTAATAAG
CACTGTATGTTATTCCTACAGCTGCAGGAAACCAGGGGAAGATGGCCACAGGGCCAATGCCAGGCAGGG
CACAGGGTGGGGCCCCTCAAGCAGCATATGGGGAACAGGAAAGACTCTGCCAGCATGGTCATGGCGCACA
GGTGGCTACAATGGTGGGTAATGCCCAGTTGGGAGGATGCAGTGTTAGACGGGGTCTTGTCCGATGGATT
```

FIGURE 405 cont'd

CCTTAGGGGGTTATATGCTTGGGAGGCTGATACAATTTCCTAGAATTCTGGGATTCTGGATGGTCTCTGA
CCTGCTCTAGGGGATCTGGGTCTCCAGAGAGGTCTCAGCTACAAAAGTGACCCTCTCCTGACCCCACCTT
GTGGGAGACCCCAGTGGTCTCAAGGTCTGTGAATAAAGGGACTTACAACCAAGATGCCTCCTGACAGGGA
GACGGGGGCTTTACAGTCAGGCCCCAGCCTACATCCCTTGCCCCAGGGGACGGCACACAGGGTGTCCAAA
CCTACAAAGGGCAGCGGAGTGAAAGCACCAGGGCCGGCTTGGGGGGTAAGCCAGCCCCTTCTCAAGGGGC
CAGTAGGCCACAGAGGCGGCCCAGGCAGGCAGGGTGGAGTAGCTGGCTGGCTGTGCTATCCGAGGTCGCTGTCC
TAATCAGAGCAGGGCCGGGAGAGCCAGGACAGGAAGTATGGAGAGCAGGGAGCGTCTCTCCAGGGCCCTG
CCTGTGGAGGACACCTTGGGGGTGGGAGCCAAGTGCAGACTTGAGGCAAAAGCCTGTCTCTGCCCTCTGC
CTGCACCCCACCCCAGGCCCTTCATGCCTCCACCCAGGCCCACCAGGGACGGAAGGGTGTGAAGGTGAC
AGTGGGGAGGTGCCAGCTCACCCTCCCCTCCCTGCACCTACCTGCAGGAGGCTGTGCTCCGGGTCTCCC
TGGGGGTTCAGCTGGTCCAGCAGGACTGGGGGCCACCCGCTGGCAAAGGCCTGAATGGCACCATCTATGG
AGGGAGGGGTCCAGGGTGGACTTAGCTGGGAAACCCTAGCACAGGGCTCAGCACAGGGGACAAAGTGAGA
GACCCCCTGCTGCAAAGACTGGCTCCTTGGACAGAAGGTGTGTGGTGAGGAATAACAAAATAATAAGCAC
AGCTGTGACAGAGTGACTCAACTGTACAGTCTTCCATTCTCCCCTCTAAAATGGCTCCCAGCCAGGCGGC
TTGGGAGGGGCAGTAAGCGCCGCCCCACTCCCCCTCCACTCCCCCCGGGCCCCTCACCCAAGCAGCG
GTTCCTGGTAAAGAGCCCCCGGAAGGCTTCGCAGTCCTCACGCCGGTTCCCGCTGGCTCCGCAGTCGCAC
CAGGGCGCCACGCGCGCGCTCACGTTGTCCACGTAGTTAGGGGTGACGGCGGTGCCTGCGGGACCCTGA
GGGCGAAGTCATCGGCCCACCGGGCGGAGATATCCCTGGAGAACCCCGCCCTCGCCGGATCCGGC
CGCGCGTACCCACGAGGCCCGCGTAGGCGCGCAGGCAGCGGGCGCCCTGGTCCAGCAGGCAGCCGTCGGG
GGCGCTGGGCGCTGGGGTGCACGAGACCTGAAAGGCCAGGAGGCGAGGCCTGCGCGGCGGGAGGGCGGTG
AGCCGGAGAGAGGCCCCGTCCCCACCCTCGCCACGGCCCCGCCGCCGCCCGCGCGCACCTGCAGACCCGG
CTGCGCTCGCAGAAGTTTAAGGGCTCAAGGCAGGAGGGCGGCGCGGGGCCGGGCCCCGAAAAGGCGCAGG
AGGGCACGAAGGTCTGGCGCCGACGCTCGGCGCACGCGGGGCCCGCGCACGGGCAGAAGAGCAGTGCGTG
GGTGAGCGCGGGCGGCCCGCGGGCGAAGAAGCGGCGCAGGGCCCGGCGGCAGCGGGCGCGGGGACAGCCC
CCCTGCGCAGCCCGGCCCAGGCACTGCGCCACATACTCGGAGCGCAAACGCTGGCACCGCGCGTCCGCCG
TGCAGGCTTCGGCCGCGTCCACACATCGGTTCCCTCCGACCGAGCTCGCCGACCCTGGGAAAGGCGCGGG
GAGGCTGCAGGTCTCAGTGCGCCCCGCATGCACACTTCACCCAGCCCATCCACGCCCTGGAAGGTGGGG
GACACTGAAAACCCGAGAAAGCATAGAGTGTGGCCCAAAGGCGGGGCCGACTGGCACTGATCGGCTCTCC
GTCGTGGGGATGGGCAGCGGCGGGCTCTGGAGGGCTCTGCAACACGTCAGGGATGGAGAGGGAGCATGGA
GGCTGAGCCAGGCCTTCCCCAAAAGCTGAAGCCCCTCCTTCCCAAGCATCGCCACCATTTCTCCAGAACG
GCCACACACGTCCAAAGACGGGTCCAGGGGCTCCTCCTACACTCAATGGCACTACCTGACGGGGGAACAA
TGAGGCTTTCTGGGGATCTGGCCAATGGAGACTTTAAAACCAGAGATGGCATAGAAGACAGTGGCTGCTC
CTAGTCTCTTAATGACAGGCTGTGACGCCATACCTTTCCTCCTCTACCCCCTCCACCTCGCCGCTTATCC
TCCACCATGGAGACCCTTTGGGTGGGTCTATTGATTTCTGTTTCTCCCTCCTTCCTGACCTCCTGCTCCT
CCTCCTGCCCCCTGCATGGGTGTCTCCCCTCTCCAGCCCTTCCTGATGCTCCCTTGAGTCGAGGTCATCC
TGCCCCATCTGCACTGGCTTCCTCCAGCCCCTCCACCCTTCATCAGCCAGGGGAGAGCGGATTCATGCAA
GAGCTCTGGCCACTGAAGAACCCACTGAGTCCTGGCTGCCAGGGTGTGGATTCAGAGAAGTCCCTGACGA
CACACCGCCGGGCTTTGTCCTGAGCCACAGGACCCAAGGGTTCATCAGTGGTTTTAGTGACCAGGCCCCA
TGATAGGTGACACCCTGCTGGAGACAGAGAAGGTGCCTGGCACCCCAGTCACACACCAGGGGTTGGGTAG
ACAGAGGGTGAGCTCTGCCCACATGCCCACAGGCTGTGTCTAAATAGAGCCAGGATAACTGGAAGTTGGG
ACTTGGCAGCCCCTTCCCAGGATTTGAGTCACAAAAACCAGGCTAATCGAATCCCCCCAGCCTCCACAA
GTTCTCCAGTCTGGAGCATCTCATTCAGACTAGAAGCCTTTCTGGTGCCCAGCCTGAGTGGACGTGCACA
GCCTGGCCCCTCATCCATCTCCCTGTGTGTTTGTGCACAGGGGCTACGGGTGGTATCCCCCCCCAGGG
CTGGGAGCAGGGTGCCTCTCTGGCAATGGCTGTGTCTTTCAGGCTGTGGATTGGACCGCGTGGTGAGAGT
GATTCCTGCTGTGACTTCAGCACCTGCCTCTGCAGGAAGGATGAACATAGCTCGAGGGCTTAGAATGGTC
CCTGAGTGGAGGGATAGATGGCAGCGGGTGAGTCCTCCCTTCCTCCCCTCCCCAAAGGGCACACTTTG
CTTTCCTCTCACAGCCTTGCCAGGCACATCCTCAGGTCTCAGCTGCACACACCAGCACCTGATGTTGCCT
AAGGGTTTGAACCCACCTCTGCCTGTTGCTTACCTGTCACCCTTGCCCAGAACACCCTTACCCAGTCTCC
ACCCTCACAGCAGCTCATCTCAGCTGCAAGATCTCCTCCACCTTAAACCTTTACCAGATTCCACTTTCCA
CACTACACTCGGTAAAGTGACCCCTCCCTCCGCGACATCCATGCAGGGACGGAGCAGTCCAAGAAGGTGG
AACAACAGATGAACAACACCGAAGATTCACCAAGGAATCTGTGTGATGGGTAGGAGGGCTGGGGCTGAGG
GGAGGGTGAGAGAGTTGGGAGATGGCAGACAATAGGCAAAAGTTCCTGGGGCACGGGTGCCAAGGCTGGA
CTCGGGAGGGGGATGGCGGTGGTGGCTTGACGGGCTGGGAGGTGAGGTGCTCAGCACATAGTGGGGTCA
ATTGCCAGGGGTCCCCAAGCCGTGCGCACAGGCCTCTCACTGGCAACCCTTCCTGTGGTTCAGCTTTTCC
TGGAATATCTTGCCCTCCCACCTTGTCACTGAGGAGCAGGGACAGAGAGGCCAGGGTTCGGGGTCCAGGG
GAAGAGAGGGGCGCTCACCCAGTAACAGCAGCAGCAGCAGCGCAGGCCCCAGGCAGCGGACCATGCTGGA
CCTTCAACAGAGAAGGATGGCTGCAGAGCCCTAGTCTGATAGGCGCCCCCCTTCCTAGTGCCTCTGGAGC
AGGAGCACAGTGAAAACCCAGCTGTCTGCGCTGATACCCCTGGGAGGAGCCTTTGCTGCAGCAACTCCCC
GCCCTCATTAAGTCTCCACCCCAGGCTGCACCGTCAGGTAAACCTGGGAGCCACGGGATTCGGCGCCTGA
ATGTGCCTAGACGGACCCCAACACACTAGCCCTGCCACGCACACCCAGCAACACACAGACAACCACCCAG
GGAGACCTGGTCTCTCCCATGCTAAACTAGGAACGCTATGAAACAGCATTTTTCTTTTCCTTTTTTATAT

FIGURE 405 cont'd

```
AATTCTATTTTAAACTTAAAAAAATTTTTTTGAATAGAGTTGGGGTCTCGCTCTATTGCGCAGGCTGGTC
TTGAACTCCTGGGCTCAAACCATCCTCCCACCTCGGCCTCTCAAAGTGCTAGGATGACAGGTGTGAGCCA
CCATGCCTGGCCTATTTTAAACTTCTTATTGTTGACTAATTTTAGACTTGCAGAAAAGTTGGAAAATGTA
AGCATTTTCCTTACACCCTTCACCCAGCTTCCCCTGATGGTCCATCTTACTTAATCATAGTCCAATCATT
ACAGCTAGGAAACTAACCTTGGTACAATCCTGTTAACGAAACTGTAGACTGTTTTGCATTTCTCATTTTT
CCACTAATGTCCTTTTTCTGTTCCAAGATCCATTCTAGGATCCCACATCACAGTTGTCTCCTTATTCTCC
TCAATCTGGGAGTTCCTTCATCTTTCCTTATCTTTACCCTTGACACTTTTGAAGAATCCTGGCCAGTTAT
TTTGCAGAATGTTTCTCTTGAGTTGTCTGATGTTTTATTCTGATCAGAATGAGACACAGCATTGTTTTGA
CTAACCAAAAGTTATTCTATAAGTAAATATTGAGGTTAAAAATCTCATCCAACCTGGGCAACAGAGTAA
GGCCCTGTCTCAAATAAAGTCTCAACACTAAGATTTAAAAAGTGACCAGAAAAGCCCCCACTATGATTTG
TCTTGACTTTTTTTAAAAAACAAACAAACAAACAAACAAACAAAACGATGTCTTGCTCTCTCTC
TCCCTCAGGCTGGAGTGCAGTGGCACGATCTTGGCTCACTGCAACCTCCGCCTCCCAGGTTCAAGCGATT
CTTCTGCCTCAGCCTCCCAGGTAGCTGGGATTACAGACGCCCGCCACCATGCCCGGCTAATTTTTGTATT
TTTAGTAGAGACAAGGTTTCACCATGTTGGCCAGGCTGGTCTCGAACTTCTAACCTCAAGTGACCCGCCC
ACCTCTGCCTCCCAAAGTGCTGGAATTACAGACGTGAGCAACTGCGCTTGGCCTCATTAGCATCTTAAAT
CTCCACACAGGGGTGTGTTCCTTACTATTATAAGGAGCAAAGGATCAGTTTGAGGACAGGTAAAATAAAA
ATGCGCTTGCTGCCTAGAGGGAGAAGTCCCTGCTGAAGATAGCTTTGCTTGAATGAGCTCAATTGCAATG
CCAGTGCTGAGGCTTGTTGACTGTACGGTCACCACAGTTGCTGCTGCGCGCCTAGAACATGGTCACTTTC
TTGACTACCTATCCTGTCTCAGTACATCTGTCTGTGGTTTGTGGTGGTCCATTTCCTAATTTTTTTAATG
AATCAGAAGACTGTGATGTGCTTTCCGCTGTGCTAACCATGGCCGCTGAAGCAAAATGTAAACCAAGATG
CCCCTGCAGTGGTTGTGCTTCACTCTACGACATCTGTTACCGGAAAGGGGTCCAGATTCAGACCCCAGGA
GAGGGTTCTTGGATCTCGTGCAAGAAAGAATTTGAGACGAGTCCATAAAGTGAAAGCACATTTATTAGGA
AAGTAAAAGAATAAAAGAATGGCTACTCCATAGAGAGCGCAGCCCTGAGGGCTGCTGGTGCCCATTTTT
ATGGTTGTTTCTGGATGATCTGCTAAACAGGGGTGGATTGTTCATGTCTCCCCTTTTAGACCATATATG
GTAACTTCCTGATACTGCCATGGCATCTGTAACCTGTCATGGCGCTGGTGGGAGTGTAGCAGTGGGGACG
ACCAGAGGTCACTCTCATCACCATCTTGGTTTGGGTGGGTTTTAGCCAGCTTCTATATTGCAAGCTGATT
TTTTTGTTTGTTTTGTTTTTGAGACGGAGTCTCGCTCCAGGCTGGAGTGCAGTGACACGATCTCAGCTC
ACTGCAACCTCCACCTCCTGGGTTCAAGCGATTCTCCTGCCTCAGCCTCCCAAGTAGCTGGGATTACAGG
CACACACCACCATGCCTGGCTAGTTTTTGTATTTTTAGTAGAGATGAGGTTTCACCTTGTTGGCCAGGCT
GGTCTCGAACTTCTGACCTCAGGTGATCCGCCCACCTCAGCCTCCCAAAGTGCTGGGATTACAGGCGTGA
GCTACCGCGCCTGGCCTACTGCAAACTATTTTATCAGCAAGGTCTTTATGACCTGTATCTCCTATCTCAT
CCTGTGACGCAGAATGCTGTAACTGTCTGGAAACGCAGCCCAGTAGGTCTCAGCCTTATTTGCTCAGCC
CCTATTCAGGATGGAGTTGCTCTGGTTCACAGGCCTCTGACACATCCTCTTGTGTTTTGGCGTGTGGGAG
GAAAGAGGGGTGAGGGAAGGAAAACTCAAAACCAAGCTCTGACCACACAGGGCAGGTACACTCTCCCACCT
GTCTGTGGGTGCCACAAGTCAAGGGAGGGGCAGAGAGAAGAAGGTGTGACAGATGGCCGCAGGCCACA
GAATGTCAGAGGAAGCCCAGTTCCTCCCGGGGCAGCCCAAGTAGCTGGTAGTTGGGTGGCCAAACAGAGG
GCGTCACAGCTGAGCTGGGCTCGCTCGCTACCCCCAGCTCAGCGTCCACTCTGCCCCTCAGTACCTCCTG
CTCAGCCTCAGGGTCCATGCCTACCCTCCTGCTTCCCAGTCACTTCTGCGTGCCTCCTGCTTTTCTGCTG
TTGGCCCCATGCCAGCTCCTTTCTGCTGAGCTTCTCTTCTCCAGTTCTGCAGCACAGCCAGGTGATCCTG
GGCTCCAGACAGGCCTCTCCCCCAGTCTGGGGCCTCCCCTCTTAGAGCCCTCTTTCCTTCCCACGTGGCC
TCCCCAGGGTTCGCCACTGAATGGAGAAGGGGTGGAGGGGGTGCTGGGCAGTCTTGGGGAATAGCCAAGA
GGGCAGAGTTGGCCTCCCCAGGGTCCCTTGTAGCTGGAGTCCCGCGGGGTCTAGACACCCCCTCCTGAAG
GGTAAGAGCGGGGGAGGTATATTAACGTGTATTTTAGAGTCTCTCTTTTTTTTTTTTTTTTTTTGAG
ACGGAGTCTTGCTCTTGTTGCCCAGGCTGGAGTGCAGTGGCACGATCTCAGCTCACTGCAACCTCCACCT
CCCATGTTCAAACAATTCTCCTGCCGCAGCCTCCCGAGTAGCTGGGATTATAGGCACGTGCCACCACACC
GGGCTAATTTTTGTATTTTTAGTAGAGATGGGGTTTCACCACATTGGCCAGGCTGGTCTCGAACTTCTGA
CCTCAAATGATCCTCCCGCCTTGGCCTCCCAAAGTGCTGGGATTACAGGCGTGAGCCACCATGCCTGGCC
TTAGATTCTCTATTTTATGATGGTTTAACATCTCGGGTGGGGCTTGTTGGCTGGAGAGAAACTGCTTG
ATTCCTGGAGATCAGAAACAACTCATGCCTTTCATATGCAAACGACCAGTCTTGAGTCCATACACCAAC
CACCCCCTTCAAGGAACTCTCACATACGAAACCAGTATTTCCCCTGCCCTAAACCAGCTCAGGGCCAGGC
ACCTACCCAGACAATTAGAGCCCAACCCCACGCCCCAAACCCCACCAGAATGATTCAAAATGCCAATCCT
ACCCTCTTCCCCTGGCCTGCCTTGCCTCCCCAGTGGAAACGGCACTGTGGGCTGTGGCCTGTGCCTTCCA
CTCGCTCCTGATTCTGTCCCTGGACCAAACCTAGTGCCTCCCCACTGTGGCCCTGCATGGTGGGAAACTG
TGAGTAATAACTTATTTCAACAGCATTGGCCTCTGTGTCATCAGTCACCTTCATAAATTAAAATTTTGCA
ACTACAACTGAGGCAGGAGGGGGCTTTAGAGAGCACTCTCACCTGGCCCCTTGGGCTTGTGGAGTGGAGC
CCGAGGTGAAGTTGCCTCCCTGCACTCAGTTTTGGGATGGTTTTGTTATGCGGCAACAGCTGGCTGATAT
AGGCCACTCAGCAGCTCTTGCATGAAGCAATGGGAGAATGTGAACGCCCAAGGGAAGCAGGAGTGACAGA
GCAAAGAGGGTGTTCAAACTAGGCAACACCGTCCTGTGCCCAGACACATGCCTGGGGCTCTGGCTGCCAC
CTAGGCTCGGCCTGCCAGCCACCACCCCGTCAGCCACCACCCCATCAGCCACCACCCCACCAACCACCAC
CCCGCCAACCACCACCCCGTGTGGTCCTCAGGGCACCCCATGGGTTGAATTTACATACAGAAAAGACTAA
CCAAGGTCCAAGTGTAATATGTCTTTTTAAAATTTATTTTAGAGACAGGGTCTTGCTCTGTCACCCAGGC
```

FIGURE 405 cont'd

```
TGGAGTGCAGTGGTGCCACCATAGCTCACTGCAGTGTTGAACTCAGGCTCAAGTGATCCTCCTGCTTCAG
CCTCCTGAGCAGCTAGGCCTACAGGTACACACCACCACGCCCAGCTAATTTTAAAATTTTTCTGTAGATG
CGGTGTCTTGCTGTGTTGCCCAGGCTGGTGTGGACCTGCTGGCCTCTGGTGATCCTCCTACCCCGGCTTC
CCAAAGTGCTGGGATTATAGGCATGAGCCACCACGCCTATAGCCAACATGTCTTTCTTTTGACTTCTACT
TTGGTATCTTTTCTTAAATGGTTCCCTCTGTCCCCCCGACACACACAGAATGGGGGAGAGGCTGTCAGAT
TCTGAGCTCCAGAACCTCAGGTGTAGCACTGGGATTGGGGGTGGGGGCTCAGGAACCACCTAGGGGAGAA
GACAGGGTGGGAAGAAACAGGAAGGAAGGTCCCCAAAATTATGTTTGTTTGCAGAGGCCAGCCAGGCTCC
AGGGGAGTGTGGACTCAGTCGAACCATAGGGCCCCAGGACCACTAGCTTCTGGCCAGCAGTCATGCCCTC
CACAGAGCTGGGTCCGTGGAAATTGCATGTAGGAGACACACCAGACTCCCAGGACAGAGCCCTTTTGGGA
TGGCCAGCACTACCCAGCCTCCACTGGTGAGGGAGGTCAGGGCTGTGTGACCTTTGCTTCTGGGACTGA
TGGTTTATTGAGCTGGAGAGTGTGCCCAGCAGTGTTCTCCAGCCCTCAGGAACTTCTAATGTGGCTCTGG
GTTCCTGGAGTGGGTGGGTCGAAGCTCCACTCGGGGAAGAAACTTCCAAGCTGCCTGCAGGTGCTGGAGG
TCCGGTGATTCACTGGCTCTGCCCCTGCAGTTCAAGTTCCTGGAGTGGCTGTCAGTGGCCACCTGTCTTT
AAATCTGTTCATTTTAGGAGCTACCTCTCACCAGAGGCAGGATCTTGGCATCTGGACTTGATCTGCTGAG
AATGAGGAGGATATGTTGTCCCCTAAGGACTGGGGCCCCAGGCTGCAAGCTGTGTGGCAGAGAGCCCATC
CTCACTCAGTGAGGACCAGTGATCCAGGAAAAGCCACAGCTTCTCCCTCCCAGCCCAGGGGCTTCCAGC
ATCCTGGTCTGCATGATAACCAAGAGGTCATAAACTCATTTCCATAATAACCTGAGCCCAGAAACCTGAT
TAGGGGGCAGCAAACTGAGGGGTGGGAGAGGTGGGAGGGTGGGCGATGAGAGGGGGAGGCTTTGAATCCA
GGTCCCTGCCTACCTTGGGGGTCAGGCGAGACTGCTGGCAGACGCTTCTCAGGGTGGCTGCTGGGCTCAT
GAGAGTTCTCAGGGTCTGGGAGAAATGGTGGAGGGTAAATGTTGTGAATATGGTCAGCAGGAGCCCCTGG
GGCTGGGGAGGGGCATAGGGGACTCAAGGTGACTGGGTGCTGCCCATCTGGAAGGAGGCAGGAGGCATGA
GCCCTTCCCTTCTCCCTTCCCTCTCCACCTCCCCCTGGTGCCTCACTCACCCAGGGGCCAGGGCTGTCCA
GTGGCTGTGGGGCCCAACTCCATGGGGTGAACGCCGCCCAGGGGGTGGTCCCTGTGTGGGCCATCTTTGG
GGCTGAGCAACGTGATAAGAGTCCAGGAGGTTGGCACAGTGATCCTGAGTGGGTTATTGCCTCCCCGCAG
CATGGTGTCCAGCCCAGGGAGTTCTGCGTTTACTGAGTTTCTTGGGGCACCCATCTGCTCCAAGTCACCC
TCTCAGCTCCCTTCCTGCTCCCTCTTCAGGGGAGCCTTGGGATCCAGGCTCCAAGTGAGCCTCATGCCCT
CGGCTGGCACCTCCTCTCTAGTCCTAACATTTCCTCCAGGCTCTGACAGCAGCCTGGCACTCTCCAGA
TGCTGGCATCGCTCAGCTTCCAAAGAACCTTGGATGTCCGCCCCTTCGGCAGCTATGTCTGCTCTCCTTG
CCCCTGGGTGCCCTGCTGCCCTTGATGATTCCAAGCCATCTTTGACTGTCCCCATCCCATCCCCCAAGGC
CTTGTCATTTCCTGTGATGTTCCTTCAAAACATTCTCCCCTGCCCTGAGACTCCCGCCTGGGGATGAGAA
GCAGCCGCCACCCTCTGCAGCGCCCCCTCCGTGCTGACACGCCAGGCTCTGGCCACCTTGCTCCTCTGCC
CACAGACCCTCAATCACAACTCGCTTTGTCAGGGTCCTCTTAGCTGCCACCCGGGGCCCAGGTGGTGCCC
TGCCCCTGTCTGTTATGCCCTCTGCCCCATCTCTGGCCCAAATCATGCCATCTCCCTTGGCTTGCCCGG
AGCACTCCCAAGACCAGGCTATGTCAGACATGGCCACAGAGTGCCTGCCCTGCCTAGGGCCCTGGTGCAG
GGTGAGTCCTAGGACAGCCATGCTTAGTATTATGTGACTCCCCACTCCGCCACCACCCAGGTCACAGAGA
ACTGGGTTAAGGCAGGGCCCTGGCACAGGGGCAGCCAGCACCGCAGCTGACCAGTGGTATGGAGTGAAAA
GATGTGCTGGGCCCAGCATTTGGGAACTTCAAGGGGGTGACAGAGGTGATTTGTGCAGAGGAAGTGGCAA
AGGGCCGAAAACTGGTGAGACAGAGGCTGGACAGGCCTCCGGGGGCAGCATGGTACAGGGACTGCAATCT
GAGCCAGGGAAAAACAGGGCGAAGTCAAGGGTGAGGCAGCCAGCTGGTGGGAGAAGCAGGAGAGTGGACA
AGAGGAGCTGTACTGGGAGGTAGAGGGCCATGCCTTGCGGTGCTGGTGGTGGGGCAGGGATCCACCCCCT
CGCTTGACTGGGAGGCCACTGGAACCTCCTGTTCAAAGCTACTTCTTTCCATGCCCTCTGGGGCTGCTCT
CTGCACCTGGGGCAAGGCTGAGGGCCTGCCCCAGCTCCCACAGCCCCAGCAGAGCTCTGAGGAGGGGAA
CCGCAGGAGTAGGCTCAGGAAGCAGGCGCTCGGAGCCTACCCACTGCACGCAGGGTCCCTTCTGCAGCCC
CAGCTGCATCGCTGCAGATGGGCTCCTGGGAGTCGGTAGCAACACCAGGCCAGGCCGGCCCTGGGAGCA
GAGGCAGCAGGACGCTGAGGAGCATGGCCAGCAGGAAGGTGTCATGGTCTGCGGGATTGGGGGAAGGGG
CGCTGAGTCCTGAGCAGGTGCACCACCCCAGCTCCTGCCCACATGCCCCCACTGGCATACTTTCAGCCT
GCACAGGGCCACTGTCCATGCTGCCACCAAAGCCTGGCTTGTCACAGAAGGGTGGAGCCCAGCCTGGAGC
ACAGTGGCAGTTATGGTTGCTATTGCAAACCTGCAGAGAAGAGAAGAGGAGGGTCACGTAGGATTAGGAA
CCCCAAGGTCACCCCCACTCCTCGGGCTCTCACCCCGTGGCTGTGGCAGGCAGTCAGGCAGCGCTGAAGC
TCCTGGAAGGCATTCTTCCTGCAGCGCCTGCTCTGGCACACCTACGGGCAGTGCACCAGGCAGTGAGGGG
GACACTGCCTGCGGGATTCAAACGGCAAGGAGGGGTCGGGTGGGCAGAGCTCACCATTCTAGGTCCACA
CTGGGTGCCTGGCTCTACCAGGCCCAGGCCAAGCAGGTCCAGCTGGGCACTGGGGAGTGCCAAGGCTCCC
CGACAAGTCACTTCCTGGCCATCTAGGTGAACGGTAGAGTCCACTGGCACCATGTGCGGTGCGAGCAGGC
TGGGCTTTCCACCCTGGCACTGCAGCTTCCCACACAGGGCATCCCTGGGGAGGAAGTAGAGGGGGGTCAA
CAGCTGCAGTACCCCCCTTCCCCAAACCCACTCCATAGCTTCTGCTCCCTCCACTCAGCTCCACTCCCTA
CCTCCCTGCACAGGGCAGGAAGTGGCCCTCGCTGTCCTGGCCGCAGTTTCCATGAGCATCTCCCGCAGAG
TTCACCACCTGGAAACAGGCCTCGGGAGCTGGGTGGGAGCCTGAGGAAGCATGGGCCAGGCTGGGGCAG
CTCGGAGAGGGGCTGCGCTCAGCGGCCTCAGTTTCCCCTGCCCATCTTCCCCACAGTAGAAAACTGGCC
CCACCAGAGGATGGGGGGCAGGGTGCAAGGGTGCTCGTGTCCTCTCACCAGGCCCCCAGAGCTGCTGGCA
CTGCTGCTCCAGCGTGGGACATGCGCCATCCCAGCAGTAGCCACTGCCCCTGGCACAGGGTGAGCCGTCC
AGTAGGTAAACGTCTGGGGGACAGTGGGAGGAGGTGCCCGTGCAAAACTCAGGGAGGTCACAGTCACCCA
```

FIGURE 405 cont'd

```
TGGCCTGGCGGCACAGCGCTCCAGCCGGCTTCAGCTGCGCAGGTGACGGGTGGTGGGGAAGGCAGAGAGA
GGCCACGTGCAGTGAGAGGTCCATGCCGAGAGCGCGGCTCGGAGCTGGGGGAGCCAGGCCTACCCAAGCC
CAGCACCCAACGGGGGAACCTGAGGGCACCAATTAACTAAGGCCAACAGGCCGGCTCCCAAGCTCCCCGA
AACCCTCACCCTGAACCTTCCATGCCCTCACCAGGCAGCGCACGCAGCAGTCCCCGTGGGCGCACTGGGC
CCCCGGGCGCAGCGAGCAGTTGTGAGCAAAGCAGCAGAGGTCGCGGCACTCCTGGGACCAGAAAGGCAAG
AAGGGCCCAGGTGAGGGCGCAGCGCCCAGACCTGAGCGGAGAGGGCAAGTGGGGCCGGGCGAGCCGAC
TTAACCTGGCCAGGGCCGCAGTCACACTCCTCGCCCGCTTCCACGAAGCCGTTCCCGCAGAGCGCCGGCG
GCACCGGGAGTCCGGGGTCCGGGGCATTGGAGAGGCAAGCGCCGCCCCCCTTGCGGAAGAAGGCGCGCAG
CTGGCGGCGGCTGCAGGCGCTGAACACGCGCGGAAACGGGTGCCTACCGGCACGGGAGGGCATTGGGCA
TGGAGGGACAGTCCCCCAACCCCCGCGCTTCTCTGATCCCCACCCCTGGGCTTGGCTACAGCCGCCAGAC
GCGCAGAGCCCAGAGAGGGGAAGTAACCCGCGCAAAGTCACACAACAAGCGGGACAGGGGACGATGCGGC
CCCAATAGTGAGCAGCCCGGGACCCAAGGTGGAATCGCGACCCGACGGTGCTCCTCCCGGTGTAGGAGTA
ACCTCGCCAGGTTACTCGGAAAATAATCTTCATACCGTTGAGAATCCACTTTGCCTGAGCTTCTTCCCTT
TAAGCCTCATAAACCACCCTGAAGCGGACACTATGATCATTATCCCCATTTTACAGAAGAGGAAACTGAG
GGACGACCAAAGAAACGCAGCGGAGGAAGTCCCCAGGACTAGCCGCCCCGCCGCAGCCCCGACCCCCAC
CCGCGTACCCGGTGGCCGCAGCCATGACGCAGCCTCCGGACTCGGCCGCAGCCTCCACGCAGCAGCCGTC
GGGGTCGTGGCTGAGGCCGAGGCTGTGGCCGATCTCATGGGCCATGGTGGCTGCGGCGCCGATGGGGAGC
TCCGAGTGGTCCTGGGGGGCCGTGGGAGGCGGTCACTGCGGCCGTAGAGCCTCCTGTCTCTCCCTCGCC
CCCGCCCGCGGGGCTCACCGTGCTCACGCCTCCCGAGCTCTCGGCGCGGCACATGCCCTCGACGGGCGCC
AGGCCCACTGTGGCGCCCTGGAAGGCGCGGCCCCTGGGGGCGGAGCGCGGCGTGACCAGGCGGGGCCGGG
AGGTGAGGCCGCCCCACCCGGGACCCGCGTCCGGGTCAGAGGCACCCACGTGAGCAGCTGCGCGGAGTCG
TGGGGCCGCTGCGCCCACAGCCCCGGCGCCACTGCAGGAAGGCCCAGAGCGTGGCGTTGGCGTCCTGCG
TGACGCGGCTGCGGTCCCGCTCGGTCCACACCTCCAGGCCGGTCAGCGCCACCTGAATGTCCAGAGTCCT
GAGAAGCTGAGGGCGAGGCGGGCTGAAGCCGGGACAGGGCGCCCCATCGCGCCGGTGGTCCTTCGTGGG
GCGCCCTTCCTCTTCCCCAAACCCCACCAGCACCTGCCTGTCCTGCCGCCGCCACCCCATCACCGCTCT
CTCCCCGCCGCCCCAACCTGGTCCACGTAGTTGGCGACTTCCAGGAGACGCTGTTTGGTGTGGTTCAAG
TTTCGGTGCCGAGTCAAGAACTGGGAAGGCAGAAATCCCGGTGGCTTGAGGGGCTGAGCTGGCCCCATCC
CTGACCCCGCCAACCCCTGGGGTCTCTCCTCACCAGGGTGTGGTCTGCCACAATGTACAGTTCCAGGTAC
TTCCGGGTCCTGCGCGCTTCTCGCCTGCCCTGCCGGAGGTGCAAATGGGGACCCTGAGTGGAAGCTGCTGG
GCTTGAGCCCTGACCACCAATCCCAGCTCCCAGAAGGAAGTTTAACATGTTTTCTGGAACTTGTTTCTTC
AGACTTCAATAAAAATACTGGGACTCGAGGCCTGTGAATTCCCGTCTCTTCTGATTTGGAGGGCTATAGA
TACAGCATTCCCACTCCCATCCGATCGATGCCCCTGACCCTGCTCTGGGGACCACCAGGAAGGCTGGTCA
TGCCCGCTTTGTTCCCAGGATCCCTGTGGCCACAGGTTCCTTTCCAGGTGAGCAGCTGCTCCATCCGAAA
GATCTCGTGGGTTGAGAAGTCCTTGGAGCCCCGGGGTGGCCAGGGACGCAGATAATAGCTGGCATTCCTG
CTGAGGGTGATCAGGCCACTAGGGTGCAGAGGGGTAGGAGCGGGTGTGAGGGAGCTCTTTCCCCATCCCA
GGCCCAGCCTCCTCTCCCAGAGCTCACCTCATCCCAGAGCAGGTGCAGAGGACTACCCAGGAGTCGGGGA
AGCCCCTTACTCGCCCTTGGTAGTGGCAATGATCCTAGGGAGGAAGGGGCCAGCCCCAAATCTCAGCCAG
GGCTGGAGCAAGAGGGCAAGAGGGAGGGTGTGGTAGGGGCTGGCTCCAACCGCCCCTTAGGAATGCAAG
GAGGAGTAGGGGTAGGAATGGTGGGGGGGTACCTCTGGCGGTGCATCCCAGAGCCCATGGAAGCATCTCA
CCGTGTGGTTGGGGGCCAGCACCACTGGCTGCCCATCTGGGCCGTAGTGGGTTTCTATGTATCCTGGGC
CAGCAGCCTGCTGAGAGGGGGTGTTACAGGGAACACTGAATTCAGCTTCCTCCTGCCTCCTCCAGGATGT
CTCCCAGCCTTCCTCCCTAAATGCTAATGGAGCAGCTTTATGAGTGAGACACTCACAGTGTGTCTTAGGG
AAGGGACAGGAGCAATGGTGACTTGCTCAGATCAGAAACTCTTGGGGCTAGAGGAAGGAGCCTTGGTGAT
GGCTTAGTTGTGGGAGGTGTGAATATGGGAAGCACCAGGGAGGACGCCGGGGAGGAGTGGGAATAGGGA
AGAGTTTGTGGTTCCCAGGGGACCTGCAGCAGGCAGCAGGATCCACAGGATCGGGAGGGGAGGAGTCAGG
AGACACTGCCGAAGAATGGGACTTGGAGTTGGGGAAATGCGGTGACCTCCCCCAGTTCCCCTGCCTGCT
```

FIGURE 406
SEQ ID NO: 398
Genbank ID : AI991252
Unigene ID(#167) : Hs.376046
Unigene name : butyrophilin, subfamily 3, member A2    BTN3A2
>gi|5838157|gb|AI991252.1|AI991252 wu41e09.x1 Soares_Dieckgraefe_colon_NHCD Hom
o sapiens cDNA clone IMAGE:2522632 3', mRNA sequence

```
TTTCATTATTAACAAATTTATTGAACAACTAGAACTTGACAAGCACTTGCCCAGTAAAGGGGATACAGTG
GTGAGCAATAATAGTGATGATAATGAGGAGCAGTTTTCCCTAGCAGGCAGCAGTTGAAAGGAATATGGGT
TTAACATCCACCAATGACCAGGAGTGGACAGATCCTTTTCCAGGAGACTGAGTCCATAGTGGGATTAAAA
ACATCCCTGTAATTCTTCTAGCTTCCTTCATCCAAATTACCAATATTACAGAGAATCTCTAGGGGTATTT
GCTCTGCCTGGAAACCTTGACTGAAGGAAGGCTGGCTCTGGCTGCACGATCACTTATCACATTTGTTGGG
```

FIGURE 406 cont'd

```
TGGGAACACATCTGTGCCCCATTATTAACTGAGTGTGGCCTCTAGTCTCTTTCAAAGTCACATGCCCTGT
GGGAACTGCAACGTTATTCTCTCAACCAAGACACTCTGCAGAGCCAATCCAAGGAGTGCTGGGTCTAAGG
CTCTGATAATCAGCTGGGAAGGAGTCCATAGGGGTCTTAACTCCACAACCACTCACAGTGATCTCGATCC
TGGAGCTGTCCT
```

FIGURE 407
SEQ ID NO: 399
```
Genbank ID        : T75480
Unigene ID(#167)  : Hs.13982
Unigene name      :       potassium channel tetramerisation domain containing
6      KCTD6
>gi|692242|gb|T75480.1|T75480 yd63b06.s1 Soares fetal liver spleen 1NFLS
Homo s
apiens cDNA clone IMAGE:112883 3', mRNA sequence
TTTTAATTTTCATATTTCATTTTTTATTAGTTTTGTTTTTTTTTCTGGTAGACAGTACACTTGGGAATT
ATACTGCACCAGGCATAAAGAGTAAGTTTTCTACCACAGGGACATTTTGTATTCAGAATTCAATATAAAT
ATTTCTAGTCAGACATTTCCATGGCTACAGATATTTGGTTCCTTGATTTATATGCATAGAAAGAAACAGT
TGTCATAACTGTAAAAAGCAGTACTTAATAAGNACTTTTAAATGATTGGGAACAGTTTTCCTTTAATATT
ACAATACTACTTATTTATTGGGTTTGGGAAACTAGGGNCACCCCTACATGGATGTTTTGGATTTTTCTCA
AAGGGCATCATGAGGTACTCNGGCTTATTCTTTCATTCTTGGTATTTTTAGGCCCTTCTAGGTTGAGTTA
GGGGGNCCCATTTTATCAGGGNAATCATTTTAGGCCA
```

FIGURE 408
SEQ ID NO: 400
```
Genbank ID        : AF099143
Unigene ID(#167)  : acc_AF099143
Unigene name      :
>gi|4336616|gb|AF099143.1|AF099143 Homo sapiens mast cell tryptase beta III
gen
e, complete cds
ATCTGGAAGCATAAATGGGGAGGGGAGAGCCCACTGGGTAGAAGGAACAGGGAGCGGCCAGGGTAAGTCC
CCACTCTCAGAGACCCTGACATCAGCGTCACCTGGAGCAGAGTGGCCCAGCTTCAGACTCAGAGCACCAA
GACCCAGGCCTGCAGGCCTGGACCCACCCCGGTCCCCCCGTCCCAGCTCCATTCTTCACCCCACAATCTG
TAGCCCCCAGCCCTGCCCTGTGAGGCCCGGCCAGGCCCACGATGTCCTCCTTGCTCCCCAGATGCTGAA
TCTGCTGCTGCTGGCGCTGCCCGTCCTGGCGAGCCGCGCCTACGCGGCCCCTGGTGAGTCCCAGCCGGGG
TCCACCCTGCCCCTCACCACATTCCACAGGTCAGGGCCTGGGTGGGTTCTGGGGAGGTCGGGCTGGCCCC
CACACAGGGAAGGGCTGGGCCCAGGCCTGGGGCTGCTTCCTGGTCCTGACCTGGCACCTGCCCCAGCCCC
AGGCCAGGCCCTGCAGCGAGTGGGCATCGTTGGGGGTCAGGAGGCCCCCAGGAGCAAGTGGCCCTGGCAG
GTGAGCCTGAGAGTCCGCGACCGATACTGGATGCACTTCTGCGGGGCTCCCTCATCCACCCCAGTGGG
TGCTGACCGCAGCGCACTGCGTGGGACCGTGAGTCTCCCGGGGCCTGGAGGGGTGGGGAAGGGCTGGATG
TGAGCCCTGGCTCCCGGGTGCTCCTGGGGGCTGCCCAGGGCCCTGAGTGGGATCCTCCGCTGCCCAGGGA
CGTCAAGGATCTGGCCGCCCTCAGGGTGCAACTGCGGGAGCAGCACCTCTACTACCAGGACCAGCTGCTG
CCGGTCAGCAGGATCATCGTGCACCCACAGTTCTACACCCAGATCGGAGCGGACATCGCCCTGCTGG
AGCTGGAGGAGCCGGTGAACGTCTCCAGCCACGTCCACACGGTCACCCTGCCCCCTGCCTCAGAGACCTT
CCCCCCGGGGATGCCGTGCTGGGTCACTGGCTGGGGCGATGTGGACAATGATGGTGGGTCTGGGGACAGT
GGAGGTGGGGCAGGGTCTTAGCCACAGCCCAGCCCCTGGGCTCCCTCTGGGCTCCAGGTGGGGGTTGCC
CGGCCCCCTCCTGAGGCTGCACCCTCTTCCCCACCTGCAGAGCGCCTCCCACCGCCATTTCCTCTGAAGC
AGGTGAAGGTCCCCATAATGGAAAACCACATTTGTGACGCAAAATACCACCTTGGCGCCTACACGGGAGA
CGACGTCCGCATCGTCCGTGACGACATGCTGTGTGCCGGGAACACCCGGAGGGACTCATGCCAGGTGGGC
CCCGCCTGTCCCCCGCCCCCCGCCCCCAACCCCCACTCCCAGGCCTGTTCGGCGAGCGCTGACCTCTGA
CCTTCCCAGGGCGACTCCGGAGGGCCCCTGGTGTGCAAGGTGAATGGCACCTGGCTGCAGGCGGGCGTGG
TCAGCTGGGGCGAGGGCTGTGCCCAGCCCAACCGGCCTGGCATCTACACCCGTGTCACCTACTACTTGGA
CTGGATCCACCATCTGTCCCCAAAAAGCCGTGAGTCAGGCCTGGGGTGTCCACCTGGGTCACTGGAGAG
CCAGCCCCTCCTGTCCAAAACACCACTGCTTCCTACCCAGGTGGCGACTGCCCCCACACCTTCCCTGCC
CCGTCCTGAGTGCCCCTTCCTGTCCTAAGCCCCTGCTCTCTTCTGAGCCCCTTCCCCTGTCCTGAGGAC
CCTTCCCCATCCTGAGCCCCCTTCCCTGTCCTAAGCCTGACGCCTGCACCGGGCCCTCCGGCCCTCCCCT
GCCCAGGCAGCTGGTGGTGGGCGCTAATCCTCCTGAGTGCTGGACCTCATTAAAGTGCATGGAAATCACT
GGTGTGCATCGCTGTGTTTCTGGTTGTGGATGTCACTGGGAGAGAAGGGGTCCAGGTGTGCTGAGGACAC
```

FIGURE 408 cont'd

CTGCCACAGTGTGAGGTCCTAGCCCTCAAGGCACAGCCAGTCACCGTGGGACGGGGCCTCCTGGGCAGCC
CTGGTCCCCGAGGCTGGCTTCTCCCCACACGATGCATCCAGCATTCGGGTCACACAGAGCCACTCGGGCA
ACTCAGTTGATTATAAAGGACAGCCAGGTCCCTGCAACCGGGTCAAGACAGAAATGGTCACCGGGAACCC
CAGGGCTGCCCATCACGAGCCCCTACCCCACGCTTCCCACGAGCTCTTCTCCCGGCCCTCCCGTCCATGC
TTGTGCTTTGCCTAATTGTTTGCTTTTGAGAACGGGATTG

FIGURE 409
SEQ ID NO: 401
Genbank ID          : AW263497
Unigene ID(#167)    : Hs.97774
Unigene name        :       synaptotagmin-like 5      SYTL5
>gi|6640313|gb|AW263497.1|AW263497    xn80a06.x1    Soares_NFL_T_GBC_S1    Homo sapiens
cDNA clone IMAGE:2700754 3', mRNA sequence
TTTTTTTTTTTTTAAGTCTGAAGACATTTTATTTTTCCTATGTGGGAAGCAATGATGATCTTACACTTT
TTGTTTTCTGTTTTTAAAAAGGGCAGCACAAGGATATGTGCAGATTTTCTTTTAAGTACCTTGCTAAGCG
ACACTAAACTAATAACCATTTTCTAGAATTAGGTGACCTACTTCTGAATAAAATTGAAACTGGATTGCGT
ATTCCCTTACTAATAATAATACTAAATATATTCTTAAATCAGTTTTCAAAATTCAAGATGAAATCTAGAA
ATATGGAACAACTAGCAGGAATAAGCCCGAAGATGATTCTAGCTCCGTTACTACTAAAACCTAGTTTCTA
AACTTTCGAGGATTTTATATGAACTCGCATGAAAAAATGAGCTCAGAGGCTAGAATATGACTCCAGAACA
TACCTTGGTCGGGTATGTTCATGCTCAAGTAATCAGACTCTGCTCCAAATTTCTTGAC

FIGURE 410
SEQ ID NO: 402
Genbank ID          : AK000839.1
Unigene ID(#167)    : Hs.306410
Unigene name        :       CDNA FLJ20832 fis, clone ADKA03033
>gi|7021158|dbj|AK000839.1|  Homo sapiens cDNA FLJ20832 fis, clone ADKA03033
CTTTTCTCTCCTCCGCGCCGCCGCCGGTGCGCAGGCCGGCTGGGGACTCGCCTCCGCTCGGGCCTTC
GGTTTCGCTCCCTCGCTGAGTCCCTTCTCCCCGCCAACAAAAGGTGATGATTCCTAGCGGACTGGGCACG
CCTGGACGGCGGAGGGTGGCTGGGAGGGGCGAGGTCACGCTAGCAACCTGTGGCTGCCAGGAGAAGGCGG
CTGGGAAGCCACGGAAAGACCCGGGAGCGCAGGGGAGGTGGCTCAGCTCGCGCGCAGCCCCTGCTCTTAT
TTTACTATTATGCGTGTTGCTGTTCGTATCCTTCTGGGCGGTGAAGGGGAGAGGCAGCCTCCCGCTCCGG
TGAAACCCGTCCTGGGAGTCGCCCATAAACCCTGTTCTCCATCTCGGGCGGCTCGAGGGGTGAGGGGGT
GCGGCGCCTTGGTGGGATTGGCAGGTGGTGACTTCCAGGGCGCAGAGGGAGAAAAATCTCTGCTCTTGGGC
GCCAGGATCAAGGATACCCAAACCCGCGGTGGCTCTGCCGCCTGTTCCTCTCTCTTGGGGTGCTGGGGCA
CCTGGGCCGCATCCCTTGTGAAGTGTAGAGCAGCAGAGAGGCCCGGCCGCCGGCCCAGCGGCCCTCCCAA
ACTTCCGAAATGCCGACGGGTTGGACGGGTTTCCGAGAGCTGGCGAGTTGAGAAGGACAGGAGGTGTGGG
GTGGGGAGGGGCCTGGACCGTTGGAGTGGGTCCTGGAGACCCTAAGTGGCCTATGACAAGATTTGGAAA
GGTCCCTGGTTGACGCTAGGGAGCTGGTGGGGATCCTAGCAGCGCATTTTGTCTGTGGGCCCTGGGCCAG
ACTCTAGGCTCCCTGAGTGCCCAGATGGGGTCTGAGATTACCTATTGGACCCTCTCTTGGCAAAGACAA
CCATAGTGTGATAGTTTGCTTTTTTCTCCCAAATATGTGTGAGTTCAGCCTGTCTGGGAGAATGTTGATG
TTAGAAATCAGGCCCAGAGGCCAACATTGGCAATTCCTAGATTTAAGATTAAAAGAAAATCAGAGGGTCT
CTGGACCTAGTTGTGGGCAGGTGGGAACTCTCCTCCTACCCACCTGCAAGGTCCCAGGACTGGGCATAGG
CAGAGATCTCTGGAGTGTTGCAGTTAGAGGGTTGTTTTGTGTTGTTCCTGTATTTGTTAATGAAATTGA
TATTATTTTGACTTCCTCACTAAAGATGCAAGTATTTCTCAGACCTAGGGAGTTGAGTAGGGAGTCTGGG
TGGGGTGGAGGCTTTTTCTATGCACATTTTCCCTTACTCTGTCACAGCTTTCACAGTCTCAGTTCCCTCC
AGCCCAATCCCCAGACTCTCAGCTTAGTAAATTCACGGCTTCTGGGAGCTTCAGAAAGTTGGTTCGTAAA
CCCCAGACGCCCATTTTGGCCCTACCACCAGCAACCAAGCAGGTGGCTAGGCGAGTTCATATGTGTTTA
GAAGGAAAGGACCCGTCTGGGCTAGGAAGGTGGGGAAATGGGGTTCCTCCCCACACTTCCCCGGGATAG
ACCCTCTCTCCTGGCTCCCAGGATGTGTGAGAGGCTGGGAGGGGCCCTATATCATCTGGCTGCATCTTTA
ACGGTTCCTCATTGCCCTTCATTCGGAAATGAAACGCCTTTGATCTTTTCTCAGGTTGTAAACGGAATTG
CCCGTCATTAAATATCTGGGGCCCCATCTGCTTGGTCTCCCAGCATTTTTCTTTACAGCTGTTTCTCTCT
CTTTTTACCACTGAATTTTTCCAAAAGGACTTTTATTACACCACCTTCACACCCAGCCGCCTCTTCCTCC
TCCCTTCGCTGAGAGGCGCTTTGGAAAATATCTAGATATTCGTTTGATCACAAACTAAAGGCTTGGAGGG
GCACGGAGGAGCCGATTGGGGTTTTGTTTTTTCTAAAAAAAAAAAAAAAAAAAAAAAAAAAA

FIGURE 411
SEQ ID NO: 403
Genbank ID           : AA572675
Unigene ID(#167)     : Hs.188173
Unigene name         :       CDNA FLJ12187 fis, clone MAMMA1000831.
>gi|2360892|gb|AA572675.1|AA572675    nf18g07.s1   NCI_CGAP_Pr1    Homo    sapiens
cDNA cl
one IMAGE:914172, mRNA sequence
TTTCCCTAAAAAAGGCTTATATTTACTTGATTTGAATTTTGCTAGCATGCTTTTTCTTCTGAATTCAAGT
GACTAGAACTGAAATTATTCCACCTGGGGAGAAGAAACAGCTGAAACCAATTTAGTATTGGTTTTCAAAT
ACATGAAGGGTACTCAGAGAGAGGATGATTGCCAAAGAAAATGGTCTTTGAACCATAGAAAGAATCTGAG
CTTGCTCTAAAGTTAAATTTCCTGACTTACAGAGTTTATGACATTAAACTGAGAGACCAAGGGATCCTTT
TTGGAGACTTCAAAAATAGGATAGATCCTCAAATGCCTGAGATGGCTTGGATGTGGCTTTGTCTGAAGTC
AGGAGGATAAATCTTACCACTGATGGTCCCTTCAGGCGTGTGAATCTATGGGTTTGACTGGCATGTCAGA
AGCTAGAATGCCAGCCCAGGACATCTAGAGAGTCATCTCTCCAATGCTGGGTAGCAGTCTATCAATCGCT
CTCACTGCCTCAACATCTCTCAGC

FIGURE 412
SEQ ID NO: 404
Genbank ID           : NM_004703.1
Unigene ID(#167)     : Hs.390163
Unigene name         :       rabaptin, RAB GTPase binding effector protein 1
    RABEP1
>gi|4759005|ref|NM_004703.1|  Homo sapiens rabaptin-5 (RAB5EP), mRNA
GCGGAGGTCGGCGGTCGGGTCCGTCTCTGCCCGCGGCTGTGGCGGCGCCGGCGGATCCAGCCTTAGCGTT
CCTCTCTGGGCGGCGGCGGCGGCGGCTCGGTTGACGCCTCCTCCGCCAGCTGAGCCCGCGGGAGCCCAGG
ACGCCGCTTCCCCGCCCATCCCCGCTCCCCGAGGCCGGCCGCCTGGTCATGGCGCAGCCGGGCCCGGCTT
CCCAGCCTGACGTTTCTCTTCAGCAACGGGTAGCAGAATTGGAAAAAATTAATGCAGAATTTTTACGTGC
ACAACAGCAGCTTGAACAAGAATTTAATCAAAAGAGAGCAAAATTTAAGGAGTTATATTTGGCTAAAGAG
GAGGATCTGAAGAGGCAAAATGCAGTATTACAAGCTGCACAAGATGATTTGGGACACCTTCGAACCCAGC
TGTGGGAAGCTCAAGCAGAGATGGAGAATATTAAGGCGATTGCCACAGTCTCTGAGAACACCAAGCAAGA
AGCTATAGATGAAGTGAAAAGACAGTGGAGAGAAGAAGTTGCTTCACTTCAGGCTGTTATGAAAGAAACA
GTTCGTGACTATGAGCACCAGTTCCACCTTAGGCTGGAGCAGGAGCGAACACAGTGGGCACAGTATAGAG
AATACGCAGAGAGGGAAATAGCTGATTTAAGAAGAAGGCTGTCTGAAGGTCAAGAGGAGGAAAATTTAGA
AAATGAAATGAAAAAGGCCCAAGAGGATGCTGAGAAACTTCGGTCCGTTGTGATGCCAATGGAAAAGGAA
ATTGCAGCTTTGAAGGATAAACTGACAGAGGCTGAAGACAAAATTAAAGAGCTGGAGGCCTCAAAGGTTA
AAGAACTGAATCATTATCTGGAAGCTGAGAAATCTTGTGGACTGATCTAGAGATGTATGTAGCTGTTTT
GAATACTCAGAAATCTGTTCTACAGGAAGATGCTGAGAAACTGCGGAAAGAATTGCATGAAGTTTGCCAT
CTCTTGGAGCAAGAGCGACAACAACACAACCAGTTAAAACATACGTGGCAGAAGGCCAATGACCAGTTTC
TGGAATCTCAGCGTTTACTGATGAGAGACATGCAGCGAATGGAGATTGTGCTAACTTCAGAACAGCTCCG
ACAAGTTGAAGAACTGAAGAAGAAAGATCAGGAGGATGATGAACAACAAAGACTCAATAAGAGAAAGGAT
CACAAAAAAGCAGATGTTGAGGAAGAAATAAAAATACCAGTAGTGTGTGCTTTAACTCAAGAAGAATCTT
CAGCCCAGTTATCAAATGAAGAGGAGCATTTAGACAGCACCCGTGGCTCAGTTCATTCCTTAGATGCAGG
CTTGCTGTTGCCATCTGGAGATCCTTTCAGTAAATCGGACAATGACATGTTTAAAGATGGACTCAGGAGA
GCACAGTCTACAGACAGCTTGGGAACCTCGGGCTCATTGCAATCCAAAGCTTTAGGCTATAACTACAAAG
CAAAATCTGCTGGAAACCTGGACGAGTCAGATTTTGGACCACTGGTAGGAGCAGATTCAGTGTCTGAGAA
CTTTGATACTGCATCCCTTGGGTCACTCCAGATGCCAAGTGGGTTTATGTTAACCAAAGATCAGGAAAGA
GCAATCAAGGCGATGACACCAGAACAAGAAGAGACAGCGTCCCTCCTCTCCAGCGTTACCCAGGGCATGG
AGAGTGCCTATGTGTCCCCTAGTGGTTATCGTTTAGTTAGTGAAACAGAATGGAATCTCTTGCAGAAAGA
GGTACATAATGCTGGAAATAAACTTGGTAGACGTTGTGATATGTGTTCCAATTACGAAAAACAGTTACAA
GGAATTCAGATTCAGGAGGCTGAAACGAGAGACCAGGTGAAAAAACTACAGCTGATGCTAAGGCAAGCTA
ATGACCAGTTAGAGAAGACAATGAAAGATAAGCAGGAGCTGGAAGACTTCATAAAGCAAAGCAGCGAAGA
TTCGAGTCACCAGATCTCTGCACTCGTCCTAAGAGCCCAGGCCTCCGAGATCTTACTTGAAGAGTTACAG
CAGGGGCTTTCCCAGGCAAAGAGGGATGTTCAGGAACAGATGGCGGTGCTGATGCAGTCACGGGAACAGG
TTTCAGAAGAGCTGGTGAGGTTACAGAAAGATAATGACAGTCTCCAGGGAAAGCACAGCCTGCATGTGTC
ATTACAGCAAGCAGAAGACTTCATCCTCCCAGACACTACAGAGGCACTGCGGGAGTTGGTATTAAAATAC
CGTGAGGACATCATTAATGTGCGGACAGCAGCAGCCACGTAGAAGAAAAGCTGAAGGCTGAGATACTTT
TCCTAAAAGAGCAGATCCAAGCAGAACAGTGTTTAAAGAAAATCTTGAAGAAACTCTGCAACTAGAAAT
AGAAAACTGCAAGGAGGAAATAGCTTCTATTTCTAGCCTAAAAGCTGAATTAGAAAGAATAAAAGTGGAA

FIGURE 412 cont'd

```
AAAGGACAGTTGGAGTCCACATTAAGAGAGAAGTCTCAACAGCTTGAGAGTCTTCAGGAAATAAAGATCA
GTTTGGAAGAGCAGTTAAAGAAAGAGACTGCTGCTAAGGCTACCGTTGAACAGCTAATGTTTGAAGAGAA
GAACAAAGCTCAGAGATTACAGACAGAATTAGATGTCAGTGAGCAAGTCCAGAGAGATTTTGTAAAGCTT
TCACAGACCCTTCAGGTGCAGTTAGAGCGGATCCGGCAAGCTGACTCCTTGGAGAGAATCCGGGCAATTC
TGAATGATACTAAACTGACAGACATTAACCAGCTTCCTGAGACATGACACCCTCATGGCAGGATTCTAGC
CTGCACTTTGGGTTTTTAACTCATCTTTAGAGCAACAGTAATTATTTAACTCTTAACTGAAGAAAGA
GAAGTCACAACAAAAGGAAGACTGGAGAAATGCTTACTTCTAGAGGGAGAAGACTGTGCGGCACAGGAAA
CAGCAAACAGTGGGGTGATCTGCAG
```

FIGURE 413
SEQ ID NO: 405
Genbank ID       : AL135396
Unigene ID(#167) : Hs.339665
Unigene name     :      MRNA  similar  to  RIKEN  cDNA  2700049P18  gene  (cDNA
clone MGC:57827 IMAGE:6064384), complete cds
>gi|6603583|gb|AL135396.1|AL135396   DKFZp762I2315_r1   762   (synonym:   hme12)
Homo s
apiens cDNA clone DKFZp762I2315 5', mRNA sequence

```
GTATTCTTAAATTCAGACGGGAAGATTCTTTCACATATCACTCAGTTACCTCCCAATCTGGGGGAGTTTT
TCTTACAACTTGATACCAGATACCATTAATTTTACATTCCTGAATAAAGGCCTAGTACCCACGCATATTT
CAACCATGCATATATCAAGTTCAACCGAGTTTTAATAGGGGATTAAAAAAACAAGCTGTTAGGTTTCCAT
GGGCACTGGTTCTCATAGGTTCTATTGGTGATAACTGCTTTAACATGGAGCAAGAGTTTGTGAATCAGGA
AATAGAATAAATTAAAATTTAAAATATATAGAGGAATCCTCTTGATTGCTCAGCATGATGTTAGATAAAT
GAGTTTGTCAGAAAATATCAGTATACGCTGTTTACCAATGTTATTTATTTACATTCTTCTAAAGCCATTA
TGGATATTGTATTATGAGAGATAAACCTAAATAAGTTATCCTGTTCCCTAGGACCTTCTCTGTAAATAGT
GAATTTTAGACGAGTAGTCTGTCCTAAATCTTAAATAGAAAAAAAAACTAAAGCGATTTGCTTAAGCCAT
TGTACATTATAAAGAGCTGTTTTGTTTTGCTTTGCTTTGCTTTGTTTGTTTTTTTTAAAGCTGCATTCA
GAGCCACAAAGGAATAGGAAAGTAGGGTAGTGTTGGATTCTGGTTTTATGTAACTCTAAAATAAATGTAT
CTCTTTAATATCTCAGTTGTAGGGATTTTGTCAATACCAAAGCAGACTGAGTTGTGGTTTTGTAAATAAA
GTTTTTTCTAAAAATGAAAAAAAAGAAAAAAAAAAAAAA
```

FIGURE 414
SEQ ID NO: 406
Genbank ID       : NM_006334.1
Unigene ID(#167) : Hs.74376
Unigene name     :        olfactomedin 1    OLFM1
>gi|5453546|ref|NM_006334.1|   Homo   sapiens   olfactomedin   1   (OLFM1),
transcript va
riant 2, mRNA

```
GCGCGGGGGAGCCATTAGGAGGCGAGGAGAGAGGAGGGCGCAGCTCCCGCCCAGCCCAGCCCTGCCCAGC
CCTGCCCGGAGGCAGACGCGCCGGAACCGGGACGCGATAAATATGCAGAGCGGAGGCTTCGCGCAGCAGA
GCCCGCGCGCCGCCCGCTCCGGGTGCTGAATCCAGGCGTGGGGACACGAGCCAGGCGCCGCCGCCGGAGC
CAGCGGAGCCGGGGCCAGAGCCGGAGCGCGTCCGCGTCCACGCAGCCGCCGGCCGGCCAGCACCCAGGGC
CCTGCATGCCAGGTCGTTGGAGGTGGCAGCGAGACATGCACCCGGCCCGGAAGCTCCTCAGCCTCCTCTT
CCTCATCCTGATGGGCACTGAACTCACTCAAGTGCTGCCCACCAACCCTGAGGAGAGCTGGCAGGTGTAC
AGCTCTGCCCAGGACAGCGAGGGCAGGTGTATCTGCACAGTGGTCGCCCCACAGCAGACCATGTGTTCAC
GGGATGCCCGCACAAAACAGCTGAGGCAGCTACTGGAGAAGGTGCAGAACCATGTCTCAATCCATAGAGGT
CTTGGACAGGCGGACCCAGAGAGACTTGCAGTACGTGGAGAAGGATGGAGAACCAAATGAAAGGACTGGAG
TCCAAGTTCAAACAGGTGGAGGAGAGTCATAAGCAACACCTGGCCAGGCAGTTTAAGGGCTAACTTAAAA
GAGTTTTTTCAATGCTGCAGTGACTGAAGAAGCAGTCCACTCCCATGTAACCATGAAAGAGAGCCAGAGA
GCTTTTTGCACCATGCATTTTTACTATTATTTTCCAATACTTAGCACCATTTCACTAAGGAACCTTGAAT
ACAACCAGGATCCTCCTTTGCATGCGACTGTAGCTGCATTTCATGAATAGTTTGAACCCTTGTCAATGCA
TTTTTTGAAAAAGAAAGAAAAAAAAAAACTTCGTGTATGTGACTCAAAGCATGTAACCTTAAGATGTTGCA
TTCTAAACTGACAATAAAGACCTTTCCCC
```

FIGURE 415
SEQ ID NO: 407
Genbank ID            : AI559190
Unigene ID(#167)      : Hs.105887
Unigene name          :         similar to common salivary protein 1      LOC124220
>gi|4509395|gb|AI559190.1|AI559190   tq42g08.x1   NCI_CGAP_Ut1   Homo   sapiens cDNA cl
one IMAGE:2211518 3' similar to TR:Q63015 Q63015 COMMON SALIVARY PROTEIN 1 PREC
URSOR. ;, mRNA sequence
CACTGATTCTGCAGAAGCTTTATTTATTGGTGGATTCAGATTCAGCGTCCCGACTCAGTTACTCCAGTAC
CATCAGCCACCACCACACAGATGGCCTCAGCTCGGATGGCCCCATACCCCACCCTAGCGACCCACGGGTG
AGTTTGCTGAGTATGTGAGATTAACTGGTGGCTCAGTGGTCGGCTCCTCTAGTGGATAATTCCATTCAAA
GCCAATGCTCTTGATGCCAAGGAGTTGATACTGGCCATAGATGCCCACCAGCACCTGCCCCTCTTGGCTG
GGGTAGGCAGAGGAGATCTGGCCATCAAGCTTCCCAAAATAGAAATAGCGGTCCTTGCTGGTGTACATGA
CCATACCCCGGAGGAAAGCTTGGAAGGCGACAAAGACTTTTGTGATGTATTCGCCTGGCTGCAGGGTGAC
TTCCTGGGTATTCCCACCTAAGGCTCCCAGTTTCACGTCCCAAGAGTCTCCAAGTTTCACCTGGACACTT
TTCACCAGGAGAAGACCTACAGACACCCGCAGCCCTGTGATTTCATGGTCGTAGTCTTCAGTGGTGCTGA
AATACTTGCCTCCTCCAGGGCC

FIGURE 416
SEQ ID NO: 408
Genbank ID            : NM_005196.1
Unigene ID(#167)      : acc_NM_005196.1
Unigene name          :
>gi|4885132|ref|NM_005196.1|  Homo sapiens centromere protein F (350/400kD, mito
sin) (CENPF), mRNA
GGAGAAGCGGGCGAATTGGGCACCGGTGGCGGCTGCGGGCAGTTTGAATTAGACTCTGGGCTCCAGCCCG
CCGAAGCCGCGCCAGAACTGTACTCTCCGAGAGGTCGTTTTCCCGTCCCCGAGAGCAAGTTTATTTACAA
ATGTTGGAGTAATAAAGAAGGCAGAACAAAATGAGCTGGGCTTTGGAAGAATGGAAAGAAGGGCTGCCTA
CAAGAACTCTTCAGAAAATTCAAGAGCTTGAAGGACAGCTTGACAAACTGAAGAAGGAAAAGCAGCAAAG
GCAGTTTCAGCTTGACAGTCTCGAGGCTGCGCCGCAGAAGCAAACACAGAAGGTTGAAAATGAAAAAACC
GAGGGTACAAACCTGAAAAGGGAGAATCAAAGATTGATGGAAATATGTGAAAGTCTGGAGAAAACTAAGC
AGAAGATTTCTCATGAACTTCAAGTCAAGGAGTCACAAGTGAATTTCCAGGAAGGACAACTGAATTCAGG
CAAAAAACAAATAGAAAAACTGGAACAGGAACTTAAAAGGTGTAAATCTGAGCTTGAAAGAAGCCAACAA
GCTGCGCAGTCTGCAGATGTCTCTCTGAATCCATGCAATACACCACAAAAAATTTTTACAACTCCACTAA
CACCAAGTCAATATTATAGTGGTTCCAAGTATGAAGATCTAAAAGAAAATATAATAAAGAGGTTGAAGA
ACGAAAAGATTAGAGGCAGAGGTTAAAGCCTTGCAGGCTAAAAAAGCAAGCCAGACTCTTCCACAAGCC
ACCATGAATCACCGCGACATTGCCCGGCATCAGGCTTCATCATCTGTGTTCTCATGGCAGCAAGAGAAGA
CCCCAAGTCATCTTTCATCTAATTCTCAAAGAACTCCAATTAGGAGAGATTTCTCTGCATCTTACTTTTC
TGGGGAACTAGAGGTGACTCCAAGTCGATCAACTTTGCAAATAGGGAAAAGAGATGCTAATAGCAGTTTC
TTTGGCAATTCTAGCAGTCCTCATCTTTTGGATCAATTAAAAGCGCAGAATCAAGAGCTAAGAAACAAGA
TTAATGAGTTGGAACTACGCCTGCAAGGACATGAAAAAGAAATGAAAGGCCAAGTGAATAAGTTTCAAGA
ACTCCAACTCCAACTGGAGAAAGCAAAAGTGAATTAATTGAAAAAAGAGAAAGTTTTGAACAAATGTAGG
GATGAACTAGTGAGAACAACAGCACAATACGACCAGGCGTCAACCAAGTATACTGCATTGGAACAAAAAC
TGAAAAAATTGACGGAAGATTTGAGTTGTCAGCGACAAAATGCAGAAAGTGCCAGATGTTCTCTGGAACA
GAAAATTAAGGAAAAAGAAAAGGAGTTTCAAGAGGAGCTCTCCCGTCAACAGCGTTCTTTCCAAACACTG
GACCAGGAGTGCATCCAGATGAAGGCCAGACTCACCCAGGAGTTACAGCAAGCCAAGAATATGCACAACG
TCCTGCAGGCTGAACTGGATAAACTCACATCAGTAAAGCAACAGCTAGAAAACAATTTGGAAGAGTTTAA
GCAAAAGTTGTGCAGAGCTGAACAGGCGTTCCAGGCGAGTCAGATCAAGGAGAATGAGCTGAGGAGAAGC
ATGGAGGAAATGAAGAAGGAAAACAACCTCCTTAAGAGTCACTCTGAGCAAAAGGCCAGAGAAGTCTGCC
ACCTGGAGGCAGAACTCAAGAACATCAAACAGTGTTTAAATCAGAGCCAGAATTTTGCAGAAGAAATGAA
AGCGAAGAATACCTCTCAGGAAACCATGTTAAGAGATCTTCAAGAAAAAATAAATCAGCAAGAAAACTCC
TTGACTTTAGAAAAACTGAAGCTTGCTGTGGCTGATCTGGAAAAGCAGCGAGATTGTTCTCAAGACCTTT
TGAAGAAAAGAGAACATCACATTGAACAACTTAATGATAAGTTAAGCAAGACAGAGAAAGAGTCCAAAGC
CTTGCTGAGTGCTTTAGAGTTAAAAAAGAAAGAATATGAAGAATTGAAAGAAGAGAAAACTCTGTTTTCT
TGTTGGAAAAGTGAAAACGAAAAACTTTTAACTCAGATGGAATCAGAAAAGGAAAACTTGCAGAGTAAAA
TTAATCACTTGGAAACTTGTCTGAAGACACAGCAAATAAAAAGTCATGAATACAACGAGAGAGTAAGAAC FIGURE 416 cont'd

```
GCTGGAGATGGACAGAGAAAACCTAAGTGTCGAGATCAGAAACCTTCACAACGTGTTAGACAGTAAGTCA
GTGGAGGTAGAGACCCAGAAACTAGCTTATATGGAGCTACAGCAGAAAGCTGAGTTCTCAGATCAGAAAC
ATCAGAAGGAAATAGAAAATATGTGTTTGAAGACTTCTCAGCTTACTGGGCAAGTTGAAGATCTAGAACA
CAAGCTTCAGTTACTGTCAAATGAAATAATGGACAAAGACCGGTGTTACCAAGACTTGCATGCCGAATAT
GAGAGCCTCAGGGATCTGCTAAAATCCAAAGATGCTTCTCTGGTGACAAATGAAGATCATCAGAGAAGTC
TTTTGGCTTTTGATCAGCAGCCTGCCATGCATCATTCCTTTGCAAATATAATTGGAGAACAAGGAAGCAT
GCCTTCAGAGAGGAGTGAATGTCGTTTAGAAGCAGACCAAAGTCCGAAAAATTCTGCCATCCTACAAAAT
AGAGTTGATTCACTTGAATTTTCATTAGAGTCTCAAAAACAGATGAACTCAGACCTGCAAAAGCAGTGTG
AAGAGTTGGTGCAAATCAAAGGAGAAATAGAAGAAATCTCATGAAAGCAGAACAGATGCATCAAAGTTT
TGTGGCTGAAACAAGTCAGCGCATTAGTAAGTTACAGGAAGACACTTCTGCTCACCAGAATGTTGTTGCT
GAAACCTTAAGTGCCCTTGAGAACAAGGAAAAGAGCTGCAACTTTTAAATGATAAGGTAGAAACTGAGC
AGGCAGAGATTCAAGAATTAAAAAGAGCAACCATCTACTTGAAGACTCTCTAAAGGAGCTACAACTTTT
ATCCGAAACCCTAAGCTTGGAGAAGAAAGAAATGAGTTCCATCATTTCTTTAAATAAAAGGGAAATTGAA
GAGCTGACCCAAGAGAATGGGACTCTTAAGGAAATTAATGCATCCTTAAATCAAGAGAAGATGAACTTAA
TCCAGAAAAGTGAGAGTTTTGCAAACTATATAGATGAAAGGGAGAAAAGCATTTCAGAGTTATCTGATCA
GTACAAGCAAGAAAAACTTATTTTACTACAAAGATGTGAAGAAACCGGAAATGCATATGAGGATCTTAGT
CAAAAATACAAAGCAGCACAGGAAAAGAATTCTAAATTAGAATGCTTGCTAAATGAATGCACTAGTCTTT
GTGAAAATAGGAAAATGAGTTGGAACAGCTAAAGGAAGCATTTGCAAAGGAACACCAAGAATTCTTAAC
AAAATTAGCATTTGCTGAAGAAAGAAATCAGAATCTGATGCTAGAGTTGGAGACAGTGCAGCAAGCTCTG
AGATCTGAGATGACAGATAACCAAAACAATTCTAAGAGCGAGGCTGGTGGTTTAAAGCAAGAAATCATGA
CTTTAAAGGAAGAACAAAACAAAATGCAAAGGAAGTTAATGACTTATTACAAGAGAATGAACAGCTGAT
GAAGGTAATGAAGACTAAACATGAATGTCAAAATCTAGAATCAGAACCAATTAGGAACTCTGTGAAAGAA
AGAGAGAGTGAGAGAAATCAATGTAATTTTAAACCTCAGATGGATCTTGAAGTTAAAGAAATTTCTCTAG
ATAGTTATAATGCGCAGTTGGTGCAATTAGAAGCTATGCTAAGAAATAAGGAATTAAAACTTCAGGAAAG
TGAGAAGGAGAAGGAGTGCCTGCAGCATGAATTACAGACAATTAGAGGAGATCTTGAAACCAGCAATTTG
CAAGACATGCAGTCACAAGAAATTAGTGGCCTTAAAGACTGTGAAATAGATGCGGAAGAAAAGTATATTT
CAGGGCCTCATGAGTTGTCAACAAGTCAAAACGACAATGCACACCTTCAGTGCTCTCTGCAAACAACAAT
GAACAAGCTGAATGAGCTAGAGAAAATATGTGAAATACTGCAGGCTGAAAAGTATGAACTCGTAACTGAG
CTGAATGATTCAAGGTCAGAATGTATCACAGCAACTAGGAAAATGGCAGAAGAGGTAGGGAAACTACTAA
ATGAAGTTAAAATATTAAATGATGACAGTGGTCTTCTCCATGGTGAGTTAGTGGAAGACATACCAGGAGG
TGAATTTGGTGAACAACCAAATGAACAGCACCCTGTGTCTTTGGCTCCATTGGACGAGAGTAATTCCTAC
GAGCACTTGACATTGTCAGACAAAGAAGTTCAAATGCACTTTGCCGAATTGCAAGAGAAATTCTTATCTT
TACAAAGTGAACACAAAATTTTACATGATCAGCACTGTCAGATGAGCTCTAAAATGTCAGAGCTGCAGAC
CTATGTTGACTCATTAAAGGCCGAAAATTTGGTCTTGTCAACGAATCTGAGAAACTTTCAAGGTGACTTG
GTGAAGGAGATGCAGCTGGGCTTGGAGGAGGGCTCGTTCCATCCCTGTCATCCTCTTGTGTGCCTGACA
GCTCTAGTCTTAGCAGTTTGGGAGACTCCTCCTTTTACAGAGCTCTTTTAGAACAGACAGGAGATATGTC
TCTTTTGAGTAATTTAGAAGGGGCTGTTTCAGCAAACCAGTGCAGTGTAGATGAAGTATTTTGCAGCAGT
CTGCAGACCTATGTTGACTCATTAAAGGCCGAAAATTTGGTCTTGTCAACGAATCTGAGAAACTTTCAAG
GTGACTTGGTGAAGGAGATGCAGCTGGGCTTGGAGGAGGGGCTCGTTCCATCCCTGTCATCCTCTTGTGT
GCCTGACAGCTCTAGTCTTAGCAGTTTGGGAGACTCCTCCTTTTACAGAGCTCTTTTAGAACAGACAGGA
GATATGTCTCTTTTGAGTAATTTAGAAGGGGTTGTTTCAGCAAACCAGTGCAGTGTAGATGAAGTATTTT
GCAGCAGTCTGCAGGAGGAGAATCTGACCAGGAAAGAAACCCCTTCGGCCCCAGCGAAGGGTGTTGAAGA
GCTTGAGTCCCTCTGTGAGGTGTACCGGCAGTCCCTCGAGAAGCTAGAAGAGAAATGGAAAGTCAAGGG
ATTATGAAAATAAGGAAATTCAAGAGCTCGAGCAGTTATTAAGTTCTGAAAGGCAAGAGCTTGACTGCC
TTAGGAAGCAGTATTTGTCAGAAAATGAACAGTGGCAACAGAAGCTGACAAGCGTGACTCTGGAGATGGA
GTCCAAGTTGGCGGCAGAAAAGAAACAGACGGAACAACTGTCACTTGAGCTGGAAGTAGCACGACTCCAG
CTACAAGGTCTGGACTTAAGTTCTCGGTCTTTGCTTGGCATCGACACAGAAGATGCTATTCAAGGCCGAA
ATGAGAGCTGTGACATATCAAAAGAACATACTTCAGAAACTACAGAAAGAACACCAAAGCATGATGTTCA
TCAGATTTGTGATAAAGATGCTCAGCAGGACCTCAATCTAGACATTGAGAAAATAACTGAGACTGGTGCA
GTGAAACCCACAGGAGGAGTGCTCTGGGGAACAGTCCCCAGATACCAATTATGAGCCTCCAGGGGAAGATA
AAACCCAGGGCTCTTCAGAATGCATTTCTGAATTGTCATTTTCTGGTCCTAATGCTTTGGTACCTATGGA
TTTCCTGGGGAATCAGGAAGATATCCATAATCTTCAACTGCGGGTAAAAGAGACATCAAATGAGAATTTG
AGATTACTTCATGTGATAGAGGACCGTGACAGAAAAGTTGAAAGTTTGCTAAATGAAATGAAAGAATTAG
ACTCAAAACTCCATTTACAGGAGGTACAACTAATGACCAAAATTGAAGCATGCATAGAATTGGAAAAAAT
AGTTGGGGAACTTAAGAAAGAAAACTCAGATTTAAGTGAAAAATTGGAATATTTTCTTGTGATCACCAG
GAGTTACTCCAGAGAGTAGAAACTTCTGAAGGCCTCAATTCTGATTTAGAAATGCATGCAGATAAATCAT
CACGTGAAGATATTGGAGATAATGTGGCCAAGGTGAATGACAGCTGGAAGGAGAGATTTCTTGATGTGGA
AAATGAGCTGAGTAGGATCAGATCGGAGAAAGCTAGCATTGAGCATGAAGCCCTCTACCTGGAGGCTGAC
TTAGAGGTAGTTCAAACAGAGAAGCTATGTTTAGAAAAAGACAATGAAAATAAGCAGAAGGTTATTGTCT
GCCTTGAAGAAGAACTCTCAGTGGTCACAAGTGAGAGAAACCAGCTTCGTGGAGAATTAGATACTATGTC
AAAAAAAACCACGGCACTGGATCAGTTGTCTGAAAAAATGAAGGAGAAAACACAAGAGCTTGAGTCTCAT
```

FIGURE 416 cont'd

```
CAAAGTGAGTGTCTCCATTGCATTCAGGTGGCAGAGGCAGAGGTGAAGGAAAAGACGGAACTCCTTCAGA
CTTTGTCCTCTGATGTGAGTGAGCTGTTAAAAGACAAAACTCATCTCCAGGAAAAGCTGCAGAGTTTGGA
AAAGGACTCACAGGCACTGTCTTTGACAAAATGTGAGCTGGAAAACCAAATTGCACAACTGAATAAGAG
AAAGAATTGCTTGTCAAGGAATCTGAAAGCCTGCAGGCCAGACTGAGTGAATCAGATTATGAAAAGCTGA
ATGTCTCCAAGGCCTTGGAGGCCGCACTGGTGGAGAAAGGTGAGTTCGCATTGAGGCTGAGCTCAACACA
GGAGGAAGTGCATCAGCTGAGAAGAGGCATCGAGAAACTGAGAGTTCGCATTGAGGCCGATGAAAAGAAG
CAGCTGCACATCGCAGAGAAACTGAAAGAACGCGAGCGGGAGAATGATTCACTTAAGGATAAGTTGAGA
ACCTTGAAAGGGAATTGCAGATGTCAGAAGAAAACCAGGAGCTAGTGATTCTTGATGCCGAGAATTCCAA
AGCAGAAGTAGAGACTCTAAAAACACAAATAGAAGAGATGGCCAGAAGCCTGAAAGTTTTTGAATTAGAC
CTTGTCACGTTAAGGTCTGAAAAAGAAAATCTGACAAAACAAATACAAGAAAAACAAGGTCAGTTGTCAG
AACTAGACAAGTTACTCTCTTCATTTAAAAGTCTGTTAGAAGAAAAGGAGCAAGCAGAGATACAGATCAA
AGAAGAATCTAAAACTGCAGTGGAGATGCTTCAGAATCAGTTAAAGGAGCTAAATGAGGCAGTAGCAGCC
TTGTGTGGTGACCAAGAAATTATGAAGGCCACAGAACAGAGTCTAGACCCACCAATAGAGGAAGAGCATC
AGCTGAGAAATAGCATTGAAAAGCTGAGAGCCCGCCTAGAAGCTGATGAAAAGAAGCAGCTCTGTGTCTT
ACAACAACTGAAGGAAAGTGAGCATCATGCAGATTTACTTAAGGGTAGAGTGGAGAACCTTGAAAGAGAG
CTAGAGATAGCCAGGACAAACCAAGAGCATGCAGCTCTTGAGGCAGAGAATTCCAAAGGAGAGGTAGAGA
CCCTAAAAGCAAAAATAGAAGGGATGACCCAAAGTCTGAGAGGTCTGGAATTAGATGTTGTTACTATAAG
GTCAGAAAAAGAAGATCTGACAAATGAATTACAAAAAGAGCAAGAGCGAATATCTGAATTAGAAATAATA
AATTCATCATTTGAAAATATTTTGCAAGAAAAGAGCAAGAGAAAGTACAGATGAAAGAAAAATCAAGCA
CTGCCATGGAGATGCTTCAAACACAATTAAAAGAGCTCAATGAGAGAGTGGCAGCCCTGCATAATGACCA
AGAAGCCTGTAAGGCCAAAGAGCAGAATCTTAGTAGTCAAGTAGAGTGTCTTGAACTTGAGAAGGCTCAG
TTGCTACAAGGCCTTGATGAGGCCAAAAATAATTATATTGTTTTGCAATCTTCAGTGAATGGCCTCATTC
AAGAAGTAGAAGATGGCAAGCAGAAACTGGAGAAGAAGGATGAAGAAATCAGTAGACTGAAAAATCAAAT
TCAAGACCAAGAGCAGCTTGTCTCTAAACTGTCCCAGGTGGAAGGAGAGCACCAACTTTGGAAGGAGCAA
AACTTAGAACTGAGAAATCTGACAGTGGAATTGGAGCAGAAGATCCAAGTGCTACAATCCAAAAATGCCT
CTTTGCAGGACACATTAGAAGTGCTGCAGAGTTCTTACAAGAATCTAGAGAATGAGCTTGAATTGACAAA
AATGGACAAAATGTCCTTTGTTGAAAAAGTAAACAAAATGACTGCAAAGGAAACTGAGCTGCAGAGGGAA
ATGCATGAGATGGCACAGAAAACAGCAGAGCTGCAAGAAGAACTCAGTGGAGAGAAAAATAGGCTAGCTG
GAGAGTTGCAGTTACTGTTGGAAGAAATAAAGAGCAGCAAAGATCAATTGAAGGAGCTCACACTAGAAAA
TAGTGAATTGAAGAAGAGCCTAGATTGCATGCACAAAGACCAGGTGGAAAAGGAAGGGAAAGTGAGAGAG
GAAATAGCTGAATATCAGCTACGGCTTCATGAAGCTGAAAAGAAACACCAGGCTTTGCTTTTGGACACAA
ACAAACAGTATGAAGTAGAAATCCAGACATACCGAGAGAAATTGACTTCTAAAGAAGAATGTCTCAGTTC
ACAGAAGCTGGAGATAGACCTTTTAAAGTCTAGTAAAGAAGAGCTCAATAATTCATTGAAAGCTACTACT
CAGATTTTGGAAGAATTGAAGAAAACCAAGATGGACAATCTAAAATATGTAAATCAGTTGAAGAAGGAAA
ATGAACGTGCCCAGGGGAAAATGAAGTTGTTGATCAAATCCTGTAAACAGCTGGAAGAGGAAAAGGAGAT
ACTGCAGAAAGAACTCTCTCAACTTCAAGCTGCACAGGAGAAGCAGAAAACAGGTACTGTTATGGATACC
AAGGTCGATGAATTAACAACTGAGATCAAAGAACTGAAAGAAACTCTTGAAGAAAAACCAAGGAGGCAG
ATGAATACTTGGATAAGTACTGTTCCTTGCTTATAAGCCATGAAAAGTTAGAGAAAGCTAAAGAGATCTT
AGAGACACAAGTGGCCCATCTGTGTTCACAGCAATCTAAACAAGATTCCCGAGGGTCTCCTTTGCTAGGT
CCAGTTGTTCCAGGACCATCTCCAATCCCTTCTGTTACTGAAAAGAGGTTATCATCTGGCCAAAATAAAG
CTTCAGGCAAGAGGCAAAGATCCAGTGGAATATGGGAGAATGGTGGAGGACCAACACCTGCTACCCCAGA
GAGCTTTTCTAAAAAAAGCAAGAAAGCAGTCATGAGTGGTATTCACCCTGCAGAAGACACGGAAGGTACT
GAGTTTGAGCCAGAGGGACTTCCAGAAGTTGTAAAGAAAGGGTTTGCTGACATCCCGACAGGAAAGACTA
GCCCATATATCCTGCGAAGAACAACCATGGCAACTCGGACCCAGCCCCCGCCTGGCTGCACAGAAGTTAGC
GCTATCCCCACTGAGTCTCGGCAAAGAAATCTTGCAGAGTCCTCCAAACCAACAGCTGGTGGCAGCAGA
TCACAAAAGGTCAAAGTTGCTCAGCGGAGCCCAGTAGATTCAGGCACCATCCTCCGAGAACCCACCACGA
AATCCGTCCCAGTCAATAATCTTCCTGAGAGAAGTCCGACTGACAGCCCCAGAGAGGGCCTGAGGGTCAA
GCGAGGCCGACTTGTCCCCAGCCCCAAAGCTGGACTGGAGTCCAAGGGCAGTGAGAACTGTAAGGTCCAG
TGAAGGCACTTTGTGTGTCAGTACCCCTGGGAGGTGCCAGTCATTGAATAGATAAGGCTGTGCCTACAGG
ACTTCTCTTTAGTCAGGGCATGCTTTATTAGTGAGGAGAAAACAATTCCTTAGAAGTCTTAAATATATTG
TACTCTTTAGATCTCCCATGTGTAGGTATTGAAAAAGTTTGGAAGCACTGATCACCTGTTAGCATTGCCA
TTCCTCTACTGCAATGTAAATAGTATAAAGCTATGTATATAAAGCTTTTTGGTAATATGTTACAATTAAA
ATGACAAGCACTATAT
```

FIGURE 417

SEQ ID NO: 409

Genbank ID : AI002715
Unigene ID(#167) : Hs.348522
Unigene name : potassium voltage-gated channel, Isk-related family, member 4 KCNE4

FIGURE 417 cont'd

>gi|3203129|gb|AI002715.1|AI002715 an20d12.s1 Gessler Wilms tumor Homo sapiens
cDNA clone IMAGE:1699223 3', mRNA sequence
TCATGACTTCCCAGGAGGGAAAAATGTGTTTATTTATTTAAATTAAAAAATATTGTGAAAATTACAAAG
TGTTAAATACAAAAGACAATTCTATACAACTCAACAGAATAAGAAGGAAGTATATACATCACTTTTTAAT
AGGTGCAGAGAGACTTGCACCAAACTTCAGGATTAAGCAATGGAAAATGTGACAAGGCACATGTCCGTCG
CAGTGAAATTTCAGAATTCAAGTGATTCCAGGCAAGAGNGCAAACTTAACTTGGCTTCTTTCAACTTAAA
CAGCCCCCTTTGGCATAAGTCCACACTGAATTTTAAAGTGAACAGAGGGCCTTTTTCCCCAAACATAAAT
TTCCTTTAGCTGTATGTCAAAGCGGACTGATAAACCAGCTCCTACACTGTTAACCCTTCCATGGCAACAG
TAGTTATTGCTGTGTCTCCAATCCATGCA

FIGURE 418
SEQ ID NO: 410
Genbank ID      : AF206665.1
Unigene ID(#167) : Hs.405479
Unigene name    :       tryptase beta 2    TPSB2
>gi|11493897|gb|AF206665.1| Homo sapiens mast cell alpha II tryptase mRNA, comp
lete cds, alternatively spliced
AGTGGCCAGGATGCTGAGCCTGCTGCTGCTGGCGCTGCCCGTCCTGGCGAGCCCGGCCTACGCGGCCCCT
GCCCCAGTCCAGGCCCTGCAGCAAGCGGGTATCGTCGGGGTCAGGAGGCCCCAGGAGCAAGTGGCCCT
GGCAGGTGAGCCTGAGAGTCCGCGACCGATACTGGATGCACTTCTGTGGGGCTCCCTCATCCACCCCA
GTGGGTGCTGACCGCGGCGCACTGCCTGGGACCGGACGTCAAGGATCTGGCCACCCTCAGGGTGCAACTG
CGGGAGCAGCACCTCTACTACCAGGACCAGCTGCTGCCGGTCAGCAGGATCATCGTGCACCCACAGTTCT
ACATCATCCAGACTGGAGCGGATATCGCCCTGCTGGAGCTGGAGGAGCCCGTGAACATCTCCAGCCGCGT
CCACACGGTCATGCTGCCCCCTGCCTCGGAGACCTTCCCCCCGGGGATGCCGTGCTGGGTCACTGGCTGG
GGCGATGTGGACAATGATGAGCCCCTCCCACCGCCATTTCCCCTGAAGCAGGTGAAGGTCCCCATAATGG
AAAACCACATTTGTGACGCAAAATACCACCTTGGCGCTACACGGGAGACGACGTCCGCATCATCCGTGA
CGACATGCTGTGTGCCGGGAACACCCGGAGGGACTCATGCCAGGGCGACTCTGGAGGGCCCCTGGTGTGC
AAGGTGAATGGCACCTGGCTACAGGCGGGCGTGGTCAGCTGGGACGAGGGCTGTGCCCAGCCCAACCGGC
CTGGCATCTACACCCGTGTCACCTACTACTTGGACTGGATCCACCACTATGTCCCCAAAAAGCCGTGAGT
CAGGCCTGGGGTGTCCACCTGGGTCACTGGAGAGCCAGCCCCTC

FIGURE 419
SEQ ID NO: 411
Genbank ID      : AU155297
Unigene ID(#167) : Hs.287562
Unigene name    :        CDNA FLJ13313 fis, clone OVARC1001489.
>gi|11016818|gb|AU155297.1|AU155297 AU155297 OVARC1 Homo sapiens cDNA clone OVA
RC1001489 3', mRNA sequence
GAAATTAACAAACTAATTTTAAAAATCAACACCTGACTGGGGACCTGGTCATACAAACTTCCTTTAGATA
CAGTTGAGAAGAAAACATCACATTTTTATGAAGCCCCTCTCCTGACAGGGGACTGGAGGAGGAACACCAT
TATGCATTGTTATCAGCGTGGTGGTGTAATTTGACTGTTGACAAAGTATCCGTGGCAGTGCGAATGAGCGCAG
TTAGAAGTGTGGCGGATTGTAATCAAGAAGATGCTTAGCTGTGCAACACTGCATCTCGAGCAGATTTGAA
TCAACATTGCCTTAAGGGGACACACACACATACCAAAAGAAAAAAAATCCATTAATTTTTAGAGGGAAAA
TTAGAGTGGCACTTGATGAAGTGAAATTTGACATGCGTTAATTGGTGTGCAGCTCTCCTAATTAGAGATT
TTCAAATTCTTTTACTGNTGNCACCATGAATGGCACATTGCNTTGCTGGACAAATNCTAAAATTGCAAAT
TGGCTTGGTCCGGAAGTTTTACGTTTGAAGATACCCTGGATCCTTAAGCCATTCCAAAGGNGGGCCANTG
GAAANCAANATACTT

FIGURE 420
SEQ ID NO: 412
Genbank ID      : AU147218
Unigene ID(#167) : Hs.297369
Unigene name    :        CDNA FLJ12111 fis, clone MAMMA1000025.

FIGURE 420 cont'd

>gi|11008739|gb|AU147218.1|AU147218 AU147218 MAMMA1 Homo sapiens cDNA clone MAM
MA1000025 3', mRNA sequence
GAGACACGAGTCTCGCTCTGNCATCCAGGCTGGAGTGCAATGGTGTGATCTCGGCTCACTGCAACCCCCG
CCTCCTGGGTTCAAGCGATTCTCCTGCCTCAGCCTCCTGAGTAGCTGGGATTACAGGTGCACGCCACCAC
GCCCAGCTAATTTTTGAATTTTTAGTAAAGATGGGATTTCACCATATTGATCATGCTGGTCTTGAACTCC
TGACCTTGTGATCCGCCCGCCTTGGCCTCCCAAAGTGCTGGGATTACAGGCATGAGCTACCGAGCCCAGC
CCTAAAAGACTTCTTTATAAGGAGCCATATTGCTTTGGGGAGACCGAAGGCTGCTGAGGGCCTCAGGGCA
GGGTTGATATGCACCTGCCAGCACGCCACCATAACATCTTCATGGAACCTTAACACTTTCTTAAAAGTGC
TCCACCTNCTTTTTTTTGACCCTTAAAGAAGAGACCAACTNTTAGTACTGNGTGGCAACTGNGCCTGNCC
TTTTACATGGGCAGGGGACTGGGTGACACATTNCCCCAAANGGNC

FIGURE 421
SEQ ID NO: 413
Genbank ID        : AA143060
Unigene ID(#167)  : Hs.454758
Unigene name      :       melanoma associated antigen (mutated) 1    MUM1
>gi|1712448|gb|AA143060.1|AA143060 zl49g03.s1 Soares_pregnant_uterus_NbHPU Homo
 sapiens  cDNA  clone  IMAGE:505300  3'  similar  to  contains  element  MER4 repetitive
 element ;, mRNA sequence
CCTTTTAAGACAGAAAAGGTTGGCTGGATTTAAAAGCAAAAATGAATTCAAATTGTGACTTTTATGAAGC
AAATCCTACTTTCAACTGCACAAATCACTCCTTTGTTAGATTTTCAGAGTAGATGGTAATGTCACTAAAA
GCTGTTTACAGCCCAGCAGGTGTGTTTGGTTTAAAAGGATGTGCTTTCCTTTTAAACTCGAGTATTCAA
TTACCTTCCCAGCCGCAGGAAAGTGTGAGCTAGGGACCAAGCGAGCTTCAGAGGCAGCTCTGAAGATGCA
GGCAGGAGGGAGTGGGGCAGGGGAGCTCCACAAGGAAGAGCAACAGGGGAGCCAATGCCTTGGACTACG
CGGGATCAGTCTCCTTGCTCTCTTCAGAACTGGGATTCTCACGACAGATGCACCCTCGCCAATCACGCA
GGACTGACCGGGGCGTCGAATCGCCGTCATTCTAGATGATCTACACCTTCCCGGTGCCAGACGCGCCCTC
GCCACAATCACGCAGGACTGACTGGGGCGTCGAATTGCTGTCANTCTAGACATCTACACCTTTNCCAGTG
CCAGACACTCACGGAGCAGACATGTGCCGCNGGTCATAGTTANTGCCTTTGACGTTA

FIGURE 422
SEQ ID NO: 414
Genbank ID        : BF508344
Unigene ID(#167)  : Hs.112742
Unigene name      :     CDNA   clone  IMAGE:6301163,  containing  frame-shift errors
>gi|11591642|gb|BF508344.1|BF508344 UI-H-BI4-aqb-d-08-0-UI.s1 NCI_CGAP_Sub8 Hom
o sapiens cDNA clone IMAGE:3089319 3', mRNA sequence
TTTTTTTTTTTTTTTTTAACAATTATGCATAAAAGAATTTTATTTAGTGGCCAGATCCCAATGAATAATG
TCAGTCATTGCTTGGTTCTGCTAAAATGTGGTATTAGATATATTCTTAAGAAAGTGTACAATTGCATCAC
CAAAAGCTGTTTAATTTGGATTGTGTAGAATAAAAGAAAACTACATAAGTCTTTGTTCTTTGATAAAAAT
TTTAAAATATAAAAATGAAAAAAAGAAACCCAAAAGCAGTATTCAAAACTAACAAATGTCACCTTGGACT
ATTTACAGTAAGACGCCTTTTTGACAGGAGAATCTTGTTCTCAGCTTGTTCTTTTCCTCACATTTTACTT
ACAGGGATTCTCACTCCCCATCTGATCCCTATTCATAACTTCTTCCATTCCTGTCTCACATGAAACAGC
CATCTTCCATGCTCTCTCACTCATCTTTGAGTCTCTCTCTGACACTCCTTTTTCCTACTCTTAAATTAT

FIGURE 423
SEQ ID NO: 415
Genbank ID        : AI054381
Unigene ID(#167)  : Hs.293379
Unigene name      :       Transcribed sequences
>gi|3322168|gb|AI054381.1|AI054381 qi64d09.x1 NCI_CGAP_Ov26 Homo sapiens cDNA c

FIGURE 423 cont'd lone IMAGE:1861265 3' similar to contains element TAR1 MER22 repetitive element
;, mRNA sequence
TTTTTTTTTTTTTAAACTGGAAGAGGATGCACAGGGGAAGAAATTGAAAAAAAAATTTTGTTGGCTTTT
GTTTACCTGGCGTGTGTGGCAGCCGGCTCGCTCCCTCTCTCTGCTTGCTATCCCTGACCTTTCTTTCTTT
TTGCTCCTTTTCAAAAAAAATATTAATTTCCCCCTTCTGTCGTCTTCTCGCAGCCGTATANGTAGATAGT
AGGGCCGGGCCCCCGGGNCCCTTTTCCCCTTTTNAAAAGGAGAAAAGGGAGGGGGAAAATTTTTTCCCC
CCCCCCCAAAAAAAAAGGGGGGGCCCCCCCTTTTTTTTTTTAAAAAAACCCCCCGGGGGTTTTTTTAA
AAAAACCCCCCGGCCCCGCCC

FIGURE 424
SEQ ID NO: 416
Genbank ID      : NM_021992.1
Unigene ID(#167) : Hs.56145
Unigene name    :    thymosin, beta, identified in neuroblastoma cells
      TMSNB
>gi|11496272|ref|NM_021992.1| Homo sapiens thymosin, beta, identified in neurob
lastoma cells (TMSNB), mRNA
CGCGGGAACGCTAACCTGGTCCGGAGCGAGTCTGGGTCTCAGCCCCGCGAACAGCCTTTCACGAGTCTTC
AAGCTTTCAGGCTATCTTCTAGTCAAGATGAGTGATAAGCCAGACTTGTCGGAAGTGGAGAAGTTTGACA
GGTCAAAACTGAAGAAAACTAATACTGAAGAAAAAAATACTCTTCCCTCAAAGGAAACTATCCAGCAAGA
GAAAGAGTGTGTTCAAACATCATAAAATGGGGATCGCCTCCCAACAGCAGATTTCGACATTACCTGAGAG
TCTTGATTTTAGGCTTGTTTTTTGTAAACCCATGTGTTTGTAGAGATTTTAGGCGTCTTCGGATATCTTC
TCACCTATGTTCCCTGGCTAAGAAGTCAGAGGTAGCCAATGTTTCCTTAAATTCATTTTTAAACTTACCA
TTGGTGCATATGTTCCAGATGGCAGATGCTGTCAATAATCTCACCATTGATGACCTTTGTGTATGTAGTT
CTTGCATCCTATACTGGATAAGCCTGTTTTAACCTGCTATGATGGGTGCTTCCATTGCTTCATAATCTTC
ATGAAGTTGCATGCTTTTGCAGCTTTTCACAGTTTATTTGCATTTCTAATGTAGTAATAAAGTAACCAAT
ATAATCATT

FIGURE 425
SEQ ID NO: 417
Genbank ID      : AA535361
Unigene ID(#167) : Hs.343666
Unigene name    :    phosphoinositol    3-phosphate-binding    protein-3
      PEPP3
>gi|2279614|gb|AA535361.1|AA535361 nf94f07.s1 NCI_CGAP_Co3 Homo sapiens cDNA cl
one IMAGE:927589 3', mRNA sequence
TTACAAACCATTCATTTATTTCCTGTATTGGGTTTATACAAACTTGCAAGATACAAATGCAGAACTCAC
TGGGATTCTTCAGTACCTAAATCTAAAAGAATGCTGCTGAAAGGGGGAAGCAAACTCTCACCTGTTTCA
GTCAGGCCATCCCTCCTCCTGGGGAGGGGGCTCATTGGCTAGAAAGATGCTAAGGGGATGCTACAGCTGT
TTGTCCCCTGACAGAGATTCCATCTATCTAACCTTCACCCTTCTTCTAAGGCCACTTTTATGCTAAATAA
AGACACTGAGATAATAAATTTCCTTGTACAGTTTATTGTCTAATACTAGCAAATCAAATTGGCCCCAATA
TGTGCATAAATAGATATACGTGTGTGTGTGCGTTTGTTTGTATATATATATATTTATATAAAGGGTGTGG
AAAACCAGAGGGGTTTTTTATTTTTAAAGCTTCCACGATAAGGGGCCACAAGGGGAATATGAATGGTTCC
CCCTGGCGGAAACAGCTGGGTTTTTT

FIGURE 426
SEQ ID NO: 418
Genbank ID      : AL157452.1
Unigene ID(#167) : Hs.349088
Unigene name    :    solute  carrier  family  1  (glial  high  affinity
glutamate transporter), member 2    SLC1A2

FIGURE 426 cont'd

>gi|7018467|emb|AL157452.1|HSM802435 Homo sapiens mRNA; cDNA DKFZp761C1712
(fro
m clone DKFZp761C1712)
GAGAACATCCATCTACAGTCCTCCTTTGCTTGGTGGATTGGGCTCAGAGGAACAAAAAGTTAGTCTGACT
CTGTGCATATTAGCATCATGTCTTTAGAGAAAGGTCAGCCTCTCTGGTTGCCAAATACTCATCATGATGC
TCATGACTTAAAGGTTCTGAGGAGCCTTGTCTCCCTTGGATTTTTGAGTCAGGGTACAGGAAAAAACATT
GCTGACTAACTAACTGCAAATGCATCTGCAGGTGAAACCCTACGAAAGCACAGTTCTGGCTATAAACTTC
AGAGTTCTCTGTAAAAAACTTAGAGCACTAGAAGCACAGGAATAGTGAGTGTACAGCTTATGCGGTTGTA
GAGGGGCAACTGATGAACACAGGTCCCACATATATGAGGGAGTATGACGTTCTCTACCTAATATGTTCTG
TGTGCATGTTTTGAATGATTGAAGATGGGATTAACTAATGCAAGTTTACAGTTGCCTCCTAAAACACACA
TTCTGTATAATTATCGCTAAATACAATGCTGTGAGGTCTGTAGTTCCTGTAACCCCTTTCTCCTCCCCAA
GGACAGAGAAGAACTAGCCATGTGCTATAGGGAACCCTGAGTGCCCTACTCTTTTCCCAAGAAGGGTAAA
GCCTACAATATCATCAGGGGGCATGAAGCACATTAATTTGCAGTGGCTGCTTCATATGAGGAGGTATGGT
GGACAGGCTAATTTTTCCTTGAAAATGTGGCTTCTTCAACTCCTTTCAAATTTAGGATGGAATACTTCCT
GAAATAAACTGGGCTTTATGCAGGATTCTCTTTGAAAATTCTTGTATGTCCAGAACAAAAGATAAAACT
AATTGTATTCCTCACATTCACAATCCCCATTGGTCTGAAGTCACGTAGCACAGAGCATCTATAGCACATA
GTGTTTAAAGACTAATGAATGCAAAAAGATAAAATCTTCAACTAATTTTTGAATTGTTTCTCATATATGC
TACTAGAAAATGCCTTGTTGATGAAGCACATTTTGGGTAGTTGAGGTCTTTTGTTTTCGCCTTTAGCTTT
CTAAGCTTTCTTACAATGTGGACTGATTACTGTAACATTTCACGTGTAAAATAACTGGATATTCTTTATA
TACTGGAAATAACCTGTGAATCCAATATTTCACTAAGTGTTTTAACTTTTGTGTATATATCTCTCATCAA
TAAATGTGGATTTCAAAAAAAAAAAAAAAA

FIGURE 427
SEQ ID NO: 419
Genbank ID       : BF110735
Unigene ID(#167) : acc_BF110735
Unigene name     :
>gi|10940425|gb|BF110735.1|BF110735 7n56b03.x1 NCI_CGAP_Lu24 Homo sapiens
cDNA
clone IMAGE:3568468 3', mRNA sequence
TTTTCTTACCTTCCTATTTTTATTAACCCGGGTCTTCTGCGCCCAAAGACTCAGCCTCATTCAGGACCAT
ATTATGTTCATACTTCTGCTGCGTCCAAGGAGTGTTGACGAAAAAGTGGGGCCTTGGAGGGGTAGAGGCC
AAGGGACAGTTTCCCCTCTGCCCTTTGAAGTTCACGATCTTCCATGCAACAAAATTGTTTTCTGTGAAAA
GCAGGAAATGAATAACAACAGCGTAGGTGCGTTGGCTATGTCCGGTGGCATTTCTTCAGAATTTTCATTA
ATGACACCTGATTNTGGAGGCATTGTATATTTTAAATACATCCAGATGTTGTTTCAGTTGCTTCCTCTT
TGGTTCTTTTTGCTTTTCGTTGTTGAGCGTCACTTAAATTCGTGTCATTTCATGTTGGTACAGGTACTCC
ACTTCAAATTTCCCAAGAAATTCAGAAGAATTGTGAACAAGTTGCTGGTTTCACAATACTGCAAGACACT
GCAAGTTATTCCAAGTTCCTCAGCAAGTGTTTACACATTGNGCCAAGGACAGATNTTTCCT

FIGURE 428
SEQ ID NO: 420
Genbank ID       : AW592266
Unigene ID(#167) : Hs.300592
Unigene name     :    v-myb    myeloblastosis    viral    oncogene    homolog
(avian)-like 1    MYBL1
>gi|7279443|gb|AW592266.1|AW592266 hf48e04.x1 Soares_NFL_T_GBC_S1 Homo
sapiens
cDNA clone IMAGE:2935134 3', mRNA sequence
TTTTTTTTCAGCTTGTACACAGATGCTTTATTTTGGATGTTAATATGTCAACATTGTATGCAAGATTCTC
TTACAATGAAGTTTTCCATATATCACAAAACTCAATTTAGTCAGGGTAATTGCTGTATTAATGTGAAAAC
CTTACAATAAAATGCAGTATTATGTATGTGTAGTCAGTTTCCATGCAAGTATGGCTGCTACATGTTATGT
CTGGCATTTGTATAACATACTGAAAGAAACTCAGAGGAACAAAACAGTTTAAAGGTGACTTAAGATGCCT
GACATGTTTAAGATAAAAAATCTTGCAAAAAGCAACAAAGCAGTTAACTGAAGGATTCAACCAGTACCAA
CCCAAATATGTATTATGTCCAATAAGCCCAGACTTATCCACAATATATTACCATTTAGGATAATTTAATG
CTCAAGAAAAAATATGCTTTAAAAAAT

FIGURE 429
SEQ ID NO: 421
Genbank ID        : AF305836.1
Unigene ID(#167)  : Hs.406958
Unigene name      :    deiodinase, iodothyronine, type III opposite strand
    DIO3OS
>gi|10799171|gb|AF305836.1|AF305836 Homo sapiens uterine-derived 14 kDa protein
 mRNA, complete cds
CTCACGGGAACGTCGAGACTGGAGCGCCCGAACTGAGCCACCTTCGCGGACCCCGAGAGCGGCGGCGCGA
CTCACCGCGGAGGCGCCCGGACGCGTCAATGTCCCCCAGGGCAAGGCCTGAACCAGGTCGCGAGGGTCTG
TCTCCCGTCTGGGGAGCTGAACTGCCCGAGACACTGTCGCAGTCGCGGGGACTTGTCTGGAGCGGCGGGG
TCTGAGCCCAAGTCGGAAGCCGCCGCCGCCGCCAGCGTCCCGTGCGCCTGCCGCCCCGGGACCAGCCGCG
AAACTTCTTCTCGGGACGGAGACAGCGCTCGCCGCCCGGGCCGAGGCCCAGCCCAATAAGAAGCACCTGA
TCCACACTCTTTCTAGCCCCAGGGATGCTCAGGAAAGCAGCCTTTCTTTAGGGCTGTCATCTGTTCTGGG
GATCTGTTGCTGTTTCTTGGGCCCACAGAATACACTCCACACCTCGGGACTCCATAATATTGGACAAGGC
TGGAAGGCCCATTTGGCTCCTGCAGCCTCTTATGCAGGAGGACCTCCTGAGGCTTCGGGCAGGAGCTGGT
GCACACCTGGAGGAGAGTGCTGGTGAATGGCAGGTGTGTGCCTCAGTGTCCTTGCTGCCAGGGTGTCAGC
CCTGCTTCACCACTGGCCGTTTGTCTCTGTCCCCTCCACTGGCCTCTTGAAAGCACAGAAGACCCCTCCG
GGGTACTTTCCTTTCCTTTGGGCTTCCCACTCATGCTATTCCCTGCTCCCTTTTTCTACCTGGAGACCCC
CATTCCTCCTCCTCCTTTGCTGCCCTCACCTCCACCTGGGCCCTCCCAGCTCCGGGAGATGGCTGAACC
CCACTCCCCACCCGCTAGTCATCCTCTTCAGCGGTCCTCCCAAGCTGTCCTCAGCATGGCAGCCTCCACA
GCCCCTGGGTGTCACCCCCGGTTTCGTGTTGCCTCGGACTCCAGACCTGCCCCTCCCAGGCTGGCCCAGA
TGGATCCTCTACAGTGACTAACCCAAACCAGCACCAGGCAGGGACCCAATAAACCTTTGTGAATGGAGTA
AAAAAAAAAAAAAAAAAAAAAAAAAAAAAAA

FIGURE 430
SEQ ID NO: 422
Genbank ID        : BF594828
Unigene ID(#167)  : Hs.91145
Unigene name      :    Transcribed sequences
>gi|11687152|gb|BF594828.1|BF594828 7o49a02.x1 NCI_CGAP_Kid11 Homo sapiens cDNA
 clone IMAGE:3577250 3', mRNA sequence
CATAACTTCATTGTCAATTTTTATTTTTTCTGTGAAACACATTGCTTATATCCCTTATTCATTTTTTAGT
TGGATTGTCACTTTTTTCTAATTCATAGAAATTATTTGTTGATTCATTCCTAAAAGTGTGTATAGTTTTA
CAGATTTTATTAAGGGCCTTCATTCTTAGTTATGTAGCAAATATTTTCCCCGATTCATTTCATGTCTTTT
TTTATGTGATGAAATACACATAACATAAAAATTACCATTTTCATCATTTTAAGTGTACAGTTCAGTAACA
TTAAGTACATTAATACTGATGTGTAACCACCACTCATCGCCAAAACATCTTCCTCTTCCTAACCTTCATT
GTATGTCTTTAAATTCATTCTTTGTGTCTTATATTATACAAAAGTTTTACATTTTTATCTATTCTAATTT
ATTAACCTTTTCCTTTATGACTTCTGGCTT

FIGURE 431
SEQ ID NO: 423
Genbank ID        : AA938184
Unigene ID(#167)  : Hs.44380
Unigene name      :    Transcribed sequence with weak  similarity to
protein sp:P39191  (H.sapiens)  ALU4_HUMAN Alu subfamily  SB2 sequence
contamination warning entry
>gi|3096295|gb|AA938184.1|AA938184 oc10d11.s1 NCI_CGAP_GCB1 Homo sapiens cDNA c
lone IMAGE:1340469 3', mRNA sequence
TTTTTTTTTTCCATTTCACAGCTATTCCAATATAAACTTTTATCAGTCACATTGAACAAAATAACTAGAA
ATATTTCATACATTTAAAAAAAGAATAAGAAATTATTTACAAGTTAAGCCGCAAACAATTCACCAAAAAC
TGAGTAATTAAGGTTACTTAACAAACAATTCTTCTGATTAGTTGGAAAATTGTTTCATTACTGTTCACAA
ATTCATACCTGATTTACTCTGTAGACAATATAGATTAGGCATAGGATAAAATCCTCTGTATTTGGTTCCT
CCCAATCATTGGTCAAAGTCATCTGACAACAGACTATCTGAGGAAAGTGTAAATACAAAGTCACCCAATA
AAACATGAATAAGTTTTGCAAAGCACAGTAAAGGAAAACCAGTTTGTTCTGAACACTTTATTGCTAAAAG FIGURE 431 cont'd GATGTAAAGGGTAAGAGGAAAAAGGTGACGAAACACTCCTTTTGATATGCTTGTTGGGGAGTCAGGATGA
ACTTCCTTGGCTAGGGATAGAAGGAAGAGATCA

FIGURE 432
SEQ ID NO: 424
Genbank ID      : BF511276
Unigene ID(#167) : Hs.197081
Unigene name    :     A     kinase    (PRKA)    anchor    protein    (gravin)   12
    AKAP12
>gi|11594574|gb|BF511276.1|BF511276 UI-H-BI4-aoj-d-05-0-UI.s1 NCI_CGAP_Sub8 Hom
o sapiens cDNA clone IMAGE:3085089 3', mRNA sequence
TTTTTTTTTTTTTTTTGGCATTTAATTAGATTGCATTTTATTTAGATAAATGAAAATTTGCCCCAAACA
GAACTAGGAATCAAATATTGTCTTGGACTAGAGGTAATTGCTAAGCTGGAAGCTTATATTGAAAACTAAA
ATTTCCAGCCCTTGACTATCTGTAGTTCCAAACATCAAAGGAAAATATTGGAACAATTTATCTATGTACA
GAGAGAGGCAACTCATGGGTACCATAAGCAAAATAACCTGAGGGGGAACATTTGATATTACAAGAAGTGG
TGAGAGTTTACAAGTCTTGCATTGCTTTCTATTGTACATGGCTCTGTAGTAATGCCAAAAATAACAAAAT
GTAGGCACTTGCTCTGACTTCTGCAGTTTACATTAGATTATTATGTACTTCATAAATTAACAGCAGCTTT
AGAATTATAAAACAGTATTATATTTCATGCTACTGTTGGTGTTCTTCTTGTTAAAATAATGTTCTCAACG
GACACAGATACAGAGCTTGTACAGAAGTAACTCTGGGCACATCCAGATAGTACAAAAAGCAGTCATAAAG
CAGCTACTCATGGAATCGCAACTGTGATGGC

FIGURE 433
SEQ ID NO: 425
Genbank ID      : AI057637
Unigene ID(#167) : Hs.234898
Unigene name    :      acetyl-Coenzyme A carboxylase beta   ACACB
>gi|3331503|gb|AI057637.1|AI057637                                     oy31h06.x1
Soares_parathyroid_tumor_NbHPA Ho
mo sapiens cDNA clone IMAGE:1667483 3', mRNA sequence
TTTTTCCTTCAAAAAATAGTTTATTCTGCACATTTCCTAGTAGGCTCTCTGCCCACCGTTCCAGGGTAG
CAGCTACTCATAACTTGTCTTTCTCTCCAAAACCAAGAGGGCCTTCCCAACAGAAAAACCTTCAGTTCCC
AAAGCAGCATCGATTCTTCCCCTCCACCCCAGCAAACCTCGGGGTGGAATAATGAATCATTCACCTTCTCC
CACCCCTCACTGCCCCGCCCCACCTTCATTTGCCAGGACTGTCACTGGCTGATGGTCAGATTTTGTCTTT
TCAACTTGGATACCCTCAAGCATCCAGCTTTTGGAGGCTTCCCTGGGCAACCTCATGGGCTTCCACAT
TGACCAGGCATTACATTCAGCATCCTTGGACAAACCACCCATCAGAGCAGTGGGTTGTGGCCAGNTCCCT
CCACCCCCGACTCCGCCCCAATGGAAGAAACCAGAGGATCACAGGGCCCCAGGCTGTGCCGCCTGCAGAG
CCAGGAGCTGCTGGGTGCATTGCAACGTTCTCCCTGAGCAAATCGGCATGGTCACCACAGTCCAGTCCTC
AGTCACCGACAGCTCTGCCCCTCGGGGTCAGATCCCACC

FIGURE 434
SEQ ID NO: 426
Genbank ID      : AI084430
Unigene ID(#167) : Hs.113919
Unigene name    :     hypothetical protein LOC374969         LOC374969
>gi|3422853|gb|AI084430.1|AI084430 ox74e03.x1 Soares_NhHMPu_S1 Homo sapiens cDN
A clone IMAGE:1662076 3', mRNA sequence
AACCGAGCAGTTTAACCAATCTCTTTTAATAAATCCAGCACATTACAGTGGTATAAATTTATCTTTTTTA
ACACTCCACATAAAAACATGTGTCCTCTCTTACATTTAATCATTAGTAGTCTCTAAAATGGTAAAATAAA
TTGAATTTACATTAGCAAATGAAAGTGCAAATTTGTACAGCTAGGCTCAGCAGCAAAAGTGAAGAATAAG
AATGAAAGGTGAAAAGCTGGTGGATGCCATGCAGAGCGAGGACTTCCATAAAGGTCTGTGCCCTGCGGCC
AAACACAGTCAACACACCACCATTTTCTTGTTGCTCTTAAATGAGCAAAACCAAATTTCTTTTTTATTTA
ATGAAATATTAAATCTTTATTTCCCCCTAACATAATTTGTGATCAAGTAGGACAGAGGTAAGTCCCACCA
TCACTGGGGACAGTAGCAACACACA

FIGURE 435
SEQ ID NO: 427
Genbank ID          : NM_020238.1
Unigene ID(#167)    : Hs.142179
Unigene name        :     inner    centromere    protein    antigens    135/155kDa
      INCENP
>gi|9910375|ref|NM_020238.1| Homo sapiens inner centromere protein antigens 135
/155kDa (INCENP), mRNA
ATGGGGACGACGGCCCCAGGGCCCATTCACCTGCTGGAGCTATGTGACCAGAAGCTCATGGAGTTTCTCT
GCAACATGGATAATAAGGACTTGGTGTGGCTTGAGGAGATCCAAGAGGAGGCCGAGCGCATGTTCACCAG
AGAATTCAGCAAAGAGCCAGAGCTGATGCCCAAAACACCTTCTCAGAAGAACCGACGGAAGGAAGAGACGG
ATTTCTTATGTTCAGGATGAAAACAGAGATCCCATCAGGAGAAGGTTATCCCGCAGAAAGTCTCGGAGCA
GCCAGCTGAGCTCCCGACGCCTCCGCAGCAAGGACAGTGTAGAGAAGCTGGCTACAGTGGTCGGGGAGAA
CGGCTCCGTTCTGCGGCGTGTGACCCGTGCTGCGGCTGCAGCTGCCGCGGCTACCATGGCATTGGCTGCA
CCTTCTTCACCCACCCCTGAGTCTCCCACGATGCTGACTAAGAAGCCCGAGGATAACCACACCCAGTGCC
AGCTGGTGCCTGTGGTGGAGATCGGCATCAGTGAGCGCCAGAATGCTGAGCAGCATGTCACCCAGCTCAT
GTCCACCGAGCCTCTGCCCCGCACTCTGTCCCGACTCCAGCTTCAGCCACAGCTCCAACCTCCCAGGGC
ATCCCGACATCAGATGAGGAATCAACACCTAAGAAGTCGAAGGCCAGGATACTGGAGTCCATCACAGTGA
GCTCCCTGATGGCTACACCCCAGGACCCCAAGGGTCAAGGGGTCGGGACGGGGCGGTCTGCGTCTAAGCT
CAGGATTGCGCAGGTCTCCCCTGGCCCACGGGACTCGCCAGCCTTTCCAGATTCTCCATGGCGGGAGCGG
GTGCTGGCTCCATCCTGCCGGATAACTTCTCCACGCCCACGGGCTCTCGCACGGACTCTCAATCGGTGC
GGCACAGCCCGATCGCCCCGTCTTCCCCGAGTCCCCAAGTCTTAGCCCAGAAGTACTCTCTGGTGGCCAA
ACAGGAAAGTGTTGTCCGCAGGGCGAGCAGAAGGCTTGCCAAGAAGACTGCCGAAGAGCCAGCTGCCTCT
GGCCGCATCATCTGTCACAGTTACCTGGAGAGGCTCCTGAATGTTGAGGTGCCCCAGAAAGTTGGTTCTG
AGCAGAAGGAACCCCCCGAGGAGGCTGAGCCTGTGGCGGCAGCTGAGCCAGAGGTCCCTGAGAACAACGG
AAATAACTCGTGGCCCCACAATGACACGGAGATTGCCAACAGCACACCCAACCCGAAGCCTGCAGCCAGC
AGCCCGGAAACACCCTCTGCAGGGCAGCAAGAGGCCAAGACGGACCAAGCAGATGGACCCAGAGAGCCAC
CGCAGAGTGCCAGGAGGAAGCGCAGCTACAAGCAGGCCGTGAGTGAGCTGGACGAGGAGCAGCACCTGGA
GGATGAGGAGCTGCAGCCCCCAGGAGCAAGACCCCTTCCTCACCCTGCCCAGCCAGCAAGGTGGTACGG
CCCCTCCGGACCTTTCTGCACACAGTGCAGAGGAACCAGATGCTCATGACCCCTACCTCAGCCCACGCA
GCGTCATGAAGTCCTTTATTAAGCGCAACACTCCCCTGCGCATGGACCCCAAGGAGAAGGAGCGGCAGCG
CCTGGAGAATCTGCGGCGGAAGGAGGAGGCCGAGCAGCTGCGCAGGCAGAAGGTGGAGGAGGACAAGCGG
CGGCGGCTGGAGGAGGTGAAGCTGAAGCGTGAGGAACGCCTCCGCAAGGTGCTGCAGGCCCGCGAGCGGG
TGGAGCAGATGAAGGAGGAGAAGAAGAAGCAGATTGAGCAGAAGTTTGCTCAGATCGACGAGAAGACTGA
GAAGGCCAAGGAGGAGCGGCTGGCAGAGGAGAAGGCCAAGAAAAAGCGGCCGCCAAGAAGATGGAGGAG
GTGGAAGCACGCAGGAAGCAGGAAGAGGATGCACGTAGGCTCAGGTGGCTGCAGCAGGAGGAGAAGAGC
GGCGGCACCAAGAGCTGCTGCAGAAGAAGAAGGAAGAGGAGCAGGAGCGGCTGCGGAAGGCGGCCGAGGC
TAAGCGGCTGGCAGAGCAGCGGGAGCAGGAGCGGCGGGAGCAGGAGCGGCGGGAGCAGGAGCGGCGCGAG
CAGGAGCGGCGCGAGCAGGAGCGGCGGGAGCAGGAGCGGCGCGAGCAGGAGCGACAGCTGGCAGAGCAGG
AGCGTCGGCGGGAGCAGGAGCGGCTCCAAGCCGAGAGGGAGCTGCAGGAGCGGGAGAAGGCCCTGCGGCT
GCAGAAGGAGCAGCTGCAGAGGGAACTGGAGGAGAAGAAGAAGAAGGAAGAGCAGCAGCGTCTGGCTGAG
CGGCAGCTGCAGGAGGAGCAAGAGAAGAAAGCCAAGGAGGCAGCAGGGGCCAGCAAGGCCCTGAATGTGA
CTGTGGACGTGCAGTCTCCAGCTTGTACCTCATCTCCCATCACTCCGCAAGGGCACAAGGCCCCTCCCCA
GATCAACCCCCACAACTACGGGATGGATCTGAATAGCGACGACTCCACCGATGATGAGGCCCATCCCCGG
AAGCCCATCCCCACCTGGGCCCGAGGCACCCCGCTCAGCCAGGCTATCATTCACCAGTACTACCAGCCAC
CGAACCTTCTGGAGCTCTTTGGAACCATTCTCCCACTGGACTTGGAGGATATCTTCAAGAAGAGCAAGCC
CCGCTATCACAAGCGCACCAGCTCTGCTGTCTGGAACTCACCGCCCCTGCAGGGCGCCAGGGTCCCCAGC
AGCCTGGCCTACAGCCTGAAGAAGCACTGAGGCTGGCCTGCGGCCTTCTTGGCAGCCTCGCCTCCTGTCC
ATGTCTATCTGTCTGTCTGTCGGTCTGTGTCTTGGTCTGTTGCCCTCCTTCTTGGCATGCCATTGTGGAG
GGCTTGGCCAGGTGTATATAAACGTCCTCTGTGCTGGGTGTTTCTGCTGCAGGTGGCAGGTGGCCCCAGG
CCTGTTTGGAGGATGGGCTGGGTGGGTGGGTGGGAAGAAATGGGCCCAGCCCCACATGGCCTGCAGACA
GTGCTCTGTAAATAGTTGTTTTAATTTAGCTGAATGTTAGCATTTTAGTCTTTGGCATTTTAGCGTTTGG
GAGGTAGATTAATAAAGTATATTCCTTCAAGCCTGCTGTTGATACCATGAAGACTGGGCGCCTCAGTCCC
AGCCCTGTAGCTGTGTGTCTTGGGCACCAGTGGCCTGCAGGACGAAGGTACTGTTCCATCACCTGCGGT
GTGCCTCAGGATCACCAGGTGCAGGCCCCACCCTCGGAGATGCTGCTGCAGTGAGTGGTTCCACTGCCT
GGATAACCCTTGAGGAACACGTCAGTTACTGTCACGATGGGGCAGGTGGAGCTCCTTCCTATTTTTGGG
GTGCTCCCTGTTTGTAAAGGGGAGTTTGTTCATTGGGAAAGACCTGGGTCTTGACACGGCCCTGCCACTT
AGTCCCCTACCCTCTCCATTCCCCAGGCTCCACCCGTGCTGCTCAAGTGCAAATGGACTTGAGAGTATTT FIGURE 435 cont'd

ATGTGCTGGTGAAGTATGAGGTCTGAGTAGAAAAGG

FIGURE 436
SEQ ID NO: 428
Genbank ID        : AI142126
Unigene ID(#167)  : Hs.26125
Unigene name      :       Transcribed sequences
>gi|3649583|gb|AI142126.1|AI142126   ow61h10.x1   Soares_NSF_F8_9W_OT_PA_P_S1 Homo
sapiens cDNA clone IMAGE:1651363 3', mRNA sequence
AACAAAGTTATTGGTTAGGCCTAAGAGACCCTTGGTATATCACCTGAAATCTTGGTGGAGGTTGATATTG
ATTTATTACTCTAAGTTTGGTATGCAGACTGTTACTGGTCTAAGAATGAGATAAGGAGTTTGTGCCACAA
CGTAAAATAAACTAAGACACTAAGCACATTGCTTAGTTCTACTGACATTTTTCAATGAAGAAAGCAGTAC
ATGGATTTATATTCTGGTTCAGGTTCCTTGTGCCCTAGAAGACCATTAAAAACAGTTTGTGGACAGGTTA
CTTTCAGTAGTACTGCTATAGTTGACAACTGCCATATCCATGGCTGTCTATCAATTCTTTGCATAGTCTT
CTTACATTTAAAGAAATTTCCATTTTATGAGTTTCAGCTTCCCAAAATAGAAGTCAAATACAAATCCCCA
ATCTCCCTTAAAACCAGAATGCAGGCATGTGACCCAGCCTCCTCCAATCAAACACACTCAAATGCAACTT
CAATTCAGAATAGAGCAGTGTAAAGAAACGAGGTTCCATTCTCATTGCTGTAAGACTTTTAGTCGTGTCC
CAGTGGTATAGGTCTAGCTCCTGAATCAGAAATGGTAT

FIGURE 437
SEQ ID NO: 429
Genbank ID        : AI421796
Unigene ID(#167)  : Hs.132591
Unigene name      :       solute   carrier   family   10   (sodium/bile   acid
cotransporter family), member 4        SLC10A4
>gi|4267727|gb|AI421796.1|AI421796   tf44g11.x1   NCI_CGAP_Brn23   Homo   sapiens
cDNA
clone IMAGE:2099108 3', mRNA sequence
CACTAGAAAAATGTTGATTATTCATTAATAAGTAGATACCAGATCAAGTAATCAAATACATTAATGTAAC
TTTTCTCTGATACTGGTTTGACAAATACTATATTTCCTTATTTAACTGACCTGTTTTGGAATTCTTCTGA
ATACAGGTCAAAATTCAACATTGTGAGGAATTTTAAGTAGAGCAAGCACACTTTTTTTTTTACAACAATT
ACATTAAACTCAATTATGCTTTACAAAGATAGCTTGTTTTTCCTCATAGTGCGCCAAAATTCTACATTTC
CAAGACCCTGTTTTCTAATAGATTCTGTATTTGCAACAGTCATAGAAATTGGTGATGGTAAAAACTAAA
ACCACATTTAATTCAGGNCTTACGTTAGCCATTCCAGGTGCAAATTATATTACAGCATTGATTTGTAATT
TGTGAACACGNNTGGGTAATNACACAGTGAACCTTAA

FIGURE 438
SEQ ID NO: 430
Genbank ID        : AF080586.1
Unigene ID(#167)  : Hs.158351
Unigene name      :       galanin receptor 2      GALR2
>gi|4165080|gb|AF080586.1|AF080586   Homo   sapiens   galanin   receptor   type   2
(GALR2)
 mRNA, complete cds
GGGCAGCCTCGGGGTCAGCGGCACCATGAACGTCTCGGGCTGCCCAGGGGCCGGGAACGCGAGCCAGGCG
GGCGGCGGGGGAGGCTGGCACCCCGAGGCGGTCATCGTGCCCCTGCTCTTCGCGCTCATCTTCCTCGTGG
GCACCGTGGGCAACACGCTGGTGCTGGCGGTGCTGCTGCGCGGCGGCCAGGCGGTCAGCACTACCAACCT
GTTCATCCTTAACCTGGGCGTGGCCGACCTGTGTTTCATCCTGTGCTGCGTGCCCTTCCAGGCCACCATC
TACACCCTGGACGGCTGGGTGTTCGGCTCGCTGCTGTGCAAGGCGGTGCACTTCCTCATCTTCCTCACCA
TGCACGCCAGCAGCTTCACGCTGGCCGCCGTCTCCCTGGACAGGTATCTGGCCATCCGCTACCCGCTGCA
CTCCCGCGAGCTGCGCACGCCTCGAAACGCGCTGGCAGCCATCGGGCTCATCTGGGGGCTGTCGCTGCTC
TTCTCCGGGCCCTACCTGAGCTACTACCGCCAGTCGCAGCTGGCCAACCTGACCGTGTGCCATCCCGCGT
GGAGCGCCCCTCGCCGCCGCGCCATGGACATCTGCACCTTCGTCTTCAGCTACCTGCTTCCTGTGCTGGT
TCTCGGCCTGACCTACGCGCGCACCTTGCGCTACCTCTGGCGCGCCGTCGACCCGGTGGCCGCGGGCTCG
GGTGCCCGGCGCGCCAAGCGCAAGGTGACACGCATGATCCTCATCGTGGCCGCGCTCTTCTGCCTCTGCT
GGATGCCCCACCACGCGCTCATCCTCTGCGTGTGGTTCGGCCAGTTCCCGCTCACGCGCGCCACTTATGC FIGURE 438 cont'd GCTTCGCATCCTCTCGCACCTGGTCTCCTACGCCAACTCCTGCGTCAACCCCATCGTTTACGCGCTGGTC
TCCAAGCACTTCCGCAAAGGCTTCCGCACGATCTGCGCGGGCCTGCTGGGCCGTGCCCCAGGCCGAGCCT
CGGGCCGTGTGTGCGCTGCCGCGCGGGGCACCCACAGTGGCAGCGTGTTGGAGCGCGAGTCCAGCGACCT
GTTGCACATGAGCGAGGCGGCGGGGGCCCTTCGTCCCTGCCCCGGCGCTTCCCAGCCATGCATCCTCGAG
CCCTGTCCTGGCCCGTCCTGGCAGGGCCCAAAGGCAGGCGACAGCATCCTGACGGTTGATGTGGCCTGAA
AGCACTTAGCGGGCGCGCTGG

FIGURE 439
SEQ ID NO: 431
Genbank ID        : NM_006681.1
Unigene ID(#167)  : Hs.418367
Unigene name      :       neuromedin U        NMU
>gi|5729946|ref|NM_006681.1| Homo sapiens neuromedin U (NMU), mRNA
AGTCCTGCGTCCGGGCCCCGAGGCGCAGCAGGGCACCAGGTGGAGCACCAGCTACGCGTGGCGCAGCGCA
GCGTCCCTAGCACCGAGCCTCCCGCAGCCGCCGAGATGCTGCGAACAGAGAGCTGCCGCCCCAGGTCGCC
CGCCGGACAGGTGGCCGCGGCGTCCCCGCTCCTGCTGCTGCTGCTGCTGCTCGCCTGGTGCGCGGGCGCC
TGCCGAGGTGCTCCAATATTACCTCAAGGATTACAGCCTGAACAACAGCTACAGTTGTGGAATGAGATAG
ATGATACTTGTTCGTCTTTTCTGTCCATTGATTCTCAGCCTCAGGCATCCAACGCACTGGAGGAGCTTTG
CTTTATGATTATGGGAATGCTACCAAAGCCTCAGGAACAAGATGAAAAGATAATACTAAAAGGTTCTTA
TTTCATTATTCGAAGACACAGAAGTTGGGCAAGTCAAATGTTGTGTCGTCAGTTGTGCATCCGTTGCTGC
AGCTCGTTCCTCACCTGCATGAGAGAAGAATGAAGAGATTCAGAGTGGACGAAGAATTCCAAAGTCCCTT
TGCAAGTCAAAGTCGAGGATATTTTTTATTCAGGCCACGGAATGGAAGAAGGTCAGCAGGGTTCATTTAA
AATGGATGCCAGCTAATTTTCCACAGAGCAATGCTATGGAATACAAATGTACTGACATTTTGTTTTCTT
CTGAAAAAAATCCTTGCTAAATGTACTCTGTTGAAAATCCCTGTGTTGTCAATGTTCTCAGTTGTAACAA
TGTTGTAAATGTTCAATTTGTTGAAAATTAAAAAATCTAAAAATAAA

FIGURE 440
SEQ ID NO: 432
Genbank ID        : U37546.1
Unigene ID(#167)  : acc_U37546.1
Unigene name      :
>gi|1145290|gb|U37546.1|HSU37546 Human IAP homolog C (MIHC) mRNA, complete
cds
GAATTCAAAATGTCTTCAGTTGTAAATCTTACCATTATTTTACGTACCTCTAAGAAATAAAAGTGCTTCT
AATTAAAATATGATGTCATTAATTATGAAATACTTCTTGATAACAGAAGTTTTAAAATAGCCATCTTAGA
ATCAGTGAAATATGGTAATGTATTATTTTCCTCCTTTGAGTTAGGTCTTGTGCTTTTTTTTCCTGGCCAC
TAAATTTCACAATTTCCAAAAAGCAAAATAAACATATTCTGAATATTTTTGCTGTGAAACACTTGACAGC
AGAGCTTTCCACCATGAAAAGAAGCTTCATGAGTCACACATTACATCTTTGGGTTGATTGAATGCCACTG
AAACATTCTAGTAGCCTGGAGAAGTTGACCTACCTGTGGAGATGCCTGCCATTAAATGGCATCCTGATGG
CTTAATACACATCACTCTTCTGTGAAGGGTTTTAATTTTCAACACAGCTTACTCTGTAGCATCATGTTTA
CATTGTATGTATAAAGATTATACAAAGGTGCAATTGTGTATTTCTTCCTTAAAATGTATCAGTATAGGAT
TTAGAATCTCCATGTTGAAACTCTAAATGCATAGAAATAAAAATAATAAAAAATTTTTCATTTTGGCTTT
TCAGCCTAGTATTAAAACTGATAAAAGCAAAGCCATGCACAAAACTACCTCCCTAGAGAAAGGCTAGTCC
CTTTTCTTCCCCATTCATTTCATTATGAACATAGTAGAAAACAGCATATTCTTATCAAATTTGATGAAAA
GCGCCAACACGTTTGAACTGAAATACGACTTGTCATGTGAACTGTACCGAATGTCTACGTATTCCACTTT
TCCTGCTGGGGTTCCTGTCTCAGAAAGGAGTCTTGCTCGTGCTGGTTTCTATTACACTGGTGTGAATGAC
AAGGTCAAATGCTTCTGTTGTGGCCTGATGCTGGATAACTGGAAAAGAGGAGACAGTCCTACTGAAAAGC
ATAAAAAGTTGTATCCTAGCTGCAGATTCGTTCAGAGTCTAAATTCCGTTAACAACTTGGAAGCTACCTC
TCAGCCTACTTTTCCTTCTTCAGTAACAAATTCCACACACTCATTACTTCCGGGTACAGAAAACAGTGGA
TATTTCCGTGGCTCTTATTCAAACTCTCCATCAAATCCTGTAAACTCCAGAGCAAATCAAGATTTTTCTG
CCTTGATGAGAAGTTCCTACCACTGTGCAATGAATAACGAAAATGCCAGATTACTTACTTTTCAGACATG
GCCATTGACTTTTCTGTCGCCAACAGATCTGGCAAAAGCAGGCTTTTACTACATAGGACCTGGAGACAGA
GTGGCTTGCTTTGCCTGTGGTGGAAAATTGAGCAATTGGGAACCGAAGGATAATGCTATGTCAGAACACC
TGAGACATTTTCCCAAATGCCCATTTATAGAAAATCAGCTTCAAGACACTTCAAGATACACAGTTTCTAA
TCTGAGCATGCAGACACATGCAGCCCGCTTTAAAACATTCTTTAACTGGCCCTCTAGTGTTCTAGTTAAT
CCTGAGCAGCTTGCAAGTGCGGGTTTTTATTATGTGGGTAACAGTGATGATGTCAAATGCTTTTGCTGTG
ATGGTGGACTCAGGTGTTGGGAATCTGGAGATGATCCATGGGTTCAACATGCCAAGTGGTTTCCAAGGTG
TGAGTACTTGATAAGAATTAAAGGACAGGAGTTCATCCGTCAAGTTCAAGCCAGTTACCCTCATCTACTT FIGURE 440 cont'd GAACAGCTGCTATCCACATCAGACAGCCCAGGAGATGAAAATGCAGAGTCATCAATTATCCATTTTGAAC
CTGGAGAAGACCATTCAGAAGATGCAATCATGATGAATACTCCTGTGATTAATGCTGCCGTGGAAATGGG
CTTTAGTAGAAGCCTGGTAAAACAGACAGTTCAAAGAAAAATCCTAGCAACTGGAGAGAATTATAGACTA
GTCAATGATCTTGTGTTAGACTTACTCAATGCAGAAGATGAAATAAGGGAAGAGGAGAGAGAAAGAGCAA
CTGAGGAAAAAGAATCAAATGATTTATTATTAATCCGGAAGAATAGAATGGCACTTTTTCAACATTTGAC
TTGTGTAATTCCAATCCTGGATAGTCTACTAACTGCCGGAATTATTAATGAACAAGAACATGATGTTATT
AAACAGAAGACACAGACGTCTTTACAAGCAAGAGAACTGATTGATACGATTTTAGTAAAAGGAAATATTG
CAGCCACTGTATTCAGAAACTCTCTGCAAGAAGCTGAAGCTGTGTTATATGAGCATTTATTTGTGCAACA
GGACATAAAATATATTCCCACAGAAGATGTTTCAGATCTACCAGTGGAAGAACAATTGCGGAGACTACAA
GAAGAAGAACATGTAAAGTGTGTATGGACAAAGAAGTGTCCATAGTGTTTATTCCTTGTGGTCATCTAG
TAGTATGCAAAGATTGTGCTCCTTCTTTAAGAAAGTGTCCTATTTGTAGGAGTACAATCAAGGGTACAGT
TCGTACATTTCTTTCATGAAGAAGAACCAAAACATCATCTAAACTTTAGAATTAATTTATTAAATGTATT
ATAACTTTAACTTTTATCCTAATTTGGTTTCCTTAAAATTTTTATTTATTTACAACTCAAAAAACATTGT
TTTGTGTAACATATTTATATATGTATCTAAACCATATGAACATATATTTTTAGAAACTAAGAGAATGAT
AGGCTTTTGTTCTTATGAACGAAAAAGAGGTAGCACTACAAACACAATATTCAATCAAAATTTCAGCATT
ATTGAAATTGTAAGTGAAGTAAAACTTAAGATATTTGAGTTAACCTTTAAGAATTTTAAATATTTTGGCA
TTGTACTAATACCTGGTTTTTTTTTGTTTGTTTTTTGTACAGACAGGGCAGCATACTGAGACCCTGC
CTTTAAAAACAAACAGAACAAAAACAAAACACCAGGGACACATTTCTCTGTCTTTTTTGATCAGTGTCCT
ATACATCGAAGGTGTGCATATATGTTGAATGACATTTTAGGGACATGGTGTTTTATAAAGAATTC

FIGURE 441
SEQ ID NO: 433
Genbank ID         : AA643687
Unigene ID(#167)   : Hs.149425
Unigene name       :        solute carrier family 28 (sodium-coupled nucleoside
transporter), member 3    SLC28A3
>gi|2568905|gb|AA643687.1|AA643687   nq79h03.s1   NCI_CGAP_Co9   Homo   sapiens
cDNA cl
one IMAGE:1158581 3', mRNA sequence
TTTTTTTTTTTTTTTTTTTTTTTTTTTTTTTTTCCTAGGGGAACATGTTGCATTTATAAAGAAATG
TCACACGTACACACAGAAAGGTCATATCAAAGCAGGTAAAAATTAAGACAACATATTTCTCCAAAAACCA
GTCTGACATCTTATAATACCAGAAATATACACACACTTCAAACCTGGGAAATCATCCTATGAATCTGCTC
TGACCAATATGGTAGCCACTAATACCTGAAATATGGAGTAACCAAGTAACAAATTTTTAAATTTAAAACT
GATACTCATTTCAGTTATTGGAAAACTTTTAAGCACATTTAGACCAACATGGGTATGTAAATTTACTTTG
CAAATTTAGATTTTATGAAATCTAAACATGGATTAAGTATTATCAGTAAAACTTTAG

FIGURE 442
SEQ ID NO: 434
Genbank ID         : NM_002341.1
Unigene ID(#167)   : Hs.376208
Unigene name       :        lymphotoxin beta (TNF superfamily, member 3)    LTB
>gi|4505034|ref|NM_002341.1|   Homo      sapiens      lymphotoxin      beta      (TNF
superfamily, me
mber 3) (LTB), transcript variant 1, mRNA
CAGTCTCAATGGGGGCACTGGGGCTGGAGGGCAGGGTGGGAGGCTCCAGGGGAGGGGTTCCCTCCTGCT
AGCTGTGGCAGGAGCCACTTCTCTGGTGACCTTGTTGCTGGCGGTGCCTATCACTGTCCTGGCTGTGCTG
GCCTTAGTGCCCCAGGATCAGGGAGGACTGGTAACGGAGACGGCCGACCCCGGGCACAGGCCCAGCAAG
GACTGGGGTTTCAGAAGCTGCCAGAGGAGGAGCCAGAAACAGATCTCAGCCCCGGGCTCCCAGCTGCCCA
CCTCATAGGCGCTCCGCTGAAGGGGCAGGGGCTAGGCTGGGAGACGACGAAGGAACAGGCGTTTCTGACG
AGCGGGACGCAGTTCTCGGACGCCGAGGGGCTGGCGCTCCCGCAGGACGGCCTCTATTACCTCTACTGTC
TCGTCGGCTACCGGGCCGGGCGCCCCCTGGCGGCGGGACCCCCAGGGCCTGGTCGGTCACGCTGCGCAG
CTCTCTGTACCGGCGGGGGCGCCCTACGGCCGGGCACTCCCGAGCTGCTGCTCGAGGGCGCCGAGACG
GTGACTCCAGTGCTGGACCCGGCCAGGAGACAAGGGTACGGGCCTCTCTGGTACACGAGCGTGGGGTTCG
GCGGCCTGGTGCAGCTCCGGAGGGGCGAGAGGGTGTACGTCAACATCAGTCACCCCGATATGGTGGACTT
CGCGAGAGGGAAGACCTTCTTTGGGGCCGTGATGGTGGGGTGAGGGAATATGAGTGCGTGGTGCGAGTGC
GTGAATATTGGGGCCCGGACGCCCAGGACCCCATGGCAGTGGGAAAAATGTAGGAGACTGTTTGGAAAT
TGATTTTGAACCTGATGAAAATAAAGAATGGAAAGCTTCAGTGCTGCCGATAAA

FIGURE 443
SEQ ID NO: 435
Genbank ID      : M85276
Unigene ID(#167) : acc_M85276
Unigene name    :
>gi|189229|gb|M85276.1|HUMNKG5PRO Homo sapiens NKG5 gene, complete cds
CTGCAGTGTTTGGTCTCACCAAGTTTCCCACAATAAAGAGACATGAGTCACCTTTCAAGACCCTTTACCC
CCAAGAATGTGGTCTTCACACATGAGACCAAGGTCTACAAGTGGTCAGGAGAGAGGGGGTCTGCTCAGAT
GGGGGAGTAGTGCCTGAGCTGGCCTCAAGAGGGTTAAGTGGCCCTGCACTGAAAACCTGGACACTGAGTT
AGGGTAGGGCTGGGGGAAAACTTGGGCTTTGGAGTCGTAGGGTCTGGGTTCAAATCCACAGACCATTCCC
TTCCTAGCTGTGTGTTGGTGGGTAATTCACTGGATCTTTCTGAGTCCTGGTTTCCTCATCTGAGGTAAAA
CGAGTTTGCCGGTTGGTCTGAGAGCTGTTCTAGGCATGGTGGGGAGACCCTGACAGGCAGAGGCAGCCCT
GCTCTCAAGCAGTTGATTTACAGCTGGGGAAACAAGACAGCCACAAATGCAATACCTCAAACTCAACTTC
TCACCAGAAAGCTCCTTTTCCTAATTTTCACAGCCAGTCCCTCAGCCTCCTGGGCCCCAAATACTAGTAA
AACCTTTGCCTCCTCTCTCTTCTTTCTTGTAATCATATAGGTACAAAGTCCTACCAATTCTTCCTG
AAATATGTTTCCTTATCAAAAAGTCCTGCAAAGCCGTGCGTGGTTGCTCATGCCTATAATCCCAGCACTT
TGGAGGCTGGGAGGATCGCTTGAGTCCAGGAGTTCGAGACCAGCCTGGACAACATATGGAGACCCATCTC
TACCAAAAATTTTAAAATCAGCAGGGGTGGTAGTGGCAAGCACCTGTGGTCTCATCTACTTGGGAGGCTG
AGGTGGGGGGATTGTTGGAGCCTGGGCGGTTGAGGCTGCAGTGATCTGTGATTGCACCACTGCACTCTAG
CCTGAGGGACAGAGCAAGAACTTGTATCAGAAAAAAAAAAAAAAAGTCCTGCGGTACTGGACACTGCCAT
TGCCTATACGATTCCCACTCCCTCATCCTCCCTAGCAGGATATCAATTTTGTTCGAAGTGTCAATGAAGG
CCAGGTGCGGTGGCTGATGCCTGTAATCCTAACACTTTGGGAGGCCGAGGCAGGCGGATCACCTGAGGTC
AGGAGTTCAAGACCAGCCTGGCCAACATGGTGAAACCCTGTCTCTACTAAAAACACACAAATTAGCAGGG
CATGGTGGCGTGCACCTGTAATCCCAGCTACTCAGGAGGCTGAGACAGGAGAATCACTTGAACCCGGAGT
GGAGGTTGCAATCAGCCAAGATCACACCACTGCACTTCAGCTTGGGTGACAAGAGTGAAACTCTGTCTCA
AAAAGAAAAACAAAACAAAAACAAACAACAACAACAAAAGCAAAGTGTCAGTGAAGGTCCAGCAAAAG
ACTCCCTTCCTATTGCCCTTTGCAGCCAGGGTCATCATGTGACACAGTTCAGATCAATGAGATGGAGGCT
GAGGGTCCCTGGGAAAGATGTTTTTCCTATACAGGTACCACCTCTTTCAGCTTCACTCTTTCCATTTTCC
ACGTGAACAGGCCTTGTAGCCTGGAGGAGCTACAGCTGCCTTTTTGAGATGCTGAGGCACCCTGTCTGAA
GAAGGCCCTCACATCACTCAACTTGACTACTGGGTGAGCCCTTGGAGAGGCTTCCCAGCCTCTGCTCTTC
AAGCCGAAGTACCACAGGGGACACGAGTCCCAGAGTTACAGGACCCCAGCTATGGTTCATGTGTAAAGGG
AACCATTAGGCAACCAGGGGAAATGATGAAGAAGCTACATTTACAAATGTGGAAAGATGTTCGTGGTA
TATTGTTAAATTAAAAAGCTGTTTAAAAATAGTTTTTGGGTCAAGTGAGATGACTCACTTATACTTTTAG
TATAAGTATGTCCCATGCAATATCTGGAACGTACTTGTACTAAGGGGTTTCTCCCTCCATCGGCACATCC
CAGGCATCCTGGCAGCTGCTGGCCTCCAGCAACCCCACATTCTAGTTGTGTGGGAGTGGGTTGTGGCATG
GACCCTGTGGGCTACCACTGCCCTGACCTGCTTCTTCACACACTGGTATTTGTATCTGTGGTAAACCCAG
TGACACGGGGGAGATGACATACAAAAAGGGCAGGACCTGAGAAAGATTAAGCTGCAGGCTCCCTGCCCAT
AAAACAGGGTGTGAAAGGCATCTCAGCGGCTGCCCCACCATGGCTACCTGGGCCCTCCTGCTCCTTGCAG
CCATGCTCCTGGGCAACCCAGGTAAGGCCTTCCCCTCGGGATCGATCCTGATGGCCCACCCAGCCTCGCA
CTCTCAGGCTGGCTGAACCTGGAGCTTGGACTCTGTGGGCACCCAGGTGCCCCTGCCTCCCCCGGCCTT
CTCCCCCGTCATGGAGGCCTGGCCCTCCCCTCAGAGCCAGGCTTAGTCCGGTGTGCTGCCCAGCCTGTCA
CTGGCCTGGCCAAGGAGGAGAGACAGGCCAGGGATTCTGGTCCTAACTCTACTGGCCACACTGTGTGGCC
TGAGACCCCCCTTTCCCTCCCAAGCCCCTGCCTCCGCATCTGCGTGGTGAAGGCCATTGGCCTCATCGGT
GGATCTGCGTTTCCTCGGGCCTACACTGTCTAGGATTGTGCGGGCTGGTGAGAGAACAAGATCTCTTCC
GTGTTCAAGGCAGACTTCCTGCCCCCTGCACCCTGCTCTCTCCCAGGCCTTGAGGTCAGTGTGAGCCCCA
AGGGCAAGAACACTTCTGGAAGGGAGAGTGGATTTGGCTGGGCCATCTGGATGGAAGGTAAAAAAAGAAA
ATCCCTTGAAAGGAGATTGAGGGAAGTTTCTAGACAAACCGACCCCCAAATCTGTGTTGCTGGGGAACA
GAGGAGAAGAGAGAGTCTCGCCCTCCTGGCTTTCTAGAAGGAACGTGAGAACACGTGTTTGTGCTGAGAG
TGGGTCAGAGCGGCTCCAGGGCAAAGCATGTGGACAGGTATCCTGGCCCCCTGCAAGGCCCAGCTCCTGT
CCTAGGCCCTGGTCACCTCCTGGACTCCACCAGCCAGGAGAACGGGCTTTCCCTCTCCTTCCGCCTGCG
GAGGGGAAGCTGAAGTCTGGTCTTCCTCAGGTCTGGTCTTCTCTCGTCTGAGCCCTGAGTACTACGACCT
GGCAAGAGCCCACCTGCGTGATGAGGAGAAATCCTGCCCGTGCCTGGCCCAGGAGGGCCCCAGGTACGT
GTTGGCTCTCTGCTCACCTGCCACAGTCCCTCTCCTTTCCTCCTCCCTGGTGGCTCCTGGGGTGAGGTC
TGGAGCTCTCTAATGGTCAGGAGGTGGGAGTGGAGGCTGGGCTGTTTCTGACGATGCTGGTTTTGTTGAA
TTCATGTCTGGCCAGGAGGGCTACAGGTATCTGGCAGACTCCTCCAGGAGGATCCTCTGGGGTCTCACCC
TCCAAGGAGCCTGGGGCTGCAGAACCCAAATAGGCAGACTCCCCTGGGAGTTCCTCAATAGGAGAGGGGC
AAGTGCAGGGCTGGGAAAGTACTGGGGTTGTGGGAGGCTGTTTCTGGGTGTCTCAGAGCCTCTAAGACA
AGCAAAAGGGTGGGTAGGGGCCAGGCAGCCAGTTCAGGCCTTCAGTGTATCCACGCTCTGGGAAGAGATC
ACGGACATTCCTGCCGGCCTCAGAAACACAAAGGGCCCCTTTCCTGGGCACTTTCACGCGCTCCCAGAGT
GTCTGAGAGACCATCATAAGGGCTTTCTTTCCTGACAGGGTGACCTGTTGACCAAAACACAGGAGCTGGG

FIGURE 443 cont'd

```
CCGTGACTACAGGACCTGTCTGACGATAGTCCAAAAACTGAAGAAGATGGTGGATAAGCCCACCCAGGTG
AGGCCAAGGGGCTACAGAGCCTCCTGTCTGCTGCTCAATGGAGGGGCCAGCCTGTGACCAGGTCGGGGAT
CGGGGAGCCCGGGGGCACCTTGCACAGTGATCCTGGGGGAGGGCTTCCTAGAAGGGAATCTGTGAGTCCC
CGTGTGTCTGTGGATGAATTTCAGAGAACTTGTGAAATTGTGACTCTCTGGAACTGTGTAAGTCAGACGG
CAGAGTATACATGGTTTTCATCATGTATCCTCAAAGAGGGCTTGTCCCAGAGAAGTTAGGAATCTTCCCC
TAAAGCCCTAACATTTGTGTCCAAGGCAGAGTTTGAGAAGCTAGTTCCCCAAGAGGCCTGGGTCAGGACT
GATAAATCCCAGATCTGCTACTTCCAAGCTGCATGGCCTTGGGCAAGTCACTTCCACTTTCTGAGCCCCT
GTTATCTTATCTTTGAAATGTGATGGATAATAGTCCCTATCTTGCAAGTTGTCAAACCCTTTTTTTTTTT
TTTCCTTGAGATAGGATCTTACTCTGAGACCCAGGCTGGAGTGCACTGGTGTGATCTTGGCTCACTGCAA
CCTCTGCCTCCCTGGCCCAAGCAATTCTCCTGTCTAAGCCTCCTGAGTACCTGGGGCTCCAGGTGTGCGC
CACCATGCCCAGCTAATTTTTGTACTTTTGTAGAAACAGGGTCTCACTGTGTTGCCCAGGCTGGTCTCCA
ACTTCTGAGCTGAAGCAATCCACCTGCCTTGGCCTCCCAAAGTGTGGGATTATAGGCATGAGCCACTGCA
CCTGGCTGCTGAAGCTTTTTAAAAGAGCTGAGGGCTGGGATGTGCTTAGCTCCACGTCCAGCACTGAGTA
AATGCTTAACGAATGACTGTGTTACTACCAAGAATTATTGTTTCACTCTCCCTCCTTCCCTCTCCTCTGC
TGCCCCAAACTACTCAGCATCCTGGCACTGCAGGCTCGCACTTAGCCCTGGATACCCAGATTCATCCTCC
TCCCCTGGGATGGCATAGAAGAGACTTTAAAACCAAATGAGCCAAGACTCCAAGCTCTGACCACACCTCC
CACCCCCACCAGTCTTCTCTATGCACCCCCTCTATATCTGGAGCCCCCAGCCAGGTTCTGGACCAAGGTA
GCTACATGGCAGAGCATTTAATGTGTGCCTGGCAGCCATGGGCACCATTCTCCACACAGAAGGCAGGGAC
AGGTGCACAAGGGGCTGAGACCCCAGCAGGGCTAACTGTCCTTGTCTCAGGAGCCCTACCTGGCCAGTCT
TGGGCCAGGCCTTGGGGACTGGGAGTAGGGGCTGACCCGTCTGTACAGTCTCTGGCCCCATGGCACCAGG
TGCCAGCTCCTCGCACCCAGTACTCCCATTGCTAGGGCTGCTGGAACCTGCAGGGTTGGCAGAGCTGGGC
AGGACTCACCCTATAACCATGTCCACTGTGGTGCTGCTGCTGCAGAGAAGTGTTTCCAATGCTGCGACCC
GGGTGTGTAGGACGGGGAGGTCACGATGGCGCGACGTCTGCAGAAATTTCATGAGGAGGTATCAGTCTAG
AGTTATCCAGGGCCTCGTGGCCGGAGAAACTGCCCAGCAGATCTGTGAGGACCTCAGGTTGTGTATACCT
TCTACAGGTGAGTGCAGAGGTGACAGCAGGGATACCTCCTGAGGGTTGGAGACAGCTTCCCCCAGGATAT
ATCAAAGCTGCCTCCTTACTCCCCATCTCCCAGCATGGGAAAGTGTGGAGAATTGAGCAGATGGACTTT
AGCTAGAAATGTTTGAGAAATACTGATTAGAGCTTGGGCTTCAGACACAGGTGGTTGTGGAGTAAAATCT
GGTCTCCATCTCTCCCTGGCTGTGTGACCTTAAGCAAATAACTTGACCTCTCTGAGCTTCAGTTTCTTCA
TCTGTGAAGGAGAGATAGCAATCCTGATTTTTGAGATTGGAATGAGAATTGAAGGAGGTCACCGTGTGTG
TGGACCTGACCCTGGGGAAATGTCCTCAGACTGAGGCTATTCAAGGTCATCAGACCCTCAGTCAAACTCC
AACCCAGCCCAGCACATGGCCCCTGGGGTCGGGAGCTGGGGCCATATCCTCCCCCACAATCCTGGGCCCT
GAGATCTGGGCTAGGGAACCCTTCAGGCAGGGAGCATGAGGCCTTTCCCTCCATGGCTGCCCAGGCTGT
GCTGAGAGAACAGATCTCGGCTGTAGGAAACGGGGCCAGAAAGGGGCCTCGGTGATTGGCTCTGGCAGCT
CAGCTGGCACTTGCCAATAGCTCTGGGATTTTATGCTGGCAGATCGGGGTCCCCACCATTTCCTGTCAT
TGGAGCTTGTGGCTTTTCTATTCAAGGCCCCACAGCCTGCTCAGGCTGCCGACTGGCTTCCAGGATGTGC
CTCTGGGTGTGTTCAGTAGGGTCAGGTGGCTCTGGGACCTTAAGCAAGTAACATTCTGAGTGCCTGCTTC
TCCTTGAGGACCCACCACATCTGCCCACAGCTAGCTGTTCTCTCCGCTCCAGGTCCCCTCTGAGCCCTCT
CACCTTGTCCTGTGGAAGAAGCACAGGCTGCTCCTCCAGATCCCGGGAACGTCAGCAACCTCTGCCGGC
TCCTCGCTTCCTCGATCCAGAATCCACTCTCCAGTCTCCCTCCCCCTGACTCCCTCTGCTGTCCTCCCCTC
TCAGGAGAATAAAGTGTCAAGCAAGATTTTAGCCGCAGCTGCTTCTTCTTTGGTGGATTTGAGGGGTGGG
TGTCAGTGGCATGCTGGGGTGAGCTGTGTAGTCCTTCAATAAATGTCTGTCGTGTGTCCCATACACTGTT
GTAGATGTTATGGATTTAGTGGTGAACGAGACAACCTTAACAGCATTCACACAGTTAGTCGTGAAATGCT
TACTGAGCACTCACCACAGCCATGCA
```

FIGURE 444
SEQ ID NO: 436
Genbank ID       : AA639707
Unigene ID(#167) : Hs.443239
Unigene name     :       Transcribed sequences
>gi|2563486|gb|AA639707.1|AA639707  np60h05.s1  NCI_CGAP_Br2  Homo  sapiens
cDNA cl
one IMAGE:1130745 3', mRNA sequence
```
TTTTTTTTTTTCTTGATTCCTTAATTTTATTCTTTCGTGTGCCTGGTGAGATGGCATTCAGGAAACAGGA
TTTCAAAATCCCGGTCTCTCTTTTCTCCTCACGTTTTCTCTCTGTTGTTACTTGCCGTGTTCACAGAGCT
GGTCCCTTGACCCAAGAGAGAGCCTGTGAAATCTGCAGACACTTTCTGAAGTTGGGGACAACAGCTTCCA
GCCAGAGGAACGCAAGGAACCAAGTGCAGGGGCTGGTGGGAGGAGAGTTTCCTGAGCAGACTTTCTCTGA
GGAGGTGATTGATTACTCGGTAGTCTTTCTTAGAACAGCCTCTTCTTTTGAACCTTATTCCAAACATATC
CGCAGTGCCGTCAGTTGCCAGTGTCATACTAAAGAGCCTCGTGC
```

FIGURE 445
SEQ ID NO: 437
Genbank ID        : NM_021920.2
Unigene ID(#167)  : acc_NM_021920.2
Unigene name      :
>gi|12545379|ref|NM_021920.2| Homo sapiens secretin (SCT), mRNA
AGCGCTCAGCTCCTGCGCCCCGACCCCGCCATGGCCCCCCGGCCCCTCCTGCTGCTGCTGCTGCTCCTCG
GGGGCTCCGCCGCGCGCCCCGCGCCCCCCAGGGCCCGGCGACACTCAGACGGGACGTTCACCAGCGAGCT
CAGCCGCCTGCGGGAGGGCGCGCGGCTCCAGCGGCTGCTACAGGGCCTGGTGGGGAAGCGCAGCGAGCAG
GACGCAGAGAACAGCATGGCCTGGACCAGGCTCAGCGCGGGTCTGCTCTGCCCGTCAGGGTCCAACATGC
CCATCCTGCAGGCCTGGATGCCCCTGGACGGGACCTGGTCTCCCTGGCTGCCCCCTGGGCCTATGGTTTC
AGAACCAGCTGGCGCTGCTGCAGAAGGAACCTTGCGGCCCAGATGAGGAAGGAACCCCCTCACCACCTGC
CCGGCCCAGGAGCGCAGCTGCATTTGGGGTGGGGGGCAGGATGGGGGAGAGGGGGAGGGGTGGTACTTGG
CACCAATAAAGGAGGAATCAGACC

FIGURE 446
SEQ ID NO: 438
Genbank ID        : AU147500
Unigene ID(#167)  : Hs.287499
Unigene name      :        CDNA FLJ12196 fis, clone MAMMA1000867.
>gi|11009021|gb|AU147500.1|AU147500 AU147500 MAMMA1 Homo sapiens cDNA clone MAM
MA1000867 3', mRNA sequence
AAGTAAAGACGGGGTTTCACTGTGTCGGCCAGGCTGGTCTCGACCTCCTGATCTCAAATGATCCGCCCGC
CTCGGCTTTCTGAAGTGCTGGGATTACAGGAGTGAACCGTTGTGCCTGGTACAACTGTTATCTTCTTTAA
GAAATGATGGGAGGCCTTTTTTCCAGGTATCATAGTCAATATCAGCACCCAGTTTAATGTACCAACAGGG
ATTTCTGGACCAAAATGACTCTTTATGCTTTGTCACATCTTGAGTGAGCATGATCATAGACTCCATGGAG
CACATTTACAACTGGGAACACAAAGTCTGTTCACTTTTCCCAGGCCTGGGCCATTACCTGAAGATTAGGA
CACCCAATGATACATTCTACTTTAATTTTACACTTCAGACTTCTAGGAGTCTTGCATCTGTTTTCCAGCA
GCCACAAAAGACATTCTCTAATTACTTCTGAATGAAAAACAGAGACTTTTAATTTCNTGCAAAGACATGC
ATGCACTACATACACTTTAAGACCCTGGGGTGGCTCAATTTCTGGNAAAACTGGACTTTTCCTN

FIGURE 447
SEQ ID NO: 439
Genbank ID        : AF176701.1
Unigene ID(#167)  : Hs.442734
Unigene name      :        F-box and leucine-rich repeat protein 9    FBXL9
>gi|6103640|gb|AF176701.1| Homo sapiens F-box protein FBL9 mRNA, partial cds
ACGAGGGCGATGGCGGAGTCGCTGCCCCTGGAGATGCTCACATATATTCTGAGCTTCCTGCCTCTGTCAG
ATCAGAAAGAGGCCTCCCTCGTGAGTTGGGCTTGGTACCGTGCTGCCCAGAATGCCCTTCGGGAGCAACC
AGGCCTTACCTCCCTGGACCTCAGTGGCTGCTCAGAACTGACTGATGGGCGCTCTTGGCCGTGAGCCGG
GGCCTGCGGCACCTGCGGCGCCTGAGCCTGGGGAAGCTGCAGCGGCTGACAGATGCAGGATGTACAGCTC
TGGGTGGCCTGCAGGAGCTGCAGAGCCTTCGACATGGCCGAGGGCGGGAACTGGCCCAGGCCCTGGGCTG
TATGCACGGGCTCCATCCCAGCTGGCCTCCCTCAGCCTGGCCCACTGCTCTTCATTGAAGTCACGCCCA
GAGCTGGAGCATCAGGCCTCAGGTACCAAGGACGCCTGTCCAGAGCCACAGGGCCCCTCCCTGCTCACGC
TGCGGGCCCTGCAGGAGTTGGACCTCACAGCCTGCAGCAAGCTGACTGATGCCAGTTTAGCCAAGGTGCT
CCAGTTTCTCCAGCTGAGGCAGCTGTCCCTTAGCCTGTTGCCAGAACTCACAGACAACGGCTTGGTTGCT
GTGGCCAGGGGCTGTCCTAGCCTGGAGCACTTGGCGCTGAGTCACTGCAGCCGACTCAGTGACAAGGGCT
GGGCCCAGGCAGCCAGCTCCTGGCCAAGGCTGCAGCATCTCAACCTGTCCAGCTGCAGTCAGCTCATAGA
GCAGACACTGGATGCTATTGGGCAGGCGTGCAGGCAGCTCCGGGTGTTGGATGTGGCCACGTGCCCTGGC
ATCAACATGGCCGCCGTCAGACGCTTCCAAGCCCAGCTGCCCCAGGTGTCCTGTGTCCAGTCCCGCTTCG
TGGGAGGGGCTGACCTGACCCTAACACTCTGAGGCCAGGTCAGTAACCAGCCCTGCAGCACAGCCTCCTT
GACTCCCCAGTCTCCAACCCTGGCCTTGACCCGGGTTGCTTTTTGCCTCCCTCTACTGCAGACCCTCTA
GGACTGGGGGTGGGGCCAATCCAGGGCAGCCCAGAGGGAACATCCTGCCACACCGCCTGGCAGTAGCCTC
TTTCCAGCTACACGTCGCTGCCACAGGCCCCTGGAAATGCTACCTACGTGTTGCCGCCACAGGCTCCTGC
TCTCTGGCCAAGCCCTGGGTGGGAGGCCAGGCCCCAGCGGGCAGGGTCTGGTGCTGGGAGGAGCAGAGC
CTCTGCCTCTTGCCTGCCCTCCTCTCAGACCTAAGGCCGGGCTCCACCTACTCCTGTGGGACTCTCCCAG

FIGURE 447 cont'd

CACCCTGTGTGCACTGAGCTTCAGCAGCTGAGCCTAGGTCTGTGCTGTAAATCCTAAGATTAAACATTCC
AGATAGTAAAAAAAAAAA

FIGURE 448
SEQ ID NO: 440
Genbank ID       : BG387172
Unigene ID(#167) : Hs.528776
Unigene name     :       TEA domain family member 2    TEAD2
>gi|13280618|gb|BG387172.1|BG387172    602455894F1    NIH_MGC_15    Homo    sapiens
cDNA cl
one IMAGE:4584334 5', mRNA sequence
GGTCGGAATGAACTGATCGCCCGCTACATCAAGCTGAGAACGGGGAAGACCCGAACTCGAAAACAGGTTT
CTAGTCACATCCAGGTTTGGCCCGAAGGAAATCAAGGGAAATCCAGTCCAAGTTGAAGGACCAGGTTTCC
AAGGACAAGGCTTTCCAGACAATGGCAACCATGTCCTCTGCCCAGCTCATCTCCGCGCCTTCTCTGCAGG
CCAAACTGGGTCCCACTGGTCCTCAGGCCTCTGAGCTTTTCCAGTTTTGGTCTGGAGGATCTGGGCCCCC
CTGGAATGTTCCAGATGTGAAGCCATTCTCACAGACACCGTTCACCTTGTCACTGACTCCCCATCTACT
GACCTCCCCGAGGGTACGAGCCCCGAACAAAAGACGCAAAAAGAGAGAGAGCGAACAGGGGAAGAACAA
CAGCCAAAGAAGAGGCAAGACACAGAGAGAATGAGAAACGACAAGAAGGAAACAGAGAACAAAACAAAGG
AGGAAGCGAACAGGAGAGAAAAAGAAGAGGAGAAACAAGAGAAAGAGAAAAAAAGAACAAAAAAAAG
AACAAGAGCAGGAGAGCAGCAAGAAAGAAGAGAAGACGAGAAACACGGGCAAGCAAGAAAAAAGGGAGA
GCGAGGCAAAGGAGAGAACACGACAGAAACGACGAAAGACAAGAGGACCAAGAGACAGAGGCGAAGAAGC
GAAGAGCGAAAAGAGCGAACGGAGAAGAGAGAAGAGCGAAAGAAAAACAAGAAAGAGACAGACGAGAAGC
GAAGAGGAAGGACGAAGCAGAAGAGAAGAAGACGAAAAAGAAGCAAAGGAGAGCGC

FIGURE 449
SEQ ID NO: 441
Genbank ID       : AK026784.1
Unigene ID(#167) : Hs.301296
Unigene name     :        CDNA: FLJ23131 fis, clone LNG08502
>gi|10439717|dbj|AK026784.1|    Homo    sapiens    cDNA:    FLJ23131    fis,    clone
LNG08502
TTTGATATGCCTGCATTTTGGAAAAAAAAATTGAGGATTTAGCCCAGTCGCTTTCCCTTGATATAGCCTT
GTTCTGAATTAAAATGGAAAAAATATTTCAATTATTTTCATCTTGTTCTCAACTGGATGTTAGTCAATGT
GGTCTCTTTTTGAATATGTATCAAATATTAATGATCCATAATATTAGGGAGATAATTTAAATGAAGTGA
TACGTGTCTAACTTACTTAAAGAATAAGTTTTTGGTTTTTGCTTTCAAAGACAACCAAATCTGATATTGT
TCATCCTGATAAAAATAACAACTTTTAGTGCTTAAAGCATTAATTAAGCAAGTGGCTAGGTATGATAAAG
AACTTCTGCTTGCTCCCCAAGAGGCAAACTATTAGAAGAACTGGAGCGGGAGTCCTTTGGACCCATCGTG
GATCTCTTTAAGCCACTGCTACCCAAAAACATTCAGGACAAGCAAACATTTAGAGCAAGAATCTCCAAAT
AATTCTTCAGGATTTGTAATGAAATGATGTTCAGTTCCATTTTGCTCTTTACATAGGGTGGAGAATTGTC
ATGTCTTCTCTAATTTTTCCAAGTAAAGTGGTAGCAAAATGTTTTAAAAAGCAATCTTATATTAGAAAAC
AAAAATGTTGTCACTTGAAATACCAAAACAACATTTCTGAGCGTTGTTGAGGGACTGGCAAAGCAATCAG
CTACTATAACAAATCAGTAGAAATAACCCTCCCACACCAGATATGCATGCAGAAGGAATGGAGTATTATA
GAGACTTGATACAATGGACATATGCACATGGAGGTACAAAACACACAGTCTAAATACAAATGAATTCCAT
CAGATTTACTATACGGAACATCAGTAGTGACAGATTGCACTTCTTACTTAATAACAGCAAACTTAATTTC
TGAGGGGAAAAAAATGGCGAAGTCTTATCCCAAACAAATAGCAAGAGAGGTATCATCAAAGAGCTAAAAT
TTTCTTTGGCATGGTAAAGGGGGAAATTGAGTTTACCAACTTATTTACATGACATTTCTCTATATTGGTG
AGTAATGCAATGCCATTTTGTTACATAAAGTTGTTTGATGTTTTTTAATATGCCTTCATATAAATATTTT
ATTCAATATGTTGTATTTGTGAATTTAACAAATGATATTAAACACAAACTACAATGCAGACAGACAAACT
CTTTGTATGCAAATTAGCAATACATACCAACAGTTCTTGATACACAGGTACCTACTACATGCAGCTCATC
ATTGCTGTCCTCTTCCCATGCTATAGGTGAGACCAGACACAAAGTAAATGACCTAACTCAATTACAAATA
ACAAGGACCCCTCTGCAATATGTCTAAACATATATTAGAAGAAAGTATTTGACATCCTTCATAGGGATAA
ATGCCCTTATAGACACCCCATATATAAAACACAACAGAGATACACATTTACATAAATCTCAGTCATTTAC
AAAAATAAATCTTGTCTTAATTTAAACCAATAAACAGACTTGCAGGGGAAAAAGAAACCAGCAAGTAGGG
CTAATTATCAGTAACAAATAGATGGGGGTGTTTGCTCTGTGTGTGTGTGTGTGTGTGTGTGTGTGTGTAT
ATGTGTGTGTTTGTGTGAAGTGAAGTGTTGCTGCTGTAAGTAGTGTCCATAAGCCCATTTGACTGTATTA
CAAGTTAGTTAATTACTCATATAGTTGGCCACATATTATGGGATCTATGTTTTCTGAAAATAATTGGTTA
ATGGAAGTTATCTAATATATTTTAACTGTTCCTGTTAAAAACAATAGGCTTCAAGATGACATAACACCAA
ATCAAAAATGACCAAAGGAATCATTTTGTTTGTTAGATTTGTAATTTAGCATCATTGGCAATAAATCTAC FIGURE 449 cont'd

```
TCAAACGTTAAAAAAAAAAAAAAAAAAAAAAAAAAAAAAAAAAAAAAAAAAAAAAAAAAAAAAAA
AAAAAAAAAAAAAAAAAAAAAAAAAAAAAAAAAAAAAAAAAAA
```

FIGURE 450
SEQ ID NO: 442
Genbank ID         : AF169689.1
Unigene ID(#167)   : Hs.247734
Unigene name       :        protocadherin alpha 5    PCDHA5
>gi|9587673|gb|AF169689.1|AF169689 Homo sapiens protocadherin alpha 10 alternat
e isoform (PCDH-alpha10) mRNA, complete cds
```
ATGGTTTCCAGATGTAGCTGCCTGGGGGTCCAGTGTCTGCTGCTCTCGCTTCTTCTCCTCGCAGCCTGGG
AGGTGGGGAGCGGCCAGCTCCACTACTCAGTCTACGAGGAGGCCAGACACGGCACCTTCGTGGGCCGCAT
CGCGCAGGACCTGGGGCTGGAGCTGGCGGAGCTGGTGCAGCGCCTGTTCCGGGTGGCGTCCAAAAGACAC
GGGGACCTTCTGGAGGTAAATCTGCAGAATGGCATTTTGTTTGTGAATTCTCGGATTGACCGCGAGGAGC
TGTGCGGGCGGAGCGTGGAGTGCAGCATCCACCTGGAGGTGATCGTGGACAGGCCGCTGCAGGTTTTCCA
TGTGGACGTGGAAGTGAAGGACATTAACGACAACCCGCCCAGGTTCTCCGTAACAGAACAAAAGCTCTCA
ATACCTGAATCCAGACTGCTTGACTCTCGATTTCCACTAGAAGGCGCATCTGATGCGGATGTTGGAGAGA
ACGCATTGCTTACTTACAAACTCAGTCCAAATGAGTATTTTGTTCTTGATATTATAAACAAAAAGACAA
AGACAAATTCCCAGTGCTTGTTCTGCGAAGCTGCTGGATCGTGAAGAAAATCCTCAGCTAAAGTTGTTG
TTGACAGCAACTGATGGAGGCAAACCTGAATTTACCGGATCTGTTTCTCTGCTGATCCTGGTGTTAGATG
CCAATGATAACGCCCCTATCTTTGACAGACCGGTTTATGAAGTTAAGATGTATGAAAATCAAGTGAACCA
AACATTAGTAATACGGCTCAACGCTTCTGATTCGGATGAAGGAATAAACAAGGAAATGATGTATTCATTT
AGCTCTTTGGTCCCACCCACGATAAGAAGGAAATTTTGGATAAACGAAAGGACGGGAGAAATAAAAGTAA
ATGATGCTATTGACTTTGAGGACAGTAACACTTATGAAATTCATGTAGATGTTACAGATAAGGGAAACCC
ACCTATGGTTGGTCACTGCACGGTCCTAGTGGAACTACTGGATGAAAATGATAATTCACCTGAGGTGATT
GTCACTTCTCTGTCTCTCCCAGTGAAAGAAGATGCTCAAGTGGGCACCGTCATTGCCCTAATCAGCGTTT
CTGACCATGATTCAGGAGCCAACGGACAGGTCACCTGCTCTCTGACGCCTCACGTTCCGTTCAAGCTGGT
GTCCACCTACAAGAATTACTACTCATTGGTGCTGGACAGCGCTCTGGACCGCGAGAGGGTGTCGGCCTAT
GAGCTGGTGGTGACCGCCGCGGACCGGGGCTCGCCTCCGCTGTGGGCCACGGCCAGGGTGTCTGTGGAGG
TGGCCGACGTGAACGACAACGCGCCTGCGTTCGCCAGTCCGAGTACACGGTGTTCGTGAAGGAGAACAA
CCCGCCAGGCTGCCACATCTTCACGGTGTCTGCGTGGGACGCGGACGCGCAGGAGAACGCCCTGGTGTCC
TACTCGCTGGTGGAGCGGCGGTTGGGCGAGCGCTCGCTGTCGAGCTACGTGTCGGTGCACGCGGAGAGCG
GCAAGGTGTACGCGCTGCAGCCGCTGGACCACGAGGAGCTGGAGCTGCTACAGTTCCAGCCACGACAGCC
CAACCCTGACTGGCGTTACTCTGCCTCCCTGAGAGCAGGCATGCACAGCTCTGTGCACCTAGAGGAGGCT
GGCATTCTACGGGCTGGTCCAGGAGGGCCTGATCAGCAGTGGCCAACAGTATCCAGTGCAACACCAGAAC
CAGAGGCAGGAGAAGTGTCCCCTCCAGTCGGTGCGGGTGTCAACAGCAACAGCTGGACCTTTAAATACGG
ACCAGGCAACCCCAAACAATCCGGTCCCGGTGAGTTGCCCGACAAATTCATTATCCCAGGATCTCCTGCA
ATCATCTCCATCCGGCAGGAGCCTACTAACAGCCAAATTGACAAAAGTGACTTCATAACCTTCGGCAAAA
AGGAGGAGACCAAGAAAAAGAAGAAAAAGAAGAAGGGTAACAAGACCCAGGAGAAAAAAGAGAAAGGGAA
CAGCACGACTGACAACAGTGACCAGTGAGGTCCTCAAATGGAAACAAGCCACTTAGCCAGTTTTTGTAAT
AATGGCAAATCTCTCCCATGTAGCAATTCCCTGCTCCTTTTTCCTATCTACATGAGCCCTCTTAGAGACC
TCAGAAATCTGCAGAAAGTTCCCTGTGTCTG
```

FIGURE 451
SEQ ID NO: 443
Genbank ID         : D59759
Unigene ID(#167)   : acc_D59759
Unigene name       :
>gi|960865|gb|D59759.1|D59759 HUM064A12A Clontech human fetal brain polyA+ mRNA
 (#6535) Homo sapiens cDNA clone GEN-064A12 3', mRNA sequence
```
GTTAGTATGGTTTTATATTTTATCAAAATAACAGAAAAGCAAATTTTTAAATACTAACCTCAATCCCCTT
AACTCTTAAGATTATAATGAAATATGAAAACTCAGCTTCTAAACTGACATAGTATTAAGTTACAGTANAC
ATTTACATTTCTATTTTTCAAATGTAATGTCTTTTACAATTAGACTGATTTCTATTAACGATTCCTTCAA
ATTAATGAGAAAATTTGCATMTGCTTATATTACTTATCCTGAAATCTAATAGAAACTCAGAAGCATTCAA
TATGATCAAGACTTAAAAGTAAGAATGAACTAAAGABTAAAATACTTGGATGCATTTATACCAGGAAAAT
ATATCNGCTAYTCCACCCAAAMTTTCACTGAATAATATAAAGCAGAAGACTATHCAAAATGAGGTTAGCT
```

FIGURE 451 cont'd

CTACTAGGTACCTTAAGGGTCTAATTAG

FIGURE 452
SEQ ID NO: 444
Genbank ID        : AB018009.1
Unigene ID(#167)  : Hs.184601
Unigene name      :     solute    carrier    family    7    (cationic    amino    acid transporter, y+ system), member 5    SLC7A5
>gi|5926731|dbj|AB018009.1|   Homo    sapiens    mRNA    for    L-type    amino    acid transporter
1, complete cds
CGGCGCGCACACTGCTCGCTGGGCCGCGGCTCCCGGGTGTCCCAGGCCCGGCCGGTGCGCAGAGCATGGC
GGGTGCGGGCCCGAAGCGGCGCGCGCTAGCGGCGCCGGCGGCCGAGGAGAAGGAAGAGGCGCGGGAGAAG
ATGCTGGCCGCCAAGAGCGCGGACGGCTCGGCGCCGGCAGGCGAGGGCGAGGGCGTGACCCTGCAGCGGA
ACATCACGCTGCTCAACGGCGTGGCCATCATCGTGGGGACCATTATCGGCTCGGGCATCTTCGTGACGCC
CACGGGCGTGCTCAAGGAGGCAGGCTCGCCGGGGCTGGCGCTGGTGGTGTGGGCCGCGTGCGGCGTCTTC
TCCATCGTGGGCGCGCTCTGCTACGCGGAGCTCGGCACCACCATCTCCAAATCGGGCGGCGACTACGCCT
ACATGCTGGAGGTCTACGGCTCGCTGCCCGCCTTCCTCAAGCTCTGGATCGAGCTGCTCATCATCCGGCC
TTCATCGCAGTACATCGTGGCCCTGGTCTTCGCCACCTACCTGCTCAAGCCGCTCTTCCCCACCTGCCCG
GTGCCCGAGGAGGCAGCCAAGCTCGTGGCCTGCCTCTGCGTGCTGCTGCTCACGGCCGTGAACTGCTACA
GCGTGAAGGCCGCCACCCGGGTCCAGGATGCCTTTGCCGCCGCCAAGCTCCTGGCCCTGGCCCTGATCAT
CCTGCTGGGCTTCGTCCAGATCGGGAAGGGTGATGTGTCCAATCTAGATCCCAACTTCTCATTTGAAGGC
ACCAAACTGGATGTGGGGAACATTGTGCTGGCATTATACAGCGGCCTCTTTGCCTATGGAGGATGGAATT
ACTTGAATTTCGTCACAGAGGAAATGATCAACCCCTACAGAAACCTGCCCCTGGCCATCATCATCTCCCT
GCCCATCGTGACGCTGGTGTACGTGCTGACCAACCTGGCCTACTTCACCACCCTGTCCACCGAGCAGATG
CTGTCGTCCGAGGCCGTGGCCGTGGACTTCGGGAACTATCACCTGGGCGTCATGTCCTGGATCATCCCCG
TCTTCGTGGGCCTGTCCTGCTTCGGCTCCGTCAATGGGTCCCTGTTCACATCCTCCAGGCTCTTCTTCGT
GGGGTCCCGGGAAGGCCACCTGCCCTCCATCCTCTCCATGATCCACCCACAGCTCCTCACCCCCGTGCCG
TCCCTCGTGTTCACGTGTGTGATGACGCTGCTCTACGCCTTCTCCAAGGACATCTTCTCCGTCATCAACT
TCTTCAGCTTCTTCAACTGGCTCTGCGTGGCCCTGGCCATCATCGGCATGATCTGGCTGCGCCACAGAAA
GCCTGAGCTTGAGCGGCCCATCAAGGTGAACCTGGCCCTGCCTGTGTTCTTCATCCTGGCCTGCCTCTTC
CTGATCGCCGTCTCCTTCTGGAAGACACCCGTGGAGTGTGGCATCGGCTTCACCATCATCCTCAGCGGGC
TGCCCGTCTACTTCTTCGGGGTCTGGTGGAAAAACAAGCCCAAGTGGCTCCTCCAGGGCATCTTCTCCAC
GACCGTCCTGTGTCAGAAGCTCATGCAGGTGGTCCCCCAGGAGACATAGCCAGGAGGCCGAGTGGCTGCC
GGAGGAGCATGCGCAGAGGCCAGTTAAAGTAGATCACCTCCTCGAACCCACTCCGGTTCCCCGCAACCCA
CAGCTCAGCTGCCCATCCCAGTCCCTCGCCGTCCCTCCCAGGTCGGGCAGTGGAGGCTGCTGTGAAAACT
CTGGTACGAATCTCATCCCTCAACTGAGGGCCAGGGACCCAGGTGTGCCTGTGCTCCTGCCCAGGAGCAG
CTTTTGGTCTCCTTGGGCCCTTTTTCCCTTCCCTCCTTTGTTTACTTATATATATATTTTTTTTAAACTT
AAATTTTGGGTCAACTTGACACCACTAAGATGATTTTTAAGGAGCTGGGGGAAGGCAGGAGCCTTCCTT
TCTCCTGCCCCAAGGGCCCAGACCCTGGGCAAACAGAGCTACTGAGACTTGGAACCTCATTGCTACGACA
GACTTGCACTGAAGCCGGACAGCTGCCCAGACACATGGGCTTGTGACATTCGTGAAAACCAACCCTGTGG
GCTTATGTCTCTGCCTTAGGGTTTGCAGAGTGGAAACTCAGCCGTAGGGTGGCACTGGGAGGGGTGGGG
GATCTGGGCAAGGTGGGTGATTCCTCCCAGGAGGTGCTTGAGGCCCCGATGGACTCCTGACCATAATCCT
AGCCCGAGACACCATCCTGAGCCAGGGAACAGCCCCAGGGTTGGGGGTGCCGGCATCTCCCCTAGCTC
ACCAGGCCTGGCCTCTGGGCAGTGTGGCCTCTTGGCTATTTCTGTTCCAGTTTTGGAGGCTGAGTTCTGG
TTCATGCAGACAAAGCCCTGTCCTTCAGTCTTCTAGAAACAGAGACAAGAAAGGCAGCACACCGCGGCC
AGGCACCCATGTGGGCGCCCACCCTGGGCTCCACACAGCAGTGTCCCCTGCCCCAGAGGTCGCAGCTACC
CTCAGCCTCCAATGCATTGGCCTCTGTACCGCCCGGCAGCCCCTTCTGGCCGGTGCTGGGTTCCCACTCC
CGGCCTAGGCACCTCCCCGCTCTCCCTGTCACGCTCATGTCCTGTCCTGGTCCTGATGCCCGTTGTCTAG
GAGACAGAGCCAAGCACTGCTCACGTCTCTGCCGCCTGCGTTTGGAGGCCCCTGGGCTCTCACCCAGTCC
CCACCCGCCTGCAGAGAGGGAACTAGGGCACCCCTTGTTTCTGTTGTTCCCGTGAATTTTTTCGCTATG
GGAGGCAGCCGAGGCCTGGCCAATGCGGCCCACTTTCCTGAGCTGTCGCTGCCTCCATGGCAGCAGCCAA
GGACCCCAGAACAAGAAGACCCCCCGCAGGATCCCTCCTGAGCTCGGGGGGCTCTGCCTTCTCAGGCC
CCGGGCTTCCCTTCTCCCCAGCCAGAGGTGGAGCCAAGTGGTCCAGCGTCACTCCAGTGCTCAGCTGTGG
CTGGAGGAGCTGGCCTGTGGCACAGCCCTGAGTGTCCCAAGCCGGGAGCCAACGAAGCCGGACACGGCTT
CACTGACCAGCGGCTGCTCAAGCCGCCAAGCTCTCAGCAAGTGCCCAGTGGAGCCTGCCGCCCCACCTGG
GCACCGGGACCCCCTCACCATCCAGTGGGCCCGGAGAAACCTGATGAACAGTTTGGGGACTCAGGACCAG
ATGTCCGTCTCTCTTGCTTGAGGAATGAAGACCTTTATTCACCCCTGCCCCGTTGCTTCCCGCTGCACAT
GGACAGACTTCACAGCGTCTGCTCATAGGACCTGCATCCTTCCTGGGGACGAATTCCACTCGTCCAAGGG
ACAGCCCACGGTCTGGAGGCCGAGGACCACCAGCAGGCAGGTGGACTGACTGTGTTGGGCAAGACCTCTT

FIGURE 452 cont'd

```
CCCTCTGGGCCTGTTCTCTTGGCTGCAAATAAGGACAGCAGCTGGTGCCCCACCTGCCTGGTGCATTGCT
GTGTGAATCCAGGAGGCAGTGGACATCGTAGGCAGCCACGGCCCCGGGTCCAGGAGAAGTGCTCCCTGGA
GGCACGCACCACTGCTTCCCACTGGGGCCGGCGGGGCCCACGCACGACGTCAGCCTCTTACCTTCCCGCC
TCGGCTAGGGGTCCTCGGGATGCCGTTCTGTTCCAACCTCCTGCTCTGGGAGGTGGACATGCCTCAAGGA
TACAGGGAGCCGGCGGCCTCTCGACGGCACGCACTTGCCTGTTGGCTGCTGCGGCTGTGGGCGAGCATGG
GGGCTGCCAGCGTCTGTTGTGGAAAGTAGCTGCTAGTGAAATGGCTGGGGCCGCTGGGGTCCGTCTTCAC
ACTGCGCAGGTCTCTTCTGGGCGTCTGAGCTGGGGTGGGAGCTCCTCCGCAGAAGGTTGGTGGGGGGTCC
AGTCTGTGATCCTTGGTGCTGTGTGCCCCACTCCAGCCTGGGGACCCCACTTCAGAAGGTAGGGGCCGTG
TCCCGCGGTGCTGACTGAGGCCTGCTTCCCCCTCCCCCTCCTGCTGTGCTGGAATTCCACAGGGACCAGG
GCCACCGCAGGGGACTGTCTCAGAAGACTTGATTTTTCCGTCCCTTTTTCTCCACACTCCACTGACAAAC
GTCCCCAGCGGTTTCCACTTGTGGGCTTCAGGTGTTTTCAAGCACAACCCACCACAACAAGCAAGTGCAT
TTTCAGTCGTTGTGCTTTTTTGTTTTGTGCTAACGTCTTACTAATTTAAAGATGCTGTCGGCACCATGTT
TATTTATTTCCAGTGGTCATGCTCAGCCTTGCTGCTCTGCGTGGCGCAGGTGCCATGCCTGCTCCCTGTC
TGTGTCCCAGCCACGCAGGGCCATCCACTGTGACGTCGGCCGACCAGGCTGGACACCCTCTGCCGAGTAA
TGACGTGTGTGGCTGGGACCTTCTTTATTCTGTGTTAATGGCTAACCTGTTACACTGGGCTGGGTTGGGT
AGGGTGTTCTGGCTTTTTTGTGGGGTTTTTATTTTTAAAGAAACACTCAATCATCCTAG
```

FIGURE 453
SEQ ID NO: 445
Genbank ID         : AI284184
Unigene ID(#167)   : Hs.388917
Unigene name       :    ATP-binding cassette, sub-family A (ABC1), member 9
      ABCA9
>gi|3922417|gb|AI284184.1|AI284184 qi26f06.x1 Soares_NhHMPu_S1 Homo sapiens cDN
A clone IMAGE:1857635 3' similar to TR:Q92473 Q92473 ABC-C TRANSPORTER. [1]
;,
mRNA sequence
```
AACTTTAAGAAGCGAACTTTTGCTATTGCACATACCTGCTGCCTCCAAAGCGCCACGCCACTGATTGTTT
TCCTTGTTTCGTGGAAGGAAGACAAAACTTGTTCCAGCTCAACAAGGCTTCCTATATCTTTTGCCCCATC
AGTTTGTAATTGTCCCCAAATTCCAATATCTGATTCATCAATAGTTGATTTTCCTTCTAATTTCAGAAAC
ACCTCATTCAAAGTTGTTATGGAAACACCATAATCCTCAATGCCTTGGTTAGAACATCTATCAAGATCCC
TGTTAAGTTCTGGAAATTTGTTTGTCCTTTCCAAAGGCAAAATATATACAAGTTCTTCTTCACTTTGAGC
TGTCAATTTGGCATCAGAGATGTGCTGCTTAACCAGTGATGTTATACTCTCTGGATCACACCTTTCATTC
AGATGCAAACTTAAATGGTAGCCTATGCCCCATTT
```

FIGURE 454
SEQ ID NO: 446
Genbank ID         : AU145289
Unigene ID(#167)   : Hs.193223
Unigene name       :    CDNA FLJ11646 fis, clone HEMBA1004394.
>gi|11006810|gb|AU145289.1|AU145289 AU145289 HEMBA1 Homo sapiens cDNA clone HEM
BA1004394 3', mRNA sequence
```
GGCCCTCCTTACACTTTGGAGACTCTTCCCTTATGTGAAATTTTATAAAGAATGAAATCTGAAGGAGGTG
GGAGAGGGTATGTCCGGGCCCCATCTCCTTGGTGTTCCCTTCTTATGCCATAATTTCTCCTTGGCCTCA
GAGGCACCTTTACTGCAGGTGAGGGCTCTTTCAAGCCCAGATGGAGCCTCAATGGCCTGGGTGACACCCA
AGGTCTCTCTAGACTCTTATGTTCTACCTGTCTTTCTGAAAGCCCCATGGAGTGGGAGGACAGCCATGA
CATAGTAAGAAAAGGAGAATTCCCTAGCACCTGACTGAAAAAAAATAACTGGGAAGAGAGAGACAGTGACAAT
ACACAATACACATGACCTCACGTACATGGAGCACGGTGACCATGAACTGTAACATTAAGTATCACCTCAG
AAGCATTCCAAACCTGGGTGACTGANCGCCCCAGTAGATGANGAGGAGCAGGAAGGCTTGTGTGGATGTT
CACACACCGGCCCAACTTCCCCAAGAAGATAAGCNCTCATGGGAAAATCAGAGAGACTGNNGAACTCAAA
TCCCTGGGATTCCCGGAATGGGCACCTNTTG
```

FIGURE 455
SEQ ID NO: 447
Genbank ID         : BF449063

FIGURE 455 cont'd

Unigene ID(#167) : Hs.512555
Unigene name : collagen, type XIV, alpha 1 (undulin) COL14A1
>gi|11515232|gb|BF449063.1|BF449063 7o64f12.x1 NCI_CGAP_Pr28 Homo sapiens cDNA
clone IMAGE:3579023 3', mRNA sequence
GTTTTAAAGTTTTATTTGCTTACAAAAGAAAATGGAAATAGGTTTGCGAAAACTTATCTGCATGTACAAA
GTAATCCCCGTAGATAAGGAGAGGCAACCCCTGGAACAAACTGCTGGATAAATCGTTCATTAAAATTATA
TCTCTTTGCATCAGAGCTGGTGGAAAATCATTATTTCACATGAGTTAAAACCACTGAAAAACTAAATCTG
TTTCTTAAACTACCAAATTTCAGAAAAGCTTAAATCCAAATGCTGATTTTTGGATACACATGAAACCAGT
TACCAAGTGATCTCAGAGTTGGACAGATCAATTAAACAAGAGGTAGTTTCTCCAATATTGTCCCTTTTTT
TCTTATCAGCAAGGTTATTCCTATAGCAAGTAGGAGTAAGTGACATATTCTTTGAACCTCTTTGAATTCT
TTTCCTGCTAGGGACATATTTCCCTCAAACACAATCATATCTGTTTGTTCATTTTAGGACTTGAGAGAGA
AGATTCCAGAGTTCAATTTATTTTTCCCAATTCCTCTTTGAGCTCTCTTCTCTGGAAAAACA

FIGURE 456
SEQ ID NO: 448
Genbank ID : AI693516
Unigene ID(#167) : Hs.28625
Unigene name : Transcribed sequences
>gi|4970856|gb|AI693516.1|AI693516 wd43e03.x1 Soares_NFL_T_GBC_S1 Homo sapiens
cDNA clone IMAGE:2330908 3', mRNA sequence
TTTATTTTTTTGAAATGATTTATTACTTTTAGAAAACAGTATAAACTTACAAACTATAAATTAAGATAT
AAGTATATTTCTGCCAAAGTAAGTCAAGAAAAATGCACTTCAGAATCAGCTTTTATTACAGGCAATGTAT
TGTAAACTCGAACATCCAGAATCTGAGTTACACTTATTATTTTTAACATTTTACTCAATAAAAATCTGAT
ATACTGGGTCCAAGTGATGACACATTCCAAATTAATGTAACTTTCTTGCAGCTTAAATAAACAAATTTAG
ATCACCAAGTGAAATCAAAGCCAAGTGTATTTGCACAACTCAAGAATGATGTGAATGGATTAGAATCTCT
CATAGTGCATACTTCGCCATTTATACACAAACTTTGAGAGTCTTCTGAGTGACATGGTATTTAACTTTGT
TTCCAAGGGCCAAATACTAAAATGTATAGAATATCCTACTCTATACTCACTATTAAATGTCATGGACTAG
GAAATCTGAGACACAGAATAAGAAGCAACTGATTACACACCCTAGTCATTTAAGTTGGAAGAGTTCTC

FIGURE 457
SEQ ID NO: 449
Genbank ID : AI732794
Unigene ID(#167) : acc_AI732794
Unigene name :
>gi|5053907|gb|AI732794.1|AI732794 ab14h11.x5 Stratagene lung (#937210) Homo sa
piens cDNA clone IMAGE:840837 3', mRNA sequence
TAACTTATTTATAGGCCTTTCCTGATGCCAAATAAGGGCAATGATCAGCTTCCCCATTCCTGGAGCCAGG
ACCTGCCACATCATTTGCAGTGCAAAATGCAAATGAGAGCCCCTTGTTCAAAGAGCAAGATAAAAGTGCC
ATCCTAGGCGCTCAAAATACAAAGGTTCCTCCTTTCTTCTATGGTCTGTCAATTGGTCAAGGCATTTTAA
TTTGCTACTTAATGTCATGCTTGCTGGGCACTGGAATACTCATGCGGTGAGTGTAGGATCCCACGGGTAT
CTGGAGGCTCGCCCTGCAATTTAGCATGTGCAAGGAGCTCCCCACCTCTGCCAGCCCAGGATGGGCGTGT
GATGCCCTGGCTGGGGTGAGTGAGGTTGAGCCAGGTATCTCTGTGTCTCATGGGCCCAACCGACACGGGA
GAGAAGACAATCCCCATGGGACTGCAACCTTTGAACTGGGACACATGAGGCCTCTGGGTTAGGGTCGGG
GAGAGGCTCGTNCCCCTGCCCAGCCACCCACTGCATGTGCCCTTGTGCTGTCAGCTTGNGGCANAACGCG
GGTGCCATGTCTGGGCCTGTGAGCCCTGTCCTGACCTGGCATGCACCCATGCCCTCCTGGGGTGCTGGGT
AGCAGCAGNTACTGTGTAGGGTGGAACAGGGCAAGNCCAGTTGGGCCCAGGCAGCAGGCTTGAGCTTGCA
GCTGANAAGGACCATGGGAGCCAAGCTCTGAGCCCAGCAGATGCTCATCATCCCATTGACTTACCTCGTG
CCGAAT

FIGURE 458
SEQ ID NO: 450
Genbank ID : J00269.1
Unigene ID(#167) : Hs.367762
Unigene name : keratin 6A KRT6A

FIGURE 458 cont'd

>gi|186699|gb|J00269.1|HUMKER56K Human 56k cytoskeletal type II keratin
mRNA
CAGAACCTGGAGCCGTTGTTCGAGCAGTACATCAACAACCTCAGGAGGCAGCTGGACAGCATTGTCGGGG
AACGGGGCCGCCTGGACTCAGAGCTCAGAGGCATGCAGGACCTGGTGGAGGACTTCAAGAACAAATATGA
GGATGAAATCAACAAGCGCACAGCAGCAGAGAATGAATTTGTGACTCTGAAGAAGGATGTGGATGCTGCC
TACATGAACAAGGTTGAACTGCAAGCCAAGGCAGACACTCTCACAGACGAGATCAACTTCCTGAGAGCCT
TGTATGATGCAGAGCTGTCCCAGATGCAGACCCACATCTCAGACACATCTGTGGTGCTGTCCATGGACAA
CAACCGCAACCTGGACCTGGACAGCATCATCGCTGAGGTCAAGGCCCAATATGAGGAGATTGCTCAGAGA
AGCCGGGCTGAGGCTGAGTCCTGGTACCAGACCAAGTACGAGGAGCTGCAGGTCACAGCAGGCAGACATG
GGGACGACCTGCGCAACACCAAGCAGGAGATTGCTGAGATCAACCGCATGATCCAGAGGCTGAGATCTGA
GAGCGACCACGTCAAGAAGCAGTGCGCCAACCTGCAGGCCGCCATTGCTGATGCTGAGCAGCGTGGGGAG
ATGGCCCTCAAGGATGCCAAGAACAAGCTGGAAGGGCTGGAGGATGCCCTGCAGAAGGCCAAGCAGGACC
TGGCCCGGCTGCTGAAGGAGTACCAGGAGCTGATGAATGTCAAGCTGGCCCTGGACGTGGAGATCGCCAC
CTACCGCAAGCTGCTGGAGGGTGAGGAGTGCAGGCTGAATGGCGAAGGCGTTGGACAAGTCAACATCTCT
GTGGTGCAGTCCACCGTCTCCAGTGGCTATGGCGGTGCCAGTGGTGTCGGCAGTGGCTTAGGCCTGGGTG
GAGGAAGCAGCTACTCCTATGGCAGTGGTCTTGGCGTTGGAGGTGGCTTCAGTTCCAGCAGTGGCAGAGC
CATTGGGGGTGGCCTCAGCTCTGTTGGAGGCGGCAGTTCCACCATCAAGTACACCACCACCTCCTCCTCC
AGCAGGAAGAGCTATAAGCACTAAAGTGCGTCTGCTAGCTCTCGGTCCCACAGTCCTCAGGCCCCTCTCT
GGCTGCAGAGCCCTCTCCTCAGGTTGCCTGTCCTCTCCTGGCCTCCAGTCTCCCCTGCTGTCCCAGGTAG
AGCTGGGGATGAATGCTTAGTGCCCTCACTTCTTCTCTCTCTCTATACCATCTGAGCACCCATTGCTC
ACCATCAGATCAACCTCTGATTTTACATCATGATGTAATCACCACTGGAGCTTCACTGTTACTAAATTAT
TAATTTCTTGCCTCCAGTGTTCTATCTCTGAGGCTGAGCATTATAAGAAAATGACCTCTGCTCCTTTTCA
TTGCAGAAAATTGCCAGGGGCTTATTTCAGAACAACTTCCACTTACTTTCCACTGGCTCTCAAACTCTCT
AACTTATAAGTGTTGTGAACCCCCACCCAGGCAGTATCCATGAAAGCACAAGTGACTAGTCCTATGATGT
ACAAAGCCTGTATCTCTGTGATGATTTCTGTGCTCTTCACTCTTTGCAATTGCTAAATAAAGCAGATTTA
TAATACA

FIGURE 459
SEQ ID NO: 452
Genbank ID        : BG028463
Unigene ID(#167)  : Hs.163734
Unigene name      :       Transcribed sequences
>gi|12417557|gb|BG028463.1|BG028463    602294372F1    NIH_MGC_86    Homo sapiens
cDNA cl
one IMAGE:4389352 5', mRNA sequence
GCGAGAGAAAACCACGTGCACCAAACTTTAGGGGAGGAAAAATGGGAACGTGGGGAGAAGACGTGAGGCG
GCAGATCTGAAAAAGATGGTCATTCCGGACTCCTGACGCCGCCAGTCCCGCGGTGAGACGTGAGCGCCAT
TGGCGTCCGTGGCCTCTGTTTCCGTGGCAACCTAGTAACCATTAATTTTCAATTAAAGGAGACAAAAAGC
TCGATGACAGCTCCAGGTCTGCTGAAGATGTCAAGAATCTGTATTAATATACAGCAAGAGAGCATAATTG
TGTGTCCATCTTCCAGAGCAGCGAAAAATGGAGGGATAATTACCAGCTCGAAAGCCACTCTGTAATTTAG
TTCTTACTGTCACCACAGCCCTACACATTAGCATAAATTAAAAGCAGAGTTTATTGTTATCAAAGTGCAA
AAAAAAAAAAAAG

FIGURE 460
SEQ ID NO: 452
Genbank ID        : BF672975
Unigene ID(#167)  : Hs.180878
Unigene name      :       lipoprotein lipase       LPL
>gi|11946870|gb|BF672975.1|BF672975    602152854F1    NIH_MGC_81    Homo sapiens
cDNA cl
one IMAGE:4294021 5', mRNA sequence
TAGTGGCCAAATAGCACATCCTCCAACGTTAAAAGACAGTGGATCATGAAAAGTGCTGTTTGTCCTTTGA
GAAAGAAATAATGTTTGAGCGCAGAGTAAAATAAGGCTCCTTCATGTGGCGTATGGGCCATAGCCTATAA
TGGTTAGAACCTCCTATTTTAATGGAATTCTGGATCTTTCGGACTGAGGCCTTCTCAAACTTTACTCTAA
GTCTCCAAGAATACAGAAAATGCTTTTCCGCGGCACGAATCAGACTCATCTACACAGCAGTATGAATGAT
GTTTTAGAATGATTCCCTCTTGCTATTGGAATGTGGTCCAGACGTCAACCAGGAACATGTCACTTGGAGA
GGGACGAAGAAAGGGTCTGATAAACACAGAGGTTTTAAACAGTCCCTACCATTGGCCTGCATCATGACAA
AGTTACAAATTCAAGGGAGATATAAAATCTAGATCAATTAATTCTTAATAGGCTTTATCGTTTATGCTTA FIGURE 460 cont'd ATCCCTCTCTCCCCCTTCTTTTTGTCTCAAGATTATATTATAATAATGTTCTCTGGGTAGGTGTTGAAAA
ATGAGCCTGTAATCCTCAAGCTGACACGTAATTTGAACTGGTGCAGAACAAACAAAAAGGATTACGGGA
ATTTATTTATTAGGATTCTCCCAAATGATTTTCATCCAATTTAAAATCATTCCAATATCTGGCAGGTACC
TTCAGGTTTAGGGCTTACTTGGGCAGCCTCAGTGGACATCCAGGGGGCTCCTG

FIGURE 461
SEQ ID NO: 453
Genbank ID      : BE858808
Unigene ID(#167) : Hs.52463
Unigene name    :       inositol polyphosphate-5-phosphatase F    INPP5F
>gi|10374225|gb|BE858808.1|BE858808  7f95h05.x1 NCI_CGAP_Brn23 Homo sapiens cDNA
  clone IMAGE:3304761 3' similar to TR:Q9Y2H2 Q9Y2H2 KIAA0966 PROTEIN. ;, mRNA s
equence
CAGTAAGATCTTGTATCATGTATTTATTCCAAAAAAATCGGTCATCAACCTAGAAAAGGTGCAGGAACAA
TAGTTCAGAAACACATTATTTCAGTTTTCCTACAAAAGCCAAAACAGGCCATCACTTCTTCCCAAGGGCA
AACCCTGCTCTACGAGCTGTGAGTGGTACCTTCTGCCAGAGGGCCGACCGTCCCTCTCCCAGTGCTCT
GCCTCTGCACGGAATTGGTCAGGTCATAGGTCAAGCTATAATAAAAGGATTCTGAGTCCATGAACATCTT
CAGCAACTCTTCAAGTAATCTCCTCTCCAACTTCTCCTTCTCTTTACTTTCCTTAACTTTCTTTTTATTA
GGAGCAGACACATTGGATTTAATATGCGTAAAGGTCTTCAGTAGAAACTTTGAGTCATCAGGAGATGGTA
TGATCTTCTCTGGTTTGTTAATACCAAAATGATGCTTCTTACAGAGCTCTAGCTCAAGATCCTGAGGTTC
CATTTCAGAAAGTGAGAGCACAGCAATTNTGGTAACTTTACAGACCTCATGGTCTCCTGGAGTTTGCCCA
CCAATGCTTTCTGCCGGATTAGAATAAGCCACCATGGGAGATCTGAATGAAGTTGAAT

FIGURE 462
SEQ ID NO: 454
Genbank ID      : NM_018402.1
Unigene ID(#167) : Hs.272350
Unigene name    :       interleukin 26    IL26
>gi|8923755|ref|NM_018402.1| Homo sapiens interleukin 26 (IL26), mRNA
CTGTGAGTGACACACGCTGAGTGGGGTGAAGGGAAATGCTGGTGAATTTCATTTTGAGGTGTGGGTTGCT
GTTAGTCACTCTGTCTCTTGCCATTGCCAAGCACAAGCAATCTTCCTTCACCAAAAGTTGTTACCCAAGG
GGAACATTGTCCCAAGCTGTTGACGCTCTCTATATCAAAGCAGCATGGCTCAAAGCAACGATTCCAGAAG
ACCGCATAAAAAATATACGATTATTAAAAAAGAAAACAAAAAAGCAGTTTATGAAAAACTGTCAATTTCA
AGAACAGCTTCTGTCCTTCTTCATGGAAGACGTTTTTGGTCAACTGCAATTGCAAGGCTGCAAGAAAATA
CGCTTTGTGGAGGACTTTCATAGCCTTAGGCAGAAATTGAGCCACTGTATTTCCTGTGCTTCATCAGCTA
GAGAGATGAAATCCATTACCAGGATGAAAAGAATATTTTATAGGATTGGAAACAAAGGAATCTACAAAGC
CATCAGTGAACTGGATATTCTTCTTTCCTGGATTAAAAAATTATTGGAAAGCAGTCAGTAAACCAAAGCC
AAGTACATTGATTTTACAGTTATTTTGAAATACAATAAGAACTGCTAGAAATATGTTTATAACAGTCTAT
TTCTTTTAAAAACTTTTTAACATAATACTGACGGCATGTTAGGTGATTCAGAATAGACAAGAAGGATTTA
GTAAATTAACGTTTTGGATATAAGTTGTCACTAATTTGCACATTTTCTGTGTTTTCAAATAATGTTTCCA
TTCTGAACATGTTTTGTCATTCACAAGTACATTGTGTCAACTTAATTTAAAGTATGTAACCTGAATTAAC
TCGTGTAATATTTGTGTGTGGAGTGGGATGTGGGGGTGGAGGGGGAATGACAGATTTCTGGAATGCAAT
GTAATGTTACTGAGACTTAAATAGATGTTATGTATATGATTGTCTGTTTAAGTGTTTGAAAATTGTTAAT
TATGCCCAGTGTGAACTTAGTACTTAACACATTTTGATTTTAATTAAATAAATTGGGTTTCCTTCTC

FIGURE 463
SEQ ID NO: 455
Genbank ID      : AI348159
Unigene ID(#167) : Hs.76277
Unigene name    :       polyposis locus protein 1-like 1    DP1L1
>gi|4085365|gb|AI348159.1|AI348159  qp57b07.x1 NCI_CGAP_Co8 Homo sapiens cDNA cl
one IMAGE:1927093 3', mRNA sequence
GGTCCGGGTTAGCTTTATTGGAGCCTCCTAGCAGGCCAGGTGTTTCAGGCACCAGTAGTGCTGCAGGCAC
GGGGGCCTGTGGTGTGGCCAGCTGCAGGTGATCTCGGTGGTGGACTCCGAAGTGTACTCCAGAGAGGTCC FIGURE 463 cont'd CGGAATGGCAGGGGACCAGCTCGGGCACTGAGGCGCTGCTGGCAGGCTGTTTCGACGATTCCTTCTGGCG
CTGTCCGCTGGTCTTGGGGGCTGCGTCCTCCGGCTTGCCAGAGGACTTGCTGGGGGGCTGCGTGGGGATG
TTGCTGCTGCTGGGAGACTGGACCATGGGTGGGACCGGGCTGGAGGTGACGTTGGGTGGCTGCAGGGGCC
CCGAGGACGGGAGGGCTGACTGGGAGGGGCCGGAGGAAGTACCAGGCGGCTGGGTGTGTTGCCGAGACCA
GTGGGAGCTGCCCTGTGCCCGACGCTGGCCCTGNG

FIGURE 464
SEQ ID NO: 456
Genbank ID      : NM_018052.1
Unigene ID(#167) : Hs.445061
Unigene name    :       hypothetical protein FLJ10305 FLJ10305
>gi|8922339|ref|NM_018052.1| Homo sapiens hypothetical protein FLJ10305
(FLJ103
05), mRNA
CTACATCAAAACTCCTCGGAAGATGTTCCGGCACACGGACAGCCTCTTTCCCATCCTACTGCAGACGTTA
TCGGATGAATCGGATGAGGTGATCCTGAAGGACCTGGAGGTGCTGGCAGAAATGCTTCCTCCCCCGCAG
GCCAGACGGATGACCCAGGCCCCCTCGATGGCCCTGACCTCCAGGCCAGCCACTCAGAGCTCCAGGTGCC
CACCCCTGGCAGAGCCGGCCTACTGAACACCTCTGGTACCAAAGGCTTAGAATGTTCTCCTTCAACTCCC
ACCATGAATTCTTACTTTTATAAGTTCATGATCAACCTTCTCAAGAGATTCAGCAGCGAATGGAAGCTCC
TGGAGGTCAGAGGCCCTTTCATCATCAGGCAGCTGTGCCTCCTGCTGAATGCGGAGAACATCTTCCACTC
AATGGCAGACATCCTGCTGCGGGAGGAGGACCTCAAGTTCGCCTCGACCATGGTCCACGCCCTCAACACC
ATCCTGCTGACCTCCACAGAGCTCTTCCAGCTAAGGAACCAGCTGAAGGACCTGAAGACCCTGGAGAGCC
AGAACCTGTTCTGCTGCCTGTACCGCTCCTGGTGCCACAACCCAGTCACCACGGTGTCCCTCTGCTTCCT
CACCCAGAACTACCGGCACGCCTATGACCTCATCCAGAAGTTTGGGGACCTGGAGGTCACCGTGGACTTC
CTCGCAGAGGTGGACAAGCTGGTGCAGCTGATTGAGTGCCCCATCTTCACATATCTGCGCCTGCAGCTGC
TGGACGTGAAGAACAACCCCTACCTGATCAAGGCCCTCTACGGCCTGCTCATGCTCCTGCCTCAGAGCAG
CGCCTTCCAGCTGCTCTCGCACCGGCTCCAGTGCGTGCCCAACCCTGAGCTGCTGCAGACCGAAGACAGT
CTAAAGGCAGCCCCCAAGTCCCAGAAAGCTGACTCCCCTAGCATCGACTACGCAGAGCTGCTGCAGCACT
TTGAGAAGGTCCAGAACAAGCACCTGGAAGTGCGGCACCAGCGGAGCGGGCGTGGGGACCACCTGGACCG
GAGGGTTGTCCTCTGACAGGCCTGGCACGGAGGAGGGCCCACCGAGTGGTCCCATGAAACACTAAGGGTC
GTCACGCCCTCCCGAGGAGCTCAAGGACCTGCCTGTCAGGACCAGGGCTGGGCCTGCCAACCCAGGGCAG
TGTTGGGGCCGGAGGCTGCTGTGTCTGCCCAAGCTCCTCTCAGAGTCCAGTCCCCAGGCCTCCAGCGCTG
TCAGCTGCACCCTGGCATTCTCACAGAGCTGGCTGCCCACCCAGTGGGGGGCTATAGCCTCAGAGACCAC
TCATCCTCTGGAATCAACCTCTTTCTAATACCCTCTTGGAAAAAGAGCTTGCCCCTCCTCCAGCACACTA
GAGCTCTGGCCTTGTGTGTATATGTATACATACGTGAACACATGCCTGTGTGTGTGTGTGTGTGTGTGTA
CTTGTATGCACGTAGGCACCAGCACAAAGATCTGAATGATGCACCCCACCCCCACCCCAATAAAGAAATA
ACAGAAAACCCTC

FIGURE 465
SEQ ID NO: 457
Genbank ID        : NM_003834.1
Unigene ID(#167) : Hs.65756
Unigene name      :      regulator of G-protein signalling 11     RGS11
>gi|4506506|ref|NM_003834.1| Homo sapiens regulator of G-protein signalling
11
(RGS11), transcript variant 2, mRNA
GCCATGGCCGCCGGCCCCGCGCCGCCCCCGGCCGCCCCGGGCGCAGATGCCGCATCTGAGGAAGGTGC
GAGGCGGATGGAGCGGGTGGTCGTGAGCATGCAGGACCCCGACCAGGGCGTGAAGATGCGGAGCCAGCGC
CTGCTGGTCACCGTCATTCCCCACGCGGTGACAGGCAGCGACGTCGTGCAGTGGTTGGCCCAGAAGTTCT
GCGTCTCGGAGGAGGAGGCCCTGCACCTGGGCGCCGTCCTGGTGCAGCATGGCTACATCTACCCGCTGCG
CGACCCCCGTAGCCTCATGCTCCGGCCAGACGAGACGCCCTACAGGTTCCAGACCCCGTACTTCTGGACA
AGTACCCTGAGGCCGGCTGCAGAGCTGGACTATGCCATCTACCTGGCCAAGAAGAACATCCGAAAACGGG
GGACCCTGGTGGATTATGAGAAGGACTGCTATGACCGGCTACACAAGAAGATCAACCACGCATGGGACCT
GGTGCTGATGCAGGCGAGGGAGCAGCTGAGGGCAGCCAAGCAGCGCAGCAAGGGGGACAGGCTGGTCATT
GCGTGCCAGGAGCAGACCTACTGGCTGGTGAACAGGCCCCGCCCGGGGCCCCGATGTGCTGGAGCAGG
GTCCAGGGCGGGGATCCTGCGCTGCCAGCCGTGTGCTCATGACCAAGAGTGCAGATTTCCATAAGCGGGA
GATCGAGTACTTCAGGAAAGCGCTGGGCAGGACCCGAGTGAAGTCCTCCGTCTGCCTTGAGGCGTACCTG
AGTTTCTGCGGCCAGCGTGGACCCCACGATCCCCTCGTGTCGGGGTGCCTGCCCAGCAATCCCTGGATCT

FIGURE 465 cont'd

```
CAGACAATGACGCCTACTGGGTCATGAATGCCCCCACGGTGGCTGCCCCCACGAAGCTCCGTGTGGAGAG
ATGGGGCTTCAGCTTCCGGGAGCTCCTGGAGGACCCCGTGGGGCGGGCCCACTTCATGGACTTTCTGGGA
AAGGAGTTCAGTGGAGAAAACCTCAGCTTCTGGGAGGCATGTGAGGAGCTTCGATATGGAGCGCAGGCCC
AGGTCCCCACCCTGGTGGATGCCGTGTACGAGCAGTTCCTGGCCCCCGGAGCTGCCCACTGGGTCAACAT
CGACAGCCGGACCATGGAGCAGACCCTGGAGGGGCTGCGCCAGCCCCACCGCTATGTCCTGGATGACGCC
CAGCTGCACATATACATGCTCATGAAGAAGGACTCCTACCCAAGGTTCCTGAAGTCTGACATGTACAAGG
CCCTCCTGGCAGAGGCTGGATCCCGCTGGAGATGAAGAGACGCGTGTTCCCGTTTACGTGGAGGCCACG
GCACTCGAGCCCCAGCCCTGCACTCCTTCCCACCCCTGTGGAGCCCACAGCGGCTTGTGGCCCTGGGGGT
GGAGATGGGGTGGCCTAGTGGACCTGGCCCATCTGCCACTCTAGTCCCTGCAGCTCAACGTCCTGCGTGA
ATGCAGCAGCCACCCCCGTCTTGGCCCAGGTCCTGGGGGCTGCTGAACCCAGCACCAGTGTCCCCTTGTG
CCCAGGGGGCCCAGTCTTCTGTGGGGTGCACAGCCTCCCTCCCTCCAGCAAGCCCTCCCTGCCCAGAAGG
AATGGGTCCAGGTGTGGATTCCCAGGGAGGGGGTTCATTGGCTCAGCTTGGGTCAGGGCAGAGCCTGTTA
CCTGAAGAGAGGTGAGACCAAGGCCACAGGGAGCTCCACCTTCTCTGGTCTTCAGTCCAGCACTGGGTGC
CCATCCCCATCTCTAAAACCAGTAAATCAGCCAGCGAATACCCGGAAGCAAGATGCACAGGCGGGCGGCT
TCCCACACACCCGTCACAAGACGCGGACATGCAGGTCTCGGCGCGAGCTCTGCCCCGTCCAAGAGCCTCT
CCGCTGTCGCCCAGTGTGAGCCTGGAAGAGGACCCAAGAGAGTGCCGTGCTGAGGCTGCCTCGAGGTCAC
TGCCTTCCGGAGCTGCGCCTATTCCTCCCTCGCCAAACGCGTTCCAGAATTTGTCCACAGGTGCGCCGGC
ACCTGCTTTCCCACCTCGAGGCCGCGGCCTCCCCCCGATTTATAGACAACTCTGACATTGTCACCCCAC
TGACGAGGCCCGATTCCATAGGGTGGATCCTTGCCAGGCGTCCCTGATCCTCCCTGCCCAAGTCTTCCTT
CGTGAGCTGGCCTTGCTCCCCATCCCCAAGTGCCTCACCAGTCCCCAGACTGGGTGAAGGTACAGCTG
GCTCCTTTCGGGGTGCAGCTTCAACTCTCTCGGCGGTAGGGCGGTGCCATCCCCACCCATAGGGCTGGC
TCACATCCAGTCACTCCCAACAGCGTCCAGCACACAAATAAAAGACCCTTGGGCCCTGGCTCTGAGAAAA
AAAA
```

FIGURE 466
SEQ ID NO: 458
Genbank ID       : AA758751
Unigene ID(#167) : Hs.484250
Unigene name     :       hypothetical protein FLJ32949  FLJ32949
>gi|2806614|gb|AA758751.1|AA758751   ah80c04.s1   Soares_testis_NHT   Homo sapiens cD
NA clone 1321926 3' similar to gb:X07868_rna1 PUTATIVE INSULIN-LIKE GROWTH FACT
OR II ASSOCIATED (HUMAN);contains element OFR repetitive element ;, mRNA sequen
ce

```
TTTAAAGTTGGAAATAATTTTATTAGTTTTTTAATGCATAAATCCAAACATATATTTGTACTGAATATTT
TATTAGCTAATACAGTACCATTTTAAAAGTTCTACCAACTTATTTAAAATATTTCCTGTAAAAACATCAT
CCAAAATATACTTTGTTAATTTTTATGAATGTTAGGTGTTATGTCTCTTTTCTTTGACGCTCTCCTTTTT
TATCCTGTGCTTACACCAAAAACAAATTATTTGAAAATGCTAAAATAAAATGTGGCATGTTTTCTTAGCT
GTTTTGTATTCTGTTATAAGATATTTTACAACTATGAAAGTTGAAAAATAACTTTATTGGTTTTGCTGCA
TATAGCTGCCTGTCTACTATAAGAGAACTAATCCATAAAATTAAGGCATTTGTTATTTCAAGTGTAGAG
GGGCAAGACATAAGGGAATTATAAAAACCCAAGATGACTCATTTAAAGTAGATGCACATTNAATACTATA
GATCTGGCATATTTCATATTTATAAAGCAGACAAAAGAATGGTTATCTGTGCCATTGGGCAGAGTATCTT
CAAGATAACTACCACTTTTCCAAGCCACTATTGTGGGGTAGGTTTATTAGGGGGGGGACTTNGGAAAC
CTGACTTTCCTCACCCCCTTCCCNNNTTNNTTGNNGGGCTNAAANTAAAATAATTAAAGAAGAAGAAAGA
AGAAAAAAAAAAAAAAAAAAAAAAAAAAAAAAAAAAAAACAACATCATCNTTTCCTGTGAAACA
CAACACACAGCACACACACCAACACATCACACACACACACACAGCAGCAACGCACCACACCCACACACCACA
CACACACAGCACACATCACACAACAGCACACA
```

FIGURE 467
SEQ ID NO: 459
Genbank ID       : AA521309
Unigene ID(#167) : Hs.380763
Unigene name     :       similar to hypothetical protein FLJ10883   LOC115294
>gi|2261852|gb|AA521309.1|AA521309   aa79g09.s1   NCI_CGAP_GCB1   Homo sapiens cDNA c
lone IMAGE:827200 3', mRNA sequence FIGURE 467 cont'd TTTTTTTTTTTTTTTTTTTCCACTTTAGTAAGTTGTTTAATATGAGCAACTTGATTACTACAAGATACA
TTTGGCAAATAATTTATATATATATTATTTTTGGGATTTTTGGAGTCGCGTTCTTTCATATTTTAATTTC
CTGCAATTAAGGAATAATGTCCTCTCAACAGAAAGCTATTTTAACTTACTTCTACACACCCACAAAAACT
TATTCTCCATACATCCTATTAAATTTTGGCAAATATCAATTTTCAAAACTATTTTCATGCTCTGAATATT
ACTATATGAAGCTTTTATTTTTAGAAATTCACATAATTCCTGACTTATTTTTATAAGTTACTGTTGGTT
ACTGATGACTTTTCTCCTTATTGTAGAATTTCAAGTACAGTAGTCTCCCTTTATGCACAGTTTCACTTTC
CACGGTTTCCGCTTTCTATGGTCAACCAAGGTGGAGTCCCACAGAATCTGGTTTGCCATTATCATTCTTA
CTTGGTTGCACAAGTGGAGCAAATGAAACAGCAAGGATATTTTTACTTTCCCAAGTGTTCTGTCCAGTTC
GCATAATCTGTGTTAACTGATCCTCTATAGGCATGACT

FIGURE 468
SEQ ID NO: 460
Genbank ID       : AA622495
Unigene ID(#167) : Hs.10844
Unigene name     :     leucine-rich alpha-2-glycoprotein 1 LRG1
>gi|2526371|gb|AA622495.1|AA622495   nq59b04.s1   NCI_CGAP_Co9   Homo   sapiens
cDNA cl
one IMAGE:1148143 3' similar to contains Alu repetitive element;, mRNA
sequence
TTCAGTTTTCAAGGGTTATTTATTAAACCCCTTGGTTCTGACCCCAAGCTAAGTGGGACTCAGCATCAGA
CCCTGCACTCAGAGAGCCCCCTGACTTGGGGAAGACAGAGTCAGAGAAAGGCAGCCCCAGTGTGGCCAGG
GCTCAGCTGGAAGGAAGGACAAGGGGCTGGGAGAACCCAGAGTTCAAGAGATCTGGGAAACAGGGAACGG
CATTCCAGACGGAGGGCACACCTTGGGCATGGGTAAGGAAAGCCCATCGTGTGTTCTAGGAAGCATGGAT
GGATGAAACGGGGTCCCAGCCGCTATGGACAGCCCCGAGTTTCACCTGTAAAAGGCAGGATTATTTGTTT
TTAATTTTAATTTTAATTTTTTTGAGACAGTCTTGCTCTGTCGCCCAGGCTAG

FIGURE 469
SEQ ID NO: 461
Genbank ID       : AI678049
Unigene ID(#167) : Hs.508819
Unigene name     :     CDNA FLJ40458 fis, clone TESTI2041778.
>gi|4888231|gb|AI678049.1|AI678049   wd35b10.x1   Soares_NFL_T_GBC_S1   Homo
sapiens
cDNA clone IMAGE:2330107 3', mRNA sequence
TTATGTATTTCAAAATGTTTATTAAATGAAAACGGAGAGTTTAGAGAGGGGGGCTGCTAGGCAGACTGGG
TTGCACCTGATTACCTGGATGATAATAAACTGCACAAAACCTCGGTCAAATTAATATTGAAACTGCCTTT
TGCTTGGGCTCGTTTCCCTTGCGGAAGAAGGATGACCAAGAAGATGAACAGGAAAGAAATGAGAAACCGA
GGCCTTTGCTTAGTAGCTAAAGGCTACCTTCTGTAACATGAAATAGTCTACAAGTGGCCTTGAACTCTGC
CGTGATTCAGTGACAGAGTTCCCTCATGTCTTCTACCCAGGTTGAAGTCCAGCAAAATTGCGACTGTCCT
CTTTACAACTTGCGAGACCACATTGCTTCTGCATTTGCCTGTTGTATGAGATTTACACTTGTTTTAACGC
AACATTTCGTTTCAGTTGGGCTGGTGGCCATACCTGGCACTAGCCAGTCAATAGTGAGATGGCTCCTCAT
GGAGGAGGCTTGGCTTGAGGCTGAGGGTCTTTAACCCACATATACAAGAGAGTT

FIGURE 470
SEQ ID NO: 462
Genbank ID       : NM_002120.1
Unigene ID(#167) : Hs.1802
Unigene name     :     major histocompatibility complex, class II, DO beta
       HLA-DOB
>gi|4504402|ref|NM_002120.1| Homo sapiens major histocompatibility complex,
cla
ss II, DO beta (HLA-DOB), mRNA
AACTCATTCTGAAGAGGCTGACGATTTTACTGTCTCATTTTTTTCCTTTCTCCAGAATGGGTTCTGGGTG
GGTCCCCTGGGTGGTGGCTCTGCTAGTGAATCTGACCCGACTGGATTCCTCCATGACTCAAGGCACAGAC
TCTCCAGAAGATTTTGTGATTCAGGCAAAGGCTGACTGTTACTTCACCAACGGGACAGAAAAGGTGCAGT
TTGTGGTCAGATTCATCTTTAACTTGGAGGAGTATGTACGTTTCGACAGTGATGTGGGGATGTTTGTGGC
ATTGACCAAGCTGGGGCAGCCAGATGCTGAGCAGTGGAACAGCCGGCTGGATCTCTTGGAGAGGAGCAGA FIGURE 470 cont'd

```
CAGGCCGTGGATGGGGTCTGTAGACACAACTACAGGCTGGGCGCACCCTTCACTGTGGGGAGAAAAGTGC
AACCAGAGGTGACAGTGTACCCAGAGAGGACCCCACTCCTGCACCAGCATAATCTGCTGCACTGCTCTGT
GACAGGCTTCTATCCAGGGGATATCAAGATCAAGTGGTTCCTGAATGGGCAGGAGGAGGAGAGCTGGGGTC
ATGTCCACTGGCCCTATCAGGAATGGAGACTGGACCTTTCAGACTGTGGTGATGCTAGAAATGACTCCTG
AACTTGGACATGTCTACACCTGCCTTGTCGATCACTCCAGCCTGCTGAGCCCTGTTTCTGTGGAGTGGAG
AGCTCAGTCTGAATATTCTTGGAGAAAGATGCTGAGTGGCATTGCAGCCTTCCTACTTGGGCTAATCTTC
CTTCTGGTGGGAATCGTCATCCAGCTAAGGGCTCAGAAAGGATATGTGAGGACGCAGATGTCTGGTAATG
AGGTCTCAAGAGCTGTTCTGCTCCCTCAGTCATGCTAAGGTCCTCACTAAGCTTGCTCTCTCTGGAGCCT
GAAGTAGTGATGAGTAGTCTGGGCCCTGGGTGAGGTAAAGGACATTCATGAGGTCAATGTTCTGGGAATA
ACTCTCTTCCCTGATCCTTGGAGGAGCCCGAACTGATTCTGGAGCTCTGTGTTCTGAGATCATGCATCTC
CCACCCATCTGCCCTTCTCCCTTCTACGTGTACATCATTAATCCCCATTGCCAAGGGCATTGTCCAGAAA
CTCCCCTGAGACCTTACTCCTTCCAGCCCCAAATCATTTACTTTTCTGTGGTCCAGCCCTACTCCTATAA
GTCATGATCTCCAAAGCTTTCTGTCTTCCAACTGCAGTCTCCACAGTCTTCAGAAGACAAATGCTCAGGT
AGTCACTGTTTCCTTTTCACTGTTTTTAAAAACCTTTTATTGTCAAATAAAATGGAGATACA
```

FIGURE 471
SEQ ID NO: 463
Genbank ID          : AJ252550
Unigene ID(#167)    : acc_AJ252550
Unigene name        :
>gi|5834425|emb|AJ252550.1|HSA252550 Homo sapiens partial GK gene for glycerol
kinase, exon 1 (glycerol kinase deficiency case)
```
GCCCCGTGACGTCTCATCGCCCTCTGCCTGTCCGAGCGTTCGGCTCTTTTGCGTTTGCTGATTGGCCAGC
CCAGGTGACAGCGCCCACCCCCACCCCCCCTGACACGCCCCTGGAGCCTTGGGGGTACGCGGTGGGGGGC
GGGGCCTGGGCCGGAGGGGCGGGGTGAGAAGGCTGCGCGCGGGTAAAGGGGCCGCCTCGAGCGCGGTCCG
AGCGTTCAGCGGACGCGCGCGGCCTCGATCTCTGGACTCGTCACCTGCCCCTCCCCCTCCGCCGCCGTC
ACCCAGGAAACCGGCCGCAATCGCCGGCCGACCTGAAGCTGGTTTCATGGCAGCCTCAAAGAAGGCAGTT
TTGGGGCCATTGGTGGGGCGGTGGACCAGGGCACCAGTTCGACGCGCTTTTTGGTGAGCCCGGGGTGAC
ATGTGAAGAGGCGCTGACGGNGNGCGNGAGTCGGGGACGGAGGGGGTGGCTGTTGTGTCCCCATCCCGC
ATCTCTCCGGCC
```

FIGURE 472
SEQ ID NO: 464
Genbank ID          : NM_004734.1
Unigene ID(#167)    : Hs.21355
Unigene name        :    doublecortin and CaM kinase-like 1  DCAMKL1
>gi|4758127|ref|NM_004734.1| Homo sapiens doublecortin and CaM kinase-like 1 (D
CAMKL1), mRNA
```
GCACATCCCTGCACTAGTGGCCGCAACCGAGACGCCGCGCTCCAGCAGCTGCTGCCGCCCAGCCCGGCCC
CGCCGCCGCCCCCCAGCCCTGCAGCCCCGCAGCCCCGGCCGCGCCCAGCCCGGCGAGGACAGCACCAGGA
GGCGGCCCCCAGCGCGGCCACAAAGACCCCGGCGGCGTCTCTCCGCGGACCGGTCCTACTTGAAGTCCA
TCATGTCCTTCGGCAGAGACATGGAGCTGGAGCACTTCGACGAGCGGGATAAGGCGCAGAGATACAGCCG
AGGGTCGCGGGTGAACGGCCTGCCGAGCCCGACGCACAGCGCCCACTGCAGCTTCTACCGCACCCGCACG
CTGCAGACGCTCAGCTCCGAGAAGAAGGCCAAGAAAGTTCGTTTCTATCGAAACGGAGATCGATACTTCA
AAGGGATTGTGTATGCCATCTCCCCAGACCGGTTCCGATCTTTTGAGGCCCTGCTGGCTGATTTGACCCG
AACTCTGTCGGATAACGTGAATTTGCCCCAGGGAGTGAGAACAATCTACACCATTGATGGCTCAAGAAG
ATTTCCAGCCTGGACCAACTGGTGGAAGGAGAGAGTTATGTATGTGGCTCCATAGAGCCCTTCAAGAAAC
TGGAGTACACCAAGAATGTGAACCCCAACTGGTCGGTGAACGTCAAGACCACCTCGGCTTCTCGGGCAGT
GTCTTCACTGGCCACTGCCAAAGGAAGCCCTTCAGAGGTGCAGAGAATAAGGATTTCATTCGGCCCAAG
CTGGTCACCATCATCAGAAGTGGCGTGAAGCCACGGAAAGCTGTCAGGATTCTGCTGAACAAGAAAACGG
CTCATTCCTTTGAGCAGGTCCTCACCGATATCACCGATGCCATCAAGCTGGACTCGGGAGTGGTGAAACG
CCTGTACACGTTGGATGGGAAACAGGTGATGTGCCTTCAGGACTTTTTTGGTGATGATGACATTTTTATT
GCATGTGGACCGGAGAAGTTCCGTTACCAGGATGATTTCTTGCTAGATGAAAGTGAATGTCGAGTGGTAA
AGTCCACTTCTTACACCAAAATAGCTTCATCATCCCGCAGGAGCACCACCAAGAGCCCAGGACCGTCCAG
GCGTAGCAAGTCCCCTGCCTCCACCAGCTCAGTTAATGGAACCCCTGGTAGTCAGCTCTCTACTCCGCGC
TCAGGCAAGTCGCCAAGCCCATCACCCACCAGCCCAGGAAGCCTGCGGAAGCAGAGGAGCTCTCAGCATG
```

FIGURE 472 cont'd

GCGGCTCCTCTACGTCACTTGCGTCCACCAAAGTCTGCAGCTCGATGGATGAGAACGATGGCCCTGGAGA
AGAAGTGTCGGAGGAAGGCTTCCAGATTCCAGCTACAATAACAGAACGATATAAAGTCGGAAGAACAATA
GGAGATGGAAATTTTGCTGTTGTCAAGGAATGTGTAGAAAGATCGACTGCTAGAGAGTACGCTCTGAAAA
TTATCAAGAAAAGCAAATGTCGAGGCAAAGAGCACATGATCCAGAATGAAGTGTCTATTTTAAGAAGAGT
GAAGCATCCCAATATCGTTCTTCTGATTGAGGAGATGGATGTGCCAACTGAACTGTATCTTGTCATGGAA
TTAGTAAAGGGGGGAGACCTTTTTGATGCCATTACTTCCACTAACAAATACACCGAGAGAGACGCCAGTG
GGATGCTGTACAACCTAGCCAGCGCCATCAAATACCTGCATAGCCTGAACATCGTCCACCGTGATATCAA
GCCAGAGAACCTGCTGGTGTATGAGCACCAAGATGGCAGCAAATCACTGAAGCTGGGTGACTTTGGACTG
GCCACCATTGTAGACGGCCCCCTGTACACAGTCTGTGGCACCCCAACATACGTGGCTCCAGAAATCATTG
CAGAGACTGGATACGGCCTCAAGGTGGACATCTGGGCAGCAGGTGTAATCACTTATATCCTGCTGTGTGG
TTTCCCTCCATTCCGTGGAAGTGGTGATGACCAGGAGGTGCTTTTTGATCAGATTTTGATGGGGCAGGTG
GACTTTCCTTCTCCATACTGGGATAATGTTTCCGATTCTGCAAGGAGCTCATTACCATGATGCTGTTGG
TCGATGTAGATCAGCGATTTTCTGCTGTTCAAGTACTTGAGCATCCCTGGGTTAATGATGATGGCCTCCC
AGAAAATGAACATCAGCTGTCAGTAGCTGGAAAGATAAAGAAGCATTTCAACACAGGCCCCAAGCCGAAT
AGCACAGCAGCTGGAGTTTCTGTCATAGCACTGGACCACGGGTTTACCATCAAGAGATCAGGGTCTTTGG
ACTACTACCAGCAACCAGGAATGTATTGGATAAGACCACCGCTCTTGATAAGGAGAGGCAGGTTTTCCGA
CGAAGACGCAACCAGGATGTGAGGAGCCGGTACAAGGCGCAGCCAGCTCCTCCCGAACTCAACTCGGAAT
CGGAAGACTACTCCCAAGCTCCTCCGAGACTGTTCGCTCCCCTAACTCGCCCTTTTAATAAGACCCTTT
TACTCAAAGTCCTAGCTTAACCCTTTGAGACTCTGAGATTTTTTCCCCCAAATTTGTGTAAAACAGTTT
CATCTGATCTATCTAGCGCTCAATGCTTGAATGGCAGAACTGAAAGTGTTTTCAGGTATCTTTGTAGCGG
TTTCCCTTTACTGAATAAGATGACACGTGGTGATTGTGAAGATGGTAATTTGCTGCTAATAGAGTCCTCA
AAGGGTTAAGGCCAATTTGCAATTTTTTTTTAAACTTAGAAGCAATGAATGTTTTCATCAGTCAAGCTAG
GATCTGCAGTATGTAATATAGCACTTGTTAACCCTCTGAGTGCATAGAATTTTATTGAGAATTCTTGTTT
GGGAATTTTTCAGGCCTTTGGATGTATACACATGTTTCTTGATTTTACTGCAGATCAAGGGGTGTTGT
TAGATGCTGAAATGTCCAGAAAAGAAGGACATTTAGAATGATATCTTGTTGTCCTTTTCTGTGGGTTTA
GAACGTGGCAGGTTTATAACTTAGACACACGCACGGTTCTTTCTTCTTCACAATCCTATTCAGAAACAGA
TTTTTTTTTTCATTAGATATGACTGTCAGTTGCAGTGAGTTCTGCATCCAAGTGGAGGGAATTGGGT
TTGTGGCAAAGAGCTTGACCCAGGAAATAGATGGTGCCCCCCAAATTGTCTCCACATGAAGATGTACTGA
TGACGCCCCAGAAATGCTGCTTCCATATCAGCTGCTGCTAGCGCCAGCGCAGACTCTCAGGGAGTCACCA
CAGCTTGTCTTGTGCTTGGTGAGTGAGGGTCTCTCTACTCAGTGTCAGACATCTACAGGAAAGAAACAAC
TGGTGGAAAAGAGCAATAAATTGCCCGGTGCTCTGCAGGGCTGGAATTTCAAACAGAAAGAGGGAATAAG
ATCCTGTGATTTTTCTCACCTGCTTTTCCACGCACTGTGGTCATCACTGTGCAATCTACATCTAGTATGA
AATCCACACATAGGAGAGCTGGGCACAAGGGGACTGGAGGCAGTTGCTTTGCAAGATGGCTGAGGAGAA
AGCACACTGGGAACACAATCCAGAATGTTCTAACAATAAGTTTTCAGTGAATAAACCACTGGCAAGACAT
TTCCATGTGCACCTTTAGGTTACCTATATAGTCTCCTAGGAAGATCAGGATGAAAGACCTAGATGATACC
CCTGAGGATAAAACCTCCATCCCCTAAAATGATTTTTTTTAAATACCACTGTCTTTAGCTGTCCAGGAGG
TCAGAGTGTTTTTTCTGTCTTTGGGCCAAGTCCTGTCTGAGACCTGTATTTTCACTCTTGTTACCAAATC
TATCTCCCTAGTGCAGTGTCTCCAGGCCTGAGTTTCTTCTGGAACAGATTCCATTTTAGAATGGGGATTC
ACAGGTTCTGTGCATCACCACAGTGCTCAGAGAGGATTCTCCTGGGGTGTCTTAGAGGCAGGTGCCCAAC
TCAAATGTATTCCCAAGGTTTGCTGGGCTCTGGGATCCACGAGACAACCAGAGAGGGATATCTCATGAAA
TTTGCATCTGGTGGCTGAACAGTACCTATGTTCTCTGTTTTGAATATACTTTAATACCTGAGAGTCTTAA
AATTTGTGAACAACGTTTCTATAGTCCTTTATTTTCAAATGCACATTGATCTTCACTTGCTGCATTTTTA
CTCTTCAACCCTGAAACTATGGTCTACATTAATATGGATTTTAAATCACATGTCATTACTTTTGCAACA
CCATCACCAAAATTTTTTGCTCTTTTACATTTAGGTTCATCTCTGTGGTCTGTGTTGTCCTGACATGTAA
AAAGCATATCGTTTATTGAGGTTTTTTTCCCCCCCTTTTAGAGCATCCGGAAGTGATAACACGCAAAATC
ACAAAGTAGCATAAATCAGTAAATTAGTTGAGTTGTTTTTGGGGGGGAGGTGGGGTAGGGGGCACAGAA
CACCAGAAAGAGTGTTGGTGTGTAGGTAGATTCCATATTAATGAGGAACACTGAACTAGTTGGAAATTAC
TGCTTTCTCTAGAAATATAAAGCAAAGCACTATTCCAAGGCTATGGAGTAGCTCTACAGCCTGGCCTCAA
CTCTAAAAGTGTGAAGAATGCAATGGGCAGAGACCTACCTGCAGTGGACTGTCATTTTCCTTTCTTTCTC
TGAATTACTGCTTTTTCTGTGGGCATTAACTATATTGCTACAGCATCTAGTGTACTGAGCCTGCGGTGCA
TGGCTCAGGCCTTTTCCCATCGACGTCTAGGGGACTCTGGACCGTGTGAAGCTAGGGGTGTTTCTCAG
CACACTGCAGAAGGGCAGCTCAGAAGAATGCAGGGCCCATTCAGCATGGGGATCCCAGCACACATCACTGTA
GAATTTGAGTGATCTATGCTGAATAAACAGTGGAATGTGACCAGTCAAGTAGAAATCTTGAGTAATCAGA
TGGAATGCAATCTTTCTAACATTAAGCTACCAAGATCCTGAATGTCAGAGATGTACTCAGAGGGTTAACA
GACAAGCACAAGGCATGCTGACTACATTGGTGTATCCAGATTGCTTTGCTTTTAGCCAGTGCTTTCTAAT
TTTTTTCTCGACATTCTTGGGATAGTTCAAGTTTGAAATAATTAAGTGGTGGTGTTCTTTAAGGAATTTC
TATAACCAAATTGATCTTATTTTTGATTTCACTTATCATAGAACAAATATGTATCATTATGGCAGTGTAT
CTATGTAATTATCAATTTAATCATCACCACCGGTGTTTCCATATTTTTTCCCAAGTATTTAATATAGCTC
TCTTATGGTGGTGGCCTGGTGATGGGACCGTCTTTCTTTTACTGACACATGACCAATCATATGGTATTT
TCAAGGGAATTTTAAGATTCATCTTTTCAGTTTGATAGTAGACTAGTTAAGGAAGAACTCTTTCATTACT
TGCATCGTGTAAATCATCTCTGTAGACATGTGTTCATATTAATGAACACATTTTTTCTCAACATTGTAGC

FIGURE 472 cont'd

AGAAATCATTTTATTCGTCATGATCAATGAATATGTGATTTGCTCCAGATCGTTAGAAGGAAAAGTAAGA
TTTCAGTCATCAAAAATGTTTTTACCGTAGCCCTCATCTAACTTACACGTGGTGCATATTAAAATAAGCA
GAGAAAAAAAATGTGAATAAACTACTGAAAAC

FIGURE 473
SEQ ID NO: 465
Genbank ID         : BE301029
Unigene ID(#167)   : Hs.226422
Unigene name       :     hypothetical protein FLJ31166 FLJ31166
>gi|9184777|gb|BE301029.1|BE301029 ba82f12.x1 NIH_MGC_21 Homo sapiens cDNA
clon
e  IMAGE:2906927  3'  similar  to  contains  Alu  repetitive  element;,  mRNA
sequence
TTTTTTTTTTTTCTGTTGCTGTTTACCACAATCAACAAGTTTTTATTGATAAAAACAAAGCCATTTCAGG
TGTGACAACAGTAACATAGTTGGCAAAAAGATAAATGGGAACATGGCTCTCAGATAAGTCATAGCAGGCA
AGGGAAGGTTAGAAGACAGTAGGAAGAATAACATACATATGCATAACACTTTACAAATCATGCCACATAT
ATTTAGCTTCTTTGATCTTCACAAAAACCTTCTGAGGTGTTATTATTTCCCGTTTTTTAGGGAAAAAACG
GCTTTAAAGATTTCAGGCCAGGAGCAGGGGGTCAGGCCTCTAATTCCAGCACTTTGGGAGGCCAAGGTGG
GCGGATCACCCGACGTCAGGAGTTCCAGACCAGACTGGCCAACATGGTGAAACCCCCTCTCCACTAAAAA
TACAAAAATTAGCTGGGCACGGTGGCAGGCAGCTGTAATCCCAG

FIGURE 474
SEQ ID NO: 466
Genbank ID         : AW117368
Unigene ID(#167)   : Hs.408177
Unigene name       :     ADP-ribosylation factor guanine nucleotide factor 6
        EFA6R
>gi|6085952|gb|AW117368.1|AW117368    xd88h01.x1    Soares_NFL_T_GBC_S1    Homo
sapiens
cDNA clone IMAGE:2604721 3', mRNA sequence
CAGGTGTGGCAAAATACTTATTACAAAGAAAGCAACTGCAACCCTAGAGAGGGGTAAGCCTTCTCTGGGC
AATAGTCATGGACATTTACAGAGGGGAAGGAAGTAAACGTTAATAAATAATTCTGTAAATAAATGCTAGT
ACATCATAATAACATACCACTTAGACACTACCATGGCTTTACAGCAGGTTTTCTCTAATTCACTGGAACC
ATGCTATTCCTGTAGAGCAGCTGATTCTTTGGTCATAGTACCTTCAACAAATAAACTATAGAACTAGAGA
AACTTTCTAAGGGAGGAAAAGAAAAATCAAAGTGATACTATTAGTTCTGAAGTTGTGCCACTTGCGGAG
ATTTTAACTTTAGGGATTACAGAGTTTCAAGGTTAGGAAATCACAAAGCTCTAGGTCTCAGTGGGCTAAA
CTTTCACTCCTTTCTCTTCCTCTACAGAAGAATATTCTGTNTATCACCCTGAACTTCAAAGGGACTGTAA
CTGGAACAAGCTCATGA

FIGURE 475
SEQ ID NO: 467
Genbank ID         : AW119113
Unigene ID(#167)   : Hs.2030
Unigene name       :     thrombomodulin    THBD
>gi|6087697|gb|AW119113.1|AW119113    xd89b09.x1    Soares_NFL_T_GBC_S1    Homo
sapiens
cDNA   clone   IMAGE:2604761  3'  similar  to  gb:J02973_rna1  THROMBOMODULIN
PRECURSOR
(HUMAN);, mRNA sequence
TGGGATTCGCCAGATGCCCCAAGAAGGGTTTATTTAATTCATTCCAACAAATGATCCTATAATGCATTTA
TGCATTTAAAAGCACAGAGACACAAGTCCTCATATATGAAGTTGTTATGGTTACAGAAAGAAAATAAATA
TTTGTGCACACAGAGATAGCATGAAATCATTCTACAGTGAAAATAATAGCCTCTGGAAAAAGCTTTGAAA
ATCAGAGATGGTGCCACCACCAGACAACACAAGTGCTGGGGTACAGGGCAGCCCTCCATGCATTTCATAG
CATTTGCATGGTTTGTGAGCCCCATTTAATGACATAAAATGAGGGCACTGAGGGAGGAAAAGTGAACAGA
CACACAACCCGAGAGCACATTGGTATTTGTTTATTTTGTACAAGTGATGTCATAAGCAAGGATTTTGCCT
GAGTGCTAGATTATCTCCAATAAATAAATAACTATGTACAAATATCTTGAGGTTACAAAATATAAGACGA FIGURE 475 cont'd GAACCTTTGTGTTACGANAAGTACATTTCTATGATACATATATTTCCATAAACTGGAGCAGGATATCATT
CCTTACGTTACTGAACCAAAGACCTTCAAACCTTGT

FIGURE 476
SEQ ID NO: 468
Genbank ID        : NM_000417.1
Unigene ID(#167)  : Hs.130058
Unigene name      :       interleukin 2 receptor, alpha IL2RA
>gi|4557666|ref|NM_000417.1| Homo sapiens interleukin 2 receptor, alpha (IL2RA)
, mRNA
GAGAGACTGGATGGACCCACAAGGGTGACAGCCCAGGCGGACCGATCTTCCCATCCCACATCCTCCGGCG
CGATGCCAAAAAGAGGCTGACGGCAACTGGGCCTTCTGCAGAGAAAGACCTCCGCTTCACTGCCCCGGCT
GGTCCCAAGGGTCAGGAAGATGGATTCATACCTGCTGATGTGGGGACTGCTCACGTTCATCATGGTGCCT
GGCTGCCAGGCAGAGCTCTGTGACGATGACCCGCCAGAGATCCCACACGCCACATTCAAAGCCATGGCCT
ACAAGGAAGGAACCATGTTGAACTGTGAATGCAAGAGAGGTTTCCGCAGAATAAAAAGCGGGTCACTCTA
TATGCTCTGTACAGGAAACTCTAGCCACTCGTCCTGGACAACCAATGTCAATGCACAAGCTCTGCCACT
CGGAACACAACGAAACAAGTGACACCTCAACCTGAAGAACAGAAAGAAGGAAAACCACAGAAATGCAAA
GTCCAATGCAGCCAGTGGACCAAGCGAGCCTTCCAGGTCACTGCAGGGAACCTCCACCATGGGAAAATGA
AGCCACAGAGAGAATTTATCATTTCGTGGTGGGCAGATGGTTTATTATCAGTGCGTCCAGGGATACAGG
GCTCTACACAGAGGTCCTGCTGAGAGCGTCTGCAAAATGACCCACGGGAAGACAAGGTGGACCCAGCCCC
AGCTCATATGCACAGGTGAAATGGAGACCAGTCAGTTTCCAGGTGAAGAGAAGCCTCAGGCAAGCCCCGA
AGGCCGTCCTGAGAGTGAGACTTCCTGCCTCGTCACAACAACAGATTTTCAAATACAGACAGAAATGGCT
GCAACCATGGAGACGTCCATATTTACAACAGAGTACCAGGTAGCAGTGGCCGGCTGTGTTTTCCTGCTGA
TCAGCGTCCTCCTCCTGAGTGGGCTCACCTGGCAGCGGAGACAGAGGAAGAGTAGAAGAACAATCTAGAA
AACCAAAAGAACAAGAATTTCTTGGTAAGAAGCCGGGAACAGACAACAGAAGTCATGAAGCCCAAGTGAA
ATCAAAGGTGCTAAATGGTCGCCCAGGAGACATCCGTTGTGCTTGCCTGCGTTTTGGAAGCTCTGAAGTC
ACATCACAGGACACGGGGCAGTGGCAACCTTGTCTCTATGCCAGCTCAGTCCCATCAGAGAGCGAGCGCT
ACCCACTTCTAAATAGCAATTTCGCCGTTGAAGAGGAAGGGCAAAACCACTAGAACTCTCCATCTTATTT
TCATGTATATGTGTTCATTAAAGCATGAATGGTATGAACTCTCTCCACCCTATATGTAGTATAAAGAAA
AGTAGGTTTACATTCATCTCATTCCAACTTCCCAGTTCAGGAGTCCCAAGGAAAGCCCCAGCACTAACGT
AAATACACAACACACACACTCTACCCTATACAACTGGACATTGTCTGCGTGGTTCCTTTCTCAGCCGCTT
CTGACTGCTGATTCTCCCGTTCACGTTGCCTAATAAACATCCTTCAAGAACTCTGGGCTGCTACCCAGAA
ATCATTTTACCCTTGGCTCAATCCTCTAAGCTAACCCCCTTCTACTGAGCCTTCAGTCTTGAATTTCTAA
AAAACAGAGGCCATGGCAGAATAATCTTTGGGTAACTTCAAAACGGGGCAGCCAAACCCATGAGGCAATG
TCAGGAACAGAAGGATGAATGAGGTCCCAGGCAGAGAATCATACTTAGCAAAGTTTTACCTGTGCGTTAC
TAATTGGCCTCTTTAAGAGTTAGTTTCTTTGGGATTGCTATGAATGATACCCTGAATTTGGCCTGCACTA
ATTTGATGTTTACAGGTGGACACACAAGGTGCAAATCAATGCGTACGTTTCCTGAGAAGTGTCTAAAAAC
ACCAAAAAGGGATCCGTACATTCAATGTTTATGCAAGGAAGGAAAGAAAGAAGGAAGTGAAGAGGGAGAA
GGGATGGAGGTCACACTGGTAGAACGTAACCACGGAAAAGAGCGCATCAGGCCTGGCACGGTGGCTCAGG
CCTATAACCCCAGCTCCCTAGGAGACCAAGGCGGGAGCATCTCTTGAGGCCAGGAGTTTGAGACCAGCCT
GGGCAGCATAGCAAGACACATCCCTACAAAAAAATTAGAAATTGGCTGGATGTGGTGGCATACGCCTGTAG
TCCTAGCCACTCAGGAGGCTGAGGCAGGAGGATTGCTTGAGCCCAGGAGTTCGAGGCTGCAGTCAGTCAT
GATGGCACCACTGCACTCCAGCCTGGGCAACAGAGCAAGATCCTGTCTTTAAGGAAAAAAAGACAAGG

FIGURE 477
SEQ ID NO: 469
Genbank ID        : BC001787.1
Unigene ID(#167)  : Hs.123232
Unigene name      :       chromosome 14 open reading frame 143       C14orf143
>gi|12804712|gb|BC001787.1| Homo sapiens chromosome 14 open reading frame 143,
mRNA (cDNA clone MGC:2492 IMAGE:3353520), complete cds
GTTGCTGGGGCTCGGTTGTTGTAGTCGCGATGTTCTTCTCCGAGGCCAGAGCCAGGTCGCGGACGTGGGA
AGCCAGTCCCTCGGAACACAGGAAGTGGGTGGAAGTATTTAAAGCATGTGATGAAGATCACAAAGGATAT
CTCAGCAGAGAGGACTTTAAAACTGCTGTTGTAATGCTGTTTGGGTACAAGCCCTCCAAGATAGAAGTGG
ATTCTGTGATGTCTTCAATAAATCCAAATACTTCTGGTATATTACTCGAGGGGTTTTTAAATATTGTCAG
GAAAAAGAAGGAAGCTCAACGATATCGGAACGAAGTAAGACACATCTTCACAGCCTTTGACACCTACTAT

FIGURE 477 cont'd

```
CGTGGATTTTTAACTTTGGAAGATTTCAAAAAAGCATTTAGGCAGGTGGCTCCCAAATTACCGGAAAGGA
CTGTTCTTGAGGTATTCAGGGAAGTAGATCGAGATTCAGATGGTCACGTCAGCTTTAGAGACTTTGAATA
TGCCCTGAACTATGGACAGAAGGAAGCCTAACTATTGTGAACTACTTTTGGTAACTCTGGGGAGATCAAT
AGATTGTAATGTCAGCAGACTCTACTCTACTAATGATGTCATGCTACAGACTTGTGATTAAACATTTAAA
AATTTTTAATTTTTGTGGGTACATAGTAGGTGCATATGTATACATACACACACATATATGGGTTACGGGA
GATATTTTGGCACAGGCATGCAATAAGTAATTGACTAAATTTTTAATCATAATTTTTGGATGCTGATGAT
AGACTTGCATCTCAGAATCCTAGAGATGGTTGCTGCCGGGGGTCTCCTTCTGTGTGGCCAGCAGCCCTGA
GTCAGGCCGCCATTGCTAGAGCTGGGGCTAGGGATGGCACTGGTGGTCCTCCTCCTCCTCACTCTTCTTG
CCCCCTACCCTCTCCACACTGCAGGCCACGGTGCTCTACTCACTCACTTCATTGTCCTCACCATCCCACC
CTGAATCTCATCATCTCCTAATATCTGCAGAGGGGCAGACTTTTCCTGCCAATGGTGCCAGTTTCCTTCA
TTTGCTCAACATTGGTTGAACAAATAATAGCACCTACACATACAGAATACTTACTATGTTCCAAGCAATC
AGCCAGGCCTTGGGAAGCATAGGCTTAAGACTTCTCTAAGATAGGCTCGTGCCTACAATCCCAGCACTTT
GGGAGGCCAAAGCAGGAGGATCACTTGAGCCTAGGAATTGGAGACTAGCCTGGGCAACATACCGAGACCC
CATCCCTACCAAAAAATTAATAATAAAAAATTATCTGGATTTAGTGGTGTGTACCTGTAGTCCCAGCTAC
TTGGGAGGCTGAGGTGGAAGGATCATTTGAGCCCAGGGGTTTGAAGCTTCAGTGAGCCATGATTGCACTG
TCGCACTCCAGCCTGGATGATAGAGCAAGACCCTGTCTCTAAAAAAACACTTTCAATTAAAAAAAAACAT
ATAAAGACTTCTCTAAGATAATGTCCCTGAGTCCAAATCATCACTGTAAAGTGGTCCCAGGGCACTGTCT
GTGCAAGACAAAGAAATCGGCTTGGGCTAACACGAGCAAGCCCTCTCGGGCTATATACAGAGGAAGAACA
GGGTGATGAGGGTACTGGGGGCAAGAGACATGTTTGCAGAACCCTTTAGGATGGTCTAGGCTTGGGAGTC
TCACTGCGGAGAAGCAAGCCTTGAGCTGCTCAGCTGCCCTCTGCTCCATACCCCTGGTTTCTAGCAGTC
ACGTCCTGCACCCAGACACTTAGCCATGTGTGTTCACGTTCCCCATGCCTTGCCTGTCCTGCTGGGCTCC
AGTAACTGCTATACTGGAGCAAGAACAGCAATGCTGGACACTCAGCATTTAGTGAAGGTAATTCCAAAAT
ACTGGTATCAGTACTCTTATTTATAAGTGTACGGAATGCATAACATGAACATTAGTCAAAGAACTTTTAA
TATAATTCACTTTTTAAGTGTTAAAATTTAAAGGTCAAGTAAAATTGTAAATTTGTAATATGGAAACATT
AAGCGTCATTATCATACAAATTATTAGCAGATAACCTTAATAAAAATAAACGTTTGCGGGTTTTTTTTGA
GACAGGGTCTCGCTTTGTCACCTAAGCTGGAGTGCAGTGGCGCGATCTCGGCTCACTGCAACTTCCGCCTC
CTGGGATCAAGTGATTCTCCTGCCTTAGCCTCCTGAGTATCTGGGTTTACAGGTGTGTACCGCCACACCC
GTCTCTACTAAAAATACAAAAAACAAAAAAAGATTAGCTGGGCGTGGTGGCAGGTGCCTGTGGTCCCAGC
TGCTCGGGAGGCTGAGGCAGGAGAATAGCATGGACCTGGGAGGCGGAGCTTGCAGTGAGCTGAAATGGTG
CCACTGCACTCCAGTCTGGGCAACAGAGCGAGACTCCCTCTTAAAAAAAAAAAAAAAAAAAAAAAAAAAA
AAAAAAAAAA
```

FIGURE 478
SEQ ID NO: 470
```
Genbank ID       : AB007975.1
Unigene ID(#167) : Hs.492779
Unigene name     :    MRNA, chromosome 1 specific transcript KIAA0506.

>gi|3413950|dbj|AB007975.1|  Homo  sapiens  mRNA,  chromosome  1  specific
transcript
KIAA0506
GTTATCCTTATTTTACAGGTAAGGGTCACATAAAGAAAATGACTCCCTTGCCTGGTGTGGTGGCTCACAC
CTGTAATCCCAGCACTTTGGGAGGCCAAGGCGAACAGATCACCTGAGGTTGGGAGTTCAAGACCGGCCTG
ACCAACATGGAGAAACCCTGTCTCTACTAAAAATACAAAATTGGCTGGGCGTGGTGCCGCATGCCTGTAG
TCCCAGCTACTCAGGAGGCTGAGGCAGGAGAATTGCTTGAACCCGGGAGGCGGGGGTTACGGTGAGCCAG
GATTGCACCATTGCACTCCAGCCTGGGTAACAAGAGCGAAACTCTGTCAAAAAAAAAGGAAAGACTTCCT
CAAACTAATTACATTGTTGTTCTTATCAACATTAACCAGAATTGAGTACAGACTGCACTATGTGCTGTTA
CTGTGTCGGGCTCCATGCAAAGCACTTAACAAGATTTGTTACTTTATCCTTATAACAACTCTGTGTGGTG
TAGGTGTAATAATTATCCCATTGTCCAGATGAGGAAACTGAGGTACCAAGAGGTTAAATAACTTGCCATA
GCTCGCAGAGGTGGTAAGTGGGGAATCTAGGATTCACTTCTAAGCTTGAACGTGGTATGGTTGTGGTATG
GAACCAAGGCAAGACTCCAGTCTGCTTACATCTGACTCAGAGATCCTACAAGAACATGCCGACTGTCCCT
GTTTAACCAAATGTCAGTCCAGGCAGCATTGTCTGTGTCCCTGATTGTGCCTTTCTCTAGTCTGGGAACA
CTGCCAGGCAGTGTATGTCACTAGATGTAAATAAGGCCATTATTTGATTTTATGAAACTCTTTTTGGAGG
TTGAGACTTGTATATTCTGTGTGACACTCCCATTTGGATATCCAAAGACACCTTAAATTCAATATGTCA
AAAAACTGAAGTTATCATTTCTGCAGTCTCTCCTTTTTGCCCTGAAAAAGAACATGCACTTGTTTTTCAT
ATTTCCTTATCTCTTGGAAAGACATCTTGACCACTCAAGAATGTAAGCTGGAAACCTCAGGGTCACCTTT
CTTCTCTGTCACTACCCCTGGCTTAGGTCACCCTTACAGATGTGCCTCTTAAATATTTTTCAATCGTGTC
TCTCCCTATTCCTTCCTACCAGTGCAGCCCCAGACTGTTGTGTTTCATAGACAGCTGCCGCAGTGCCCTC
CAGACTGCCACCATGCCTTTGGCTGTGCCCTCCCACCATCCTCCACACTGCTGCCTGGCTCATCTGTATA
AGGATGATTCTGTAGGCATTGTCCTGCTTAAAACCATGTGGTGATTCCAGGCTTGAGTCTGAACTCAGAG
```

FIGURE 478 cont'd

```
CAAGGCACATGGCATTCTGCCTGGCACCTGAGGCCACAGCAGCATATTATAGGTCCGCTGTGCCTTGTGC
CCTGAGTATGTCCTGTTGAGGCCACTTCTATTCCTGCTCTTCCTTCTACCTGGGAAGCACTCCCTTCCCA
TTGCGGCTGAAGCCTGTCTCTTCAAACCTCAGCCCAACTTCTGCTTATCTTCCAGAGCCTATTTGAGCTT
TCATCCCTTCTAGAAGCTTTCCCTGATGTTGGCAGAGTAGTTTTCTCTTCTTTTGTGTTACCATTACACT
CTAGAGAGACCTTTGTTTCTGCATGCATCACAGTGTATTTGTCTTTTTGAAGGCAGGGACTCTGACACTC
ATCTTGACAGCAAAGGGGTGAATTACTCAACTGTCAATTCTTTTGTAAAATGGACAATGTCAACCCTGTT
AGAAGTAAATGCAATAATGGGTGTCACGTCCTTAGCACCGTGCCTGGCCCATAGTATATACCCAGTGGAC
ACCTGTACCTCCTCTCCACATCCCTGTTGCATGGTGACTGGGCCCAGAAGGCAGCTAGAATTGGCAACTC
AAGCCCTTTTGGTCAGGATCCTTTGCTGGGTGGAAGCTCCTCGCCTACTAATGCGGGTGCCCTGTGGCTG
AATCTGGTGAATCCATCAGGTCCAGGTTGAAAACTACTGAGCAGAGCCCTGCTGCCTCTGGGTATTCTGT
TCACCACCCAGCCCTTTTGCATTTAATGAATGTAAAAAATAATGGGGCAGCTGCTGTTCCTTACTCTCTC
TTCCTGCTGCACTAAGTCTCTGTCTCCCTGGAGAGGCATTTAACCGCACGAAGGTTTATGGTGGAAATGA
CAAATTGCTTCTTCACAACGAGCTCACCCTGCTTTCTAACCAGTTGGAATCACCCTTGTTCATGTAATAT
TAGCAATTTACCTGTCTCCTTAACCACTAACCATCCTGAGAGGATTTGGCATTCTTTGCAGCTGTTAATC
CTCTCATCACCTGAGGGCTTATTAAATAGGTGGAGTGTACATCTAGCCTTTCTCCTACAGTGAACAGTCA
TTCATGATCTTTTCCTTTTTACTCAGCCTCTCTCCTCAGCTGCCTGAGCCCAGGATAAGGCAGGGTCCTC
CCCTCTAGAGGCCACAGCGGAGAGAGCTGGGCTCTGGACCGGGGAGTCCCGGTTTGACTCCTTGCTTGG
TCAGGACTTCCTCAACATAATCGCCTGGCCCTGGTGCCAGGGTGGTTGTGGGGCTGAGGGAGGTGCCTGT
GCAGCCCATTTCCCTGTGGAGGTCAGTTGCCCCTTTCCTTTCCCTTCATCAGGCTCAGGCCATCCTTGGG
GCAGCCCTGCTATCTGAGGGGGTCTCTCCCGAGCCGCTAAGACATAGTCCTCATTCATATTGGGTGTTGT
TGACAATCATCCCATCCTCTGCTGCTTCATTTTGTGACTTGTGGACCCAAGTGGGTCTTTGTTTATCCTG
ATCCAGGAGAGCTGGGAAGGGAGACAGTTTGAATTGCTCCGGGCATATGTTACTTGTTAATATTTTAAAA
TTTGACTTGTTGCAGTTTTTCAGAGGTATTAATCTAAAAGCCATTTCATGGAAAAAAGCAACAAGGAACT
GGTTTTATTTCTTTTAGGTGACACTAATAACCAAACATGAGACACATCAGAATTTAAGTGGCTAGTCAAA
AAAAAAAAAAAAATACCAGTGAAAATAGCAAGTCTACATTGATGTTAGTTGTTATATAACAGGCGCTGT
TCTAAGCGTTTTGCCTGTAGCAACTCACTGAATCCTCATAATTACTTTATGAAGAGGAGATTCAGTAACC
TGGTCACATAGGCAATGAATGGCCAGGATTCAGCCTCTAAAACTGGGTCTCCTGACCACGACGATCCCTC
TCTAGGGCTGATGGAGATCATCACTAAATCACCTCCTTTGGGATTCTCTGCTCGTTGGAAATGGAGTGTT
ACCTGCAGAGTACTGCTGTGACCTCTCCTTTAGGCCTCTCTGTGCAGAGACTGCAGTAGTCTGTGTTAGT
GCTGTCCTGTTGAAGCTGGTCCACACTTTTCTGGACTTCTGGTTGAGCCAGTCTGCTCAGATACGAACTT
CCAAACGAACCTGTTTCTCTTTGGTCCTCAGCCAGGCTTTGTGACATCAGCTGCTACAGCTGTGGAAACA
GTTGATAAACAGGGTCAGGCTGCTCAGAGGGAGAATGTGGCAGTAGGGTCCCTGGCAAGGGTTGCCTGCT
CACTTGGAAGGGCAAAGGCCTAGAAATCCACGCGCAATTGATGCACAAGCTGTCATTGTGCTGAGGCTTG
TGGGCAGGGGGGTGTGTTTCTCTTTCCTTCTCCCCTTTTCTTCCTCTCTTTCCCTTGCTCTCTTTCTTTC
TTCCTCCTTCCCTTCCTCTTTCCTTCCTCCCTTTCTTTCTCCTTTGAAAAACTAAGATGAGGTCCTGGTA
AAGATAGTACATAGAAGAGAGGCTTCAAGCCTCAAAAAGTTATTTCGATAATATAGTAAGTCACTGCTCC
TTATTAAATAAGAGGCCTAAGGGGCTGAGGTGGTGAGGGATTGAAGTGAAGTCTGGCTTGGTTCAGGCCT
GAATACCCAAACCAGGCCAGCTTTGGGTTGGGTTGGCTCTGCCTGGCATGAGGAGACATCCAAGGATTCC
GTCTCCCTCAGAGAGCCATGCTGGGAAATCTTCTAAGCATTGGACTTTGAGGTTAAAATAAAGAGTCTTG
CACCCTTGGCGGGGATTTCTGAAAGATTGATGGGATTCTAACTGCCTAACAGTTCCATTTCCAGATGAGC
GCCCTCCGTGCATGGGCTTTGTAGCAGCTCTCTGCCTTTCCTTGCCAAATGACCCTATTTGATCTGGAGC
CCTGGCTTGACTTTTCTCTTCAGCATCTGCTGTTTTCTGACCAATCCCACACCTTCCCTGGTTTTCTCT
TTTACAGAAATCCTTTCTTCCAACTTGATTAGATTTCTTTGTTGGCTTGCACATCTGGTCTTCATTTAGT
AGGGATGACACTTAATTGAAGTAAGAGTTTGGCTGCCTTTAAATTTAACAACTGCACCCTGCTGGGGTG
CTGATGAGGAGTCAGTAGCTGAATTGTTTATTGAAAGAGATCATATTGATTTGTGATTTTCACTTAAGAA
ATGCATTCCCACACACCCCTGCATTTAGTTGCTTAGCTGGGCACTCAGACAGCTGCTTTAAGAATCCAGT
ACCCTTGTCTCTGGAGAGGCGTTTCTCCTCAGTGTGCATGCAGTACTACTGTATGCACGTGGCATGTGTC
CATCTGTCCTCACAGAGGAGACTGTGCATTGGTAGAGCTGGAGGGCTCCTGTTGTCCACCCAGCATGCCA
CTTTGAACCAGCTCCTAAAGCATGAGGTCCCATCATGTCTCTATTCAAAAACTTTCAGTGGCTCCTCATTG
CCTGTGAATGAAATATGGAATCTCAGCGGGCGGTCAGGGCCTCCCAGTCTGGCTTCACTGTGCCTGTCC
AACTCATTTCCTATGATTGCCATGCAGAAACCCAGTTCTCTGGCCACACCGAATTTCTTACAATCTTCCC
ATTCACTTGGCCATTCTGCCTTTATGTTTTTCACTTTCTCTGGAATTTCCTCCCTCCCTTTCCTGCCTGT
ATGGTCTCAGTTCTTCAAAGCCCATTTCAAATGAAAACCTTTGCTACGAAATCTTCCCTGATTCCTCTCA
CCTATAGTGCACCCCTTTGAACTCAGACACCCTCTCTGTATTTCTCTTCAGGTATTTTAGCTCACTTTAT
GTTATAATTGTTTTTATGATTGTTGTTTATTCTTATTCAACAGAGTCACTACCTGAGAGCAGTGACCTTG
TGTTGGTCACATGTGTCCCCTGAAGGATACAGCTCAGTGCTTGGGGTAGTAATAATTGATATTCTTGAGT
GCTCACTACATGCCAGTTCTATTCTAAGCACTATACATGTATTCATCTTGGTTGATCCTCACAAAAGCCC
TTGGAGGGAGGTACTGTTATTAGCCCCATTTTACAGATAAGGTAACTGAGATCTAGGCTGAGTAACTTGC
CTAAGGCTACCCAGGTAGCAAGCAGCAGAGCTGGGGTCCACCTGGGCCTTCTGAATCCAGGCTCTCAAC
TAGTAAGCCACATGGCTTCTTTCATTAGCTACTTGCTCAATACATATCTATCAAGAAAAGTTGTACTGAA
GTTAAGAGATATAGGGGAGCAGGAATGGGTTAGTTTAAAAACAAGGAGAGGGAAGAAGAGAAGGAAATTA
```

FIGURE 478 cont'd

GAATGGGCCAGTAGGAAAAGAAAAGAAAGGAGAAGTGCTAAGAAACCAAGGAACAGGCCAGGCGCGGTGG
CTCACGCCTGTAATCCCAGCACCTTGGGAGGCTGAGGCATGTAAATCACTTGAGGTCAGAAGTTCGAGAC
AGCCTGACCAACATGGAGAAACCCTGTCTCGACTAAAAATACAAAAACTAAAAATACAAAAATTAGCCGG
ATATGGTGGTGTGCACCTGTAGTCCCACACTCAAGAGGCTGAGGCAGGAGAATCGCTTGAACCAGGGAGG
CGGAGGTTGCAGTGAGCTGAGATTGTGCCATTGCACTCTAACCTGGGCAACAAGAGTGAAACTCCATCT
C

FIGURE 479
SEQ ID NO: 472
Genbank ID       : NM_002358.2
Unigene ID(#167) : Hs.79078
Unigene name     :     MAD2   mitotic   arrest   deficient-like   1   (yeast)
     MAD2L1
>gi|6466452|ref|NM_002358.2| Homo sapiens MAD2 mitotic arrest deficient-
like 1
(yeast) (MAD2L1), mRNA
GGGAAGTGCTGTTGGAGCCGCTGTGGTTGCTGTCCGCGGAGTGGAAGCGCGTGCTTTTGTTTGTGTCCCT
GGCCATGGCGCTGCAGCTCTCCCGGGAGCAGGGAATCACCCTGCGCGGGAGCGCCGAAATCGTGGCCGAG
TTCTTCTCATTCGGCATCAACAGCATTTTATATCAGCGTGGCATATATCCATCTGAAACCTTTACTCGAG
TGCAGAAATACGGACTCACCTTGCTTGTAACTACTGATCTTGAGCTCATAAAATACCTAAATAATGTGGT
GGAACAACTGAAAGATTGGTTATACAAGTGTTCAGTTCAGAAACTGGTTGTAGTTATCTCAAATATTGAA
AGTGGTGAGGTCCTGGAAAGATGGCAGTTTGATATTGAGTGTGACAAGACTGCAAAAGATGACAGTGCAC
CCAGAGAAAAGTCTCAGAAAGCTATCCAGGATGAAATCCGTTCAGTGATCAGACAGATCACAGCTACGGT
GACATTTCTGCCACTGTTGGAAGTTTCTTGTTCATTTGATCTGCTGATTTATACAGACAAAGATTTGGTT
GTACCTGAAAAATGGGAAGAGTCGGGACCACAGTTTATTACCAATTCTGAGGAAGTCCGCCTTCGTTCAT
TTACTACTACAATCCACAAAGTAAATAGCATGGTGGCCTACAAAATTCCTGTCAATGACTGAGGATGACA
TGAGGAAAATAATGTAATTGTAATTTTGAAATGTGGTTTTCCTGAAATCAGGTCATCTATAGTTGATATG
TTTTATTTCATTGGTTAATTTTTACATGGAGAAAACCAAAATGATACTTACTGAACTGTGTGTAATTGTT
CCTTTATTTTTTTGGTACCTATTTGACTTACCATGGAGTTAACATCATGAATTTATTGCACATTGTTCAA
AAGGAACCAGGAGGTTTTTTTGTCAACATTGTGATGTATATTCCTTTGAAGATAGTAACTGTAGATGGAA
AAACTTGTGCTATAAAGCTAGATGCTTTCCTAAATCAGATGTTTTGGTCAAGTAGTTTGACTCAGTATAG
GTAGGGAGATATTTAAGTATAAAATACAACAAAGGAAGTCTAAATATTCAGAATCTTTGTTAAGGTCCTG
AAAGTAACTCATAATCTATAAACAATGAAATATTGCTGTATAGCTCCTTTTGACCTTCATTTCATGTATA
GTTTTCCCTATTGAATCAGTTTCCAATTATTTGACTTTAATTTATGTAACTTGAACCTATGAAGCAATGG
ATATTTGTACTGTTTAATGTTCTGTGATACAGAACTCTTAAAAATGTTTTTTCATGTGTTTTATAAAATC
AAGTTTTAAGTGAAAGTGAGGAAATAAAGTTAAGTTTGTTTTAAAAAAAAAAAAAAAAAA

FIGURE 480
SEQ ID NO: 472
Genbank ID       : AI241896
Unigene ID(#167) : Hs.48653
Unigene name     :     CDNA FLJ39593 fis, clone SKNSH2001222.
>gi|3837293|gb|AI241896.1|AI241896 qu70h07.x1 NCI_CGAP_Brn35 Homo sapiens
cDNA
clone IMAGE:1977469 3' similar to contains Alu repetitive element;, mRNA
sequen
ce
GCAAGCAAAATATTTTATTGAAAATTCAGAAAAGTTACAACACTTTAAGACAGCGTTTTTCATATTCTGT
TATAAAGAAAAATGTTAAAAGAATTGACTTGAATGTTATATTTAGGTTTCATTCAAACTAACAAAATCAT
TTTGAAAAACAAAAATCCACCCACAGCTGAATTATTCAGGGGTGTAAACATATATTTTCTATTTTGTTAT
CAAGAAAACGCTATGAAATATTNTTTNAGTGTTCTTTTCAAAACAGCATCTTTCTGGACCCATTAAATAG
TATTTAGTNTTAGATTCTATCACATAGATCTGTTTGTGGGGGGGTGCTGCTATAACTGTGACCAGGNCT
GTAGGACAGCTATTTATTTGAAATTTAGATNNAGAAGATTTGCTTTTACTTATATAGGGCATAAAACAAT
CTAGCTTTTTGGGCTGTTCTATCTTTAAGCACAAACACTTCNNAAAGTAGCCCTTTATGGGGCCCGGGTT
ACAAATATCAATGTGCCCCAGTTACTTTCTCGGAATTGGTGGGGGGGCACTCACTTCGAACCAAGTTTC
AATTTTTAAGAGGCTCGTGCAAAAGGCACACTCATTAAAAAGATTTGG

FIGURE 481
SEQ ID NO: 473
Genbank ID        : AF316824.1
Unigene ID(#167)  : Hs.435655
Unigene name      :        asporin (LRR class 1)    ASPN
>gi|13625796|gb|AF316824.1| Homo sapiens asporin precursor (ASPN) mRNA, complet
e cds
CTTCTACACTAAGACACCATGAAGGAGTATGTGCTCCTATTATTCCTGGCTTTGTGCTCTGCCAAACCCT
TCTTTAGCCCTTCACACATCGCACTGAAGAATATGATGCTGAAGGATATGGAAGACACAGATGATGATGA
TGATGATGATGATGATGATGATGATGAGGACAACTCTCTTTTTCCAACAAGAGAGCCAAGAAGCCAT
TTTTTTCCATTTGATCTGTTTCCAATGTGTCCATTTGGATGTCAGTGCTATTCACGAGTTGTACATTGCT
CAGATTTAGGTTTGACCTCAGTCCCAACCAACATTCCATTTGATACTCGAATGCTTGATCTTCAAAACAA
TAAAATTAAGGAAATCAAAGAAAATGATTTTAAAGGACTCACTTCACTTTATGGTCTGATCCTGAACAAC
AACAAGCTAACGAAGATTCACCCAAAAGCCTTTCTAACCACAAAGAAGTTGCGAAGGCTGTATCTGTCCC
ACAATCAACTAAGTGAAATACCACTTAATCTTCCCAAATCATTAGCAGAACTCAGAATTCATGAAAATAA
AGTTAAGAAAATACAAAAGGACACATTCAAAGGAATGAATGCTTTACACGTTTTGGAAATGAGTGCAAAC
CCTCTTGATAATAATGGGATAGAGCCAGGGGCATTTGAAGGGGTGACGGTGTTCCATATCAGAATTGCAG
AAGCAAAACTGACCTCAGTTCCTAAAGGCTTACCACCAACTTTATTGGAGCTTCACTTAGATTATAATAA
AATTTCAACAGTGGAACTTGAGGATTTTAAACGATACAAAGAACTACAAAGGCTGGGCCTAGGAAACAAC
AAAATCACAGATATCGAAAATGGGAGTCTTGCTAACATACCACGTGTGAGAGAAATACATTTGGAAAACA
ATAAACTAAAAAAAATCCCTTCAGGATTACCAGAGTTGAAATACCTCCAGATAATCTTCCTTCATTCTAA
TTCAATTGCAAGAGTGGGAGTAAATGACTTCTGTCCAACAGTGCCAAAGATGAAGAAATCTTTATACAGT
GCAATAAGTTTATTCAACAACCCGGTGAAATACTGGGAAATGCAACCTGCAACATTTCGTTGTGTTTTGA
GCAGAATGAGTGTTCAGCTTGGGAACTTTGGAATGTAATAATTAGTAATTGGTAATGTCCATTT

FIGURE 482
SEQ ID NO: 474
Genbank ID        : NM_000926.1
Unigene ID(#167)  : Hs.2905
Unigene name      :        progesterone receptor    PGR
>gi|4505766|ref|NM_000926.1| Homo sapiens progesterone receptor (PGR), mRNA
CTGACCAGCGCCGCCCTCCCCCGCCCCCGACCCAGGAGGTGGAGATCCCTCCGGTCCAGCCACATTCAAC
ACCCACTTTCTCCTCCCTCTGCCCCTATATTCCCGAAACCCCCTCCTCCTTCCCTTTTCCCTCCTCCCTG
GAGACGGGGGAGGAGAAAAGGGGAGTCCAGTCGTCATGACTGAGCTGAAGGCAAAGGGTCCCCGGGCTCC
CCACGTGGCGGGCGGCCCGCCCTCCCCCGAGGTCGGATCCCCACTGCTGTGTCGCCCAGCCGCAGGTCCG
TTCCCGGGGAGCCAGACCTCGGACACCTTGCCTGAAGTTTCGGCCATACCTATCTCCCTGGACGGGCTAC
TCTTCCCTCGGCCCTGCCAGGGACAGGACCCCTGCGAAAAGACGCAGGACCAGCAGTCGCTGTCGGA
CGTGGAGGGCGCATATTCCAGAGCTGAAGCTACAAGGGGTGCTGGAGGCAGCAGTTCTAGTCCCCAGAA
AAGGACAGCGGACTGCTGGACAGTGTCTTGGACACTCTGTTGGCGCCCTCAGGTCCCGGGCAGAGCCAAC
CCAGCCCTCCCGCCTGCGAGGTCACCAGCTCTTGGTGCCTGTTTGGCCCCGAACTTCCCGAAGATCCACC
GGCTGCCCCCGCCACCCAGCGGGTGTTGTCCCCGCTCATGAGCCGGTCCGGGTGCAAGGTTGGAGACAGC
TCCGGGACGGCAGCTGCCCATAAAGTGCTGCCCCGGGGCCTGTCACCAGCCCGGCAGCTGCTGCTCCCGG
CCTCTGAGAGCCCTCACTGGTCCGGGGCCCCAGTGAAGCCGTCTCCGCAGGCCGCTGCGGTGGAGGTTGA
GGAGGAGGATGGCTCTGAGTCCGAGGAGTCTGCGGGTCCGCTTCTGAAGGGCAAACCTCGGGCTCTGGGT
GGCGCGGCGGCTGGAGGAGGAGCCGCGGCTGTCCCGCCGGGGCGGCAGCAGGAGGCGTCGCCCTGGTCC
CCAAGGAAGATTCCCGCTTCTCAGCGCCCAGGGTCGCCCTGGTGGAGCAGGACGCGCCGATGGCGCCCGG
GCGCTCCCCGCTGGCCACCACGGTGATGGATTTCATCCACGTGCCTATCCTGCCTCTCAATCACGCCTTA
TTGGCAGCCCGCACTCGGCAGCTGCTGGAAGACGAAAGTTACGACGGCGGGCCGGGGCTGCCAGCGCCT
TTGCCCCGCCCGGAGTTCACCCTGTGCCTCGTCGTCCACCCGGTCGTGAGGGGGACTTCCCCGACTGCGC
GTACCCGCCCGACGCCGAGCCCAAGGACGACGCGTACCCTCTCTATAGCGACTTCCAGCCGCCCGCTCTA
AAGATAAAGGAGGAGGAGGAAGGCGCGGAGGCCTCCGCGCGCTCCCCGCGTTCCTACCTTGTGGCCGGTG
CCAACCCCGCAGCCTTCCCGGATTTCCCGTTGGGGCCACCGCCCCCGCTGCCGCCGCGAGCGACCCCATC
CAGACCCGGGGAAGCGGCGGTGACGGCCGCACCCGCCAGTGCCTCAGTCTCGTCTGCGTCCTCCTCGGGG
TCGACCCTGGAGTGCATCCTGTACAAAGCGGAGGGCGCGCCGCCCCAGCAGGGCCCGTTCGCGCCGCCGC
CCTGCAAGGCGCCGGGCGCGAGCGGCTGCCTGCTCCCGCGGGACGGCCTGCCCTCCACCTCCGCCTCTGC
CGCCGCCGCCGGGGCGGCCCCGCGCTCTACCCTGCACTCGGCCTCAACGGGCTCCCGCAGCTCGGCTAC
CAGGCCGCCGTGCTCAAGGAGGGCCTGCCGCAGGTCTACCCGCCCTATCTCAACTACCTGAGGCCGGATT
CAGAAGCCAGCCAGAGCCCACAATACAGCTTCGAGTCATTACCTCAGAAGATTTGTTTAATCTGTGGGGA

FIGURE 482 cont'd

```
TGAAGCATCAGGCTGTCATTATGGTGTCCTTACCTGTGGGAGCTGTAAGGTCTTCTTTAAGAGGGCAATG
GAAGGGCAGCACAACTACTTATGTGCTGGAAGAAATGACTGCATCGTTGATAAAATCCGCAGAAAAAACT
GCCCAGCATGTCGCCTTAGAAAGTGCTGTCAGGCTGGCATGGTCCTTGGAGGTCGAAAATTTAAAAAGTT
CAATAAAGTCAGAGTTGTGAGAGCACTGGATGCTGTTGCTCTCCCACAGCCAGTGGGCGTTCCAAATGAA
AGCCAAGCCCTAAGCCAGAGATTCACTTTTTCACCAGGTCAAGACATACAGTTGATTCCACCACTGATCA
ACCTGTTAATGAGCATTGAACCAGATGTGATCTATGCAGGACATGACAACACAAAACCTGACACCTCCAG
TTCTTTGCTGACAAGTCTTAATCAACTAGGCGAGAGGCAACTTCTTTCAGTAGTCAAGTGGTCTAAATCA
TTGCCAGGTTTTCGAAACTTACATATTGATGACCAGATAACTCTCATTCAGTATTCTTGGATGAGCTTAA
TGGTGTTTGGTCTAGGATGGAGATCCTACAAACACGTCAGTGGGCAGATGCTGTATTTTGCACCTGATCT
AATACTAAATGAACAGCGGATGAAAGAATCATCATTCTATTCATTATGCCTTACCATGTGGCAGATCCCA
CAGGAGTTTGTCAAGCTTCAAGTTAGCCAAGAAGAGTTCCTCTGTATGAAAGTATTGTTACTTCTTAATA
CAATTCCTTTGGAAGGGCTACGAAGTCAAACCCAGTTTGAGGAGATGAGGTCAAGCTACATTAGAGAGCT
CATCAAGGCAATTGGTTTGAGGCAAAAAGGAGTTGTGTCGAGCTCACAGCGTTTCTATCAACTTACAAAA
CTTCTTGATAACTTGCATGATCTTGTCAAACAACTTCATCTGTACTGCTTGAATACATTTATCCAGTCCC
GGGCACTGAGTGTTGAATTTCCAGAAATGATGTCTGAAGTTATTGCTGCACAATTACCCAAGATATTGGC
AGGGATGGTGAAACCCCTTCTCTTTCATAAAAAGTGAATGTCATCTTTTTCTTTTAAAGAATTAAATTTT
GTGG
```

FIGURE 483
SEQ ID NO: 475
Genbank ID        : AF334676.1
Unigene ID(#167)  : Hs.414648
Unigene name      :      tektin 3      TEKT3
>gi|13183786|gb|AF334676.1|AF334676 Homo sapiens testicular microtubules-relate
d protein TEKTIN3 (TEKT3) mRNA, complete cds
```
GTGGTAGGCTGCGACCCCTTCCTCCCACAGCCCCTTCCCGCCCCTCGCCGGGCATCCGCCGACAGGACAG
GAGAGATTTACAAATAGTGTTTTGGCATCATGGAACGTGTAGGTTGTACTTTAACGACAACTTACGCCCA
CCCTAGACCAACACCAACCAACTTTCTACCAGCCATCAGTACCATGGCCTCAAGCTACAGGGACCGCTTT
CCCCACTCCAATTTGACCCATAGCCTGAGCCTTCCTTGGAGACCCAGCACATACTACAAAGTCGCCTCCA
ATTCCCCAAGCGTGGCCCCGTACTGCACCAGATCACAGAGGGTGTCCGAGAATACCATGCTTCCCTTTGT
TTCCAACAGAACCACTTTCTTCACAAGATACACACGGATGACTGGTACAGGTCCAATTTAACCAACTAT
CAAGAGTCCAACACTTCCCGACATAATTCGGAGAAACTAAGAGTGGATACATCTCGCCTGATTCAAGACA
AATATCAACAAACAAGAAAAACTCAGGCAGACACAACCCAAAATCTGGGAGAACGTGTCAATGACATAGG
GTTTTGGAAATCTGAAATCATTCATGAGTTGGATGAAATGATTGGAGAGACAAATGCACTTACTGATGTG
AAGAAAAGACTGGAGCGGGCTTTGATGGAGACTGAAGCCCCTCTTCAGGTAGCCCGAGAATGTCTATTTC
ATCGAGAAAGAGAATGGGAATCGACCTAGTTCACGATGAAGTTGAAGCACAACTGCTGACGGAAGTTGA
TACTATTCTGTGTTGTCAAGAAAGAATGAAGCTACATTTGGATAAGGCTATTGCCCAACTTGCAGCCAAC
AGAGCGTCCCAGCATGAGCTGGAAAAGGACCTGAGTGACAAACAGACGGCTTACCGGATCGACGACAAAT
GCCACCACCTGCGCAACACATCAGACGGTGTCGGCTACTTCCGCGGAGTGGAGAGGGTCGATGCAACTGT
CTCAGTGCCTGAGTCCTGGGCCAAATTTACAGATGACAATATTCTCCGCTCCCAGAGTGAACGGGCAGCT
TCCGCTAAGCTAAGAGACGACATTGAAAACCTCTTGGTTGTGACTGCCAATGAGATGTGGAATCAATTCA
ACAAAGTGAACTTGTCTTTCACCAATCGCATTGCTGAGACTGCAGATGCTAAGAATAAGATTCAGACGCA
CTTAGCAAAGACCCTGCAGGAGATTTTCCAGACTGAAATGACCATAGAATCCATCAAGAAGGCCATCAAG
GACAAGACTGCCTTCCTGAAGGTGGCTCAGACCAGACTGGATGAGCGCACAAGACGGCCGAACATTGAGT
TGTGCCGAGACATGGCTCAGCTACGCCTTGTTAACGAGGTACACGAGGTTGACGACACCATCCAGACCCT
GCAGCAGCGCCTGAGGGATGCAGAGGACACCCTGCAGTCGCTGGTCCACATCAAAGCCACACTCGAGTAT
GACCTGGCTGTCAAAGCCAATTCCCTGTACATCGACCAGGAAAATGCATGAGCATGCGCAAGAGCTACC
CCAACACCCTCCGGCTGGTCGGCTTCTGCTAGGGACCCCACCGGGTGTGGTTTTGATACCCCTAAGTTAA
GGCTGAGCCAGAGCACTGTCTCAGCATTTGAACCGAATGCTAATATAGTCACTTATTAAAGGATTATGCT
GATGGAAATGTACCAAAAAAAAAAAAA
```

FIGURE 484
SEQ ID NO: 476
Genbank ID        : AF109294.1

FIGURE 484 cont'd

```
Unigene ID(#167) : Hs.459541
Unigene name     :     methylthioadenosine phosphorylase    MTAP
>gi|4378719|gb|AF109294.1|  Homo  sapiens  hypothetical  methylthioadenosine
phosph
orylase fusion protein mRNA, complete cds
GAATTCCGCTCCGCACTGCTCACTCCCGCGCAGTGAGGTTGGCACAGCCACCGCTCTGTGGCTCGCTTGG
TTCCCTTAGTCCCGAGCGCTCGCCCACTGCAGATTCCTTTCCCGTGCAGACATGGCCTCTGGCACCACCA
CCACCGCCGTGAAGATTGGAATAATTGGTGGAACAGGCCTGGATGATCCAGAAATTTTAGAAGGAAGAAC
TGAAAAATATGTGGATACTCCATTTGGCAAGCCATCTGATGCCTTAATTTTGGGGAAGATAAAAAATGTT
GATTGCATCCTCCTTGCAAGGCATGGAAGGCAGCACACCATCATGCCTTCAAAGGTCAACTACCAGGCGA
ACATCTGGGCTTTGAAGGAAGAGGGCTGTACACATGTCATAGTGACCACAGCTTGTGGCTCCTTGAGGGA
GGAGATTCAGCCCGGCGATATTGTCATTATTGATCAGTTCATTGACAGGACTATTTGCCACGACATTTCA
AAGGATTCCAAGAGAGAATATTGGTGTCCATGCTGTGATGATTCCTCAGCTCCTCTCATCTGATCTCCGT
CCTGGCCCCCATGACTTTCTTTGCGGTAGTTAGGGTGTGGTATGTGCCACTGAGGCCCACACCTATTGGC
AATTTATAGCACTGATCTGTCATCAATACCACTTGCTGTCTTGGATGTGAAGATGATTTTTCCTGCAGGG
ATTCCCTCTACAAAATTAAAAACACTGGGCATGTGGAAATAATATTCACGCTTTAAATTGTCTTTTCTAT
TCACTACACCAGGGGTCCCCGACCCCTAGGCAACAGACTGTGGCCCTAGTGTAGTGAATAGAAAAGACAA
TTTAAAGCATGAATATTATTTCCTCATGCCCAGTGTTTTTAATTTTGGTACTGGTCTGTGGCTTGTTAGA
AACCAGGCTGCACAGCAGAAGGTGGGCAGCAG
```

FIGURE 485
SEQ ID NO: 477

```
Genbank ID       : AL162032.1
Unigene ID(#167) : Hs.23644
Unigene name     :    G protein-coupled receptor 133    GPR133
>gi|7328046|emb|AL162032.1|HSM802546 Homo sapiens mRNA; cDNA DKFZp434B1272
(fro
m clone DKFZp434B1272); partial cds
GTCATGGAGTGTCTGCACGGGACGTCCTGGAGAGTCGGACACGTAAGCAGCACAGTGAGGCCACCAACAG
CAGCAACCGAGTCTTCGTGTACTGCGCCTTCCTGGACTTCAGCTCCGGAGAAGGGGTCTGGTCGAACCAC
GGCTGTGCGCTCACGAGAGGAAACCTCACCTACCTCTGCCGCTGCACTCACCTCACCAACTTTGCCA
TCCTCATGCAGGTGGTCCCGCTGGAGGTCAACATTGGCATCCTCATCGCTGTGACCAGAGTCATCTCACA
GATCAGCGCCGACAACTACAAGATCCATGGAGACCCCAGTGCCTTCAAGTTGACGGCCAAGGCAGTGGCC
GTGCTGCTGCCCATCCTGGGTACCTCGTGGGTCTTTGGCGTGCTTGCTGTCAACGGTTGTGCTGTGGTTT
TCCAGTACATGTTTGCCACGCTCAACTCCCTGCAGGGACTGTTCATATTCCTCTTTCATTGTCTCCTGAA
TTCAGAGGTGAGAGCCGCCTTCAAGCACAAAACCAAGGTCTGGTCGCTCACGAGCAGCTCCGCCCGCACC
TCCAACGCGAAGCCCTTCCACTCGGACCTCATGAATGGGACCCGGCCAGGCATGGCCTCCACCAAGCTCA
GCCCTTGGGACAAGAGCAGCCACTCTGCCCACCGCGTCGACCTGTCAGCCGTGTGAGCCGGGAGGCTGCC
AACCAGGCCAGGCTGCGCTCAGAACACACCCCCCAAACAGAATGAAATGCCCCACCTTTGCCCATGGAC
CCTCTCCTTGCTGCTGTCTGGACATGGGTGTTGTGGCCCCGAGACAGCTGTCCTCCCCTGTGACTCTGGC
TGTCGGAGCACACTGCTCAGCCCAGCAGCCTGATGCCCAGGCCAGCGTGGGCCCTCCTGCCTTGCATCCA
CCCGTGGGCTGAGTGACTTCCTCGGAGGATTCCCAGGACACGACTGGCCTGACTGTGATGGTGCCCTTGAG
CCTCCCTTCATCACTCAGCATCAGACCCAGCGAGGCCAGGACACTCGGGGCCGGTCCCGCAGCACCAGGA
GGGGATGTTCAGCCTCTGTGCCTTGGTGGGCTTGGGGACTCAGGGCCAAAGAGGTGGTTCAGGTCCCCA
CGCACCCTCAGTCAGGCGCAGGCAGCTGGGGGTGTGTGGGGAAGAGCATGCGGAGTCCCCAGTGTCTGAA
TCCACTGAGTGGTGAGTTCCCCACAGCCGGCGCTAGCCGTGGTGTGTGTCTCTGTAGGTGGTGCCGGCGT
GGGCCAACCTGTGCTGTGTCATCAGTTGGGGGCCCCTGCCCAAGCCGAGCTCGAGCCGTGGGCGGGAGTC
GTTGACTCTCCAGGTGAGGGCGACCCCTCTGCCCTGTCCTTGCGGGGGTCCCCTCTGCTCACGTGAAGAG
CCGCTCTGGGCCTTGAGGCTGCCTGATGGTGCCTGTGCTTGGGGAGCTTCTCGGCCATCCGCTGTGAGT
TTTGCCTCTTTGGACCCCAATTCGGCCTTAAGATGCCCTCCTCCCTCGTGTGCCAGCCTCCTTGGTTGTT
CTTGGGCCACAGGAGCTGGCCGTGTCCCGCAGTGCCTGGTGTCCAGGTGGAAAGTGGAGGGCATTTTCC
AGGGCACTGCTTTCCCCAGAGGCTTCCTCATGGCTCACAGGCACTCTACGAAGTTTCTAATGGGCAGACC
ACGCGGCAGGTAGCACAGTGCGTCCGTCTGGTCACCATGAGACCGACCTGCGCTGAGTCCCCACTGACC
TGGAGAGGGAGGGCTGGTGACAGCCGTGTCTTCTGTGTTGAGGGAAATTTATGGACTCAGACTCAGCCCC
AGAGGAGATGGGATAATTGTTATGGACCCATGTGTGGGCATGATCCTGTGGAACACAGGTTTGGGATCAT
AGATGTGAATTAAGACACCACCGAGATACGGGCTGTGAGGTTCATACTGTGCTGATAGCACTCGTGGTGT
CTGTGAAATGTGGGTAAGACATTCAAACCTGGTTTTGATACTGGAAACTCTTCCTTTAAAACTGTGACCA
TGATTTCATTCAGCCCCTCCACACCCCTATGTCTGCCTTGTTTCAGAGTGAGTTTTCTATGGAGCCTGTG
```

FIGURE 485 cont'd

GCCCTTTTGCAGCCCACCTGGTGGCTTCTTAATGTAACTCTTCCCCTGGTCGCCTGGAGTGGACCACTCA
TCTGCAGGCCTCTCCTGCATGGGGAGGGTAGGCAGGGAGCAGCATGTCTGCAGGGGTGAACCTTTGCTCT
TCTGTCAGGCGAGGCCCAGGCTGCACCAGCCACCTGCCACATGGTGACAGTGCCACGGGCCCTGCGTATG
GCCCCTGCAACCGTGCTCTGGCGGGCACACCTGGCTGCTGCAGGCCAAGGCCGCTGTTCAGTGAAGAGTC
CCATGTTTAGTATGGACTAAAGTCCCATGTTTAGCCACTGCCCCAGGCTCCCGTGACCCCAGAAACCAGG
TCACATGGACCACAGTGCCAGATCCTCATCACGCCGGTGAGCACCTAGAAGTGAGAACACTGTATTCCTA
CAATGTACACTTGGATATTTCTCCTTATTTAGTTTCTAGTGAAACAAATCAAGTAAGGAACTATCTTTAG
TTTAGATGGAATTATTTGTTTTTAATTGTTGCCGTATTCATCTATATAGCTAATATTTCAAGATAAGTAA
TGAACAAAACCTGTCTAAACCTTTTGTTTCCAATGAATGAAAGTCATGCACTTTATTTATAGGCTCTATG
TTTTGGCTTCTGCAGTACTTTTATTATCTATACATAATTTGGCCAAAAATAAGAAATTGGAAAGAATGAA
ATGTTTAGTTTATAGTAGAAGAAAGATGATGACACTAAGTTGTGAAAATATGTTGTGATTTTTATGAAAT
AAACTCATGTCCTGAAAAAAAAAA

FIGURE 486
SEQ ID NO: 478
Genbank ID        : BE835502
Unigene ID(#167)  : acc_BE835502
Unigene name      :
>gi|10267880|gb|BE835502.1|BE835502  RC5-FN0023-190600-022-F04  FN0023  Homo sapie
ns cDNA, mRNA sequence
AATTCAGTTTTCAGCAAAGCTTTAAACTTTTAACAGATTCCTCACAATAAGAAAAAATTTTAAAGTTCTA
CTATTAGACCAACTTTTACTATACAGTATTTCACATAAATCATGTTTTACATTTTTTTCTAATTACATAC
AGAAAAATTCTCCAATCAACACAAGAATGGCAGAGGAAAAAGATGCATTATGCTTGGCAGATGCAAATT
AAAACACACAGACAGAAAGAAGCAGTAAAATGTCAAATAAATCACACCCACTCTAAGTATCAATGAATAG
CTGATATGCATTGTTGGGAGAATCATTTCTGAATGAGTTTGTGAACAAGTTGTGCTTCTTATTAATTGTG
CACTTAAAAAATGACCACTAAAGAATAATTTAACTTGTTATTAATGTTCTCCAGATATTAAAAAAAAAAA
ATTATACCATTAACGTGATTACCAAGCACCTAATTTTGGAAAGGCTTCATAATGGATGTTTTCTTTTTCT
C

FIGURE 487
SEQ ID NO: 479
Genbank ID        : AI733287
Unigene ID(#167)  : Hs.203755
Unigene name      :   Transcribed sequence with moderate similarity to
protein sp:P12947 (H.sapiens) RL31_HUMAN 60S ribosomal protein L31
>gi|5054400|gb|AI733287.1|AI733287  oo52g05.x5  NCI_CGAP_Lu5  Homo sapiens cDNA cl
one IMAGE:1569848 3' similar to gb:X69181 60S RIBOSOMAL PROTEIN L31
(HUMAN);, m
RNA sequence
TTTTTAAACAAAAAAGGGAATTTATTGGTTCATGTATGTGAAAAATCATGAGGTCAGTCTGCTGGATGCT
TTGGCTGGATATAGGCGCACAGGATGTTGTCAGGTCTCTGCGTGCATCTCTATTTCTTGAGCATGTGTGC
AGCTTCTGTTAGTCTGTTACTTGTTCTGTCATACACATGAAGACATCTTTGTTTTCCTTGGTGTTGGCTT
CATTTTTTTTTTTTTTTTGCAGTTTTATAACTTTGTTTGATATAGTTGACAATCAGTGATTAGTTCTC
ATCCACAATGACTGTCTATAGATTTTGAAAGTGGTAACAGGTACATAGGTAACCGAAGTACAGAGCTTA
TTTGGTGAATCTTCATCCTCATTATATTCTCTGGAC

FIGURE 488
SEQ ID NO: 480
Genbank ID        : AL080207.1
Unigene ID(#167)  : Hs.134585
Unigene name      :   ATP-binding cassette, sub-family A (ABC1), member
12    ABCA12
>gi|5262695|emb|AL080207.1|HSM800732  Homo sapiens mRNA; cDNA DKFZp434G232
(from
 clone DKFZp434G232)

FIGURE 488 cont'd

```
CACTGCACTGGCCTTGATAGGGAAACCTTCCATTCTACTGCTGGATGAGCCGAGCTCTGGCATGGATCCG
AAGTCGAAACGGCACCTCTGGAAGATCATTTCAGAAGAAGTACAGAACAAATGTTCCGTCATCCTCACAT
CTCACAGCATGGAAGAATGTGAAGCTCTCTGTACCAGGTTGGCCATTATGGTGAATGGAAAGTTTCAATG
TATTGGATCTTTGCAGCACATAAAGAGCAGGTTTGGACGAGGATTTACTGTCAAAGTTCACTTGAAGAAT
AACAAAGTGACCATGGAGACCCTCACAAAGTTCATGCAGCTGCACTTTCCAAAAACATACTTAAAAGATC
AGCACCTCAGCATGCTAGAGTATCATGTACCAGTCACAGCAGGAGGAGTCGCAAACATTTTTGATCTGCT
GGAAACCAACAAGACTGCTTTAAATATTACAAATTTCTTAGTGAGTCAGACCACTCTGGAAGAGGTTTTC
ATCAACTTTGCCAAAGACCAGAAGTCCTATGAAACTGCTGATACCAGCAGCCAAGGTTCCACTATAAGTG
TTGACTCACAAGATGACCAGATGGAGTCTTAACACTTCCAGCAAACTCAATCTCAGCATGTGACCAATGG
CTTCATTTTGAAGAAAAGCCACAGAAGATACACTTCCGCAAGATATCTTCATTTTAAAGTAAAGTAATAT
ACTGTATGGAAAGTTACAACTGTGTTAGACTAACAAGTAATTATAAAAGGAAATTTTTCCTTCTAAGGTC
AGTGAGTGTTGTTGCTACTGAAATGAATTCCTGTATACTCAACACTGTGAGCATGCTAATGTATATGCTG
GTGATTCTTATGCAAAGGTGAAGCCACCTCAAGATGAATATCTTAATTTATTACTTTCAATAAAAAGACA
GTTTAAAAGGCAAAAAAAAAAAAA
```

FIGURE 489
SEQ ID NO: 481
Genbank ID           : U19970.1
Unigene ID(#167)     : Hs.51120
Unigene name         :      cathelicidin antimicrobial peptide   CAMP
>gi|643476|gb|U19970.1|HSU19970  Human   antimicrobial   LPS-binding   protein CAP18 p
recursor mRNA, complete cds
```
GCAGACATGGGGACCATGAAGACCCAAAGGGATGGCCACTCCCTGGGGCGGTGGTCACTGGTGCTCCTGC
TGCTGGGCCTGGTGATGCCTCTGGCCATCATTGCCCAGGTCCTCAGCTACAAGGAAGCTGTGCTTCGTGC
TATAGATGGCATCAACCAGCGGTCCTCGGATGCTAACCTCTACCGCCTCCTGGACCTGGACCCCAGGCCC
ACGATGGATGGGGACCCAGACACGCCAAAGCCTGTGAGCTTCACAGTGAAGGAGACAGTGTGCCCCAGGA
CGACACAGCAGTCACCAGAGGATTGTGACTTCAAGAAGGACGGGCTGGTGAAGCGGTGTATGGGGACAGT
GACCCTCAACCAGGCCAGGGGCTCCTTTGACATCAGTTGTGATAAGGATAACAAGAGATTTGCCCTGCTG
GGTGATTTCTTCCGGAAATCTAAAGAGAAGATTGGCAAAGAGTTTAAAAGAATTGTCCAGAGAATCAAGG
ATTTTTTGCGGAATCTTGTACCCAGGACAGAGTCCTAGTGTGTGCCCTACCCTGGCTCAGGCTTCTGGGC
TCTGAGAAATAAACTATGAGAGCAATTTCA
```

FIGURE 490
SEQ ID NO: 482
Genbank ID           : NM_003686.1
Unigene ID(#167)     : Hs.47504
Unigene name         :       exonuclease 1      EXO1
>gi|4504368|ref|NM_003686.1| Homo sapiens exonuclease 1 (EXO1), mRNA
```
GCACGAGGTGCCACATGCGATCTCTGAGATATGTACACAGTCATTCTTACTATCGCACTCAGCCATTCTT
ACTACGCTAAAGAAGAAATAATTATTCGAGGATATTTGCCTGGCCCAGAAGAAACTTATGTAAATTTCAT
GAACTATTATATCCGTTTTCCTCGGAGTGAGAGAAAACTCTTTTTAGATATCATCTGAGAGGTAGTTAAT
TTGGCACCATGGGGATACAGGGATTGCTACAATTTATCAAAGAAGCTTCAGAACCCATCCATGTGAGGAA
GTATAAAGGGCAGGTAGTAGCTGTGGATACATATTGCTGGCTTCACAAAGGAGCTATTGCTTGTGCTGAA
AAACTAGCCAAAGGTGAACCTACTGATAGGTATGTAGGATTTTGTATGAAATTTGTAAATATGTTACTAT
CTCATGGGATCAAGCCTATTCTCGTATTTGATGGATGTACTTTACCTTCTAAAAAGGAAGTAGAGAGATC
TAGAAGAGAAAGACGACAAGCCAATCTTCTTAAGGGAAAGCAACTTCTTCGTGAGGGAAAGTCTCGGAA
GCTCGAGAGTGTTTCACCCGGTCTATCAATATCACACATGCCATGGCCCACAAAGTAATTAAAGCTGCCC
GGTCTCAGGGGGTAGATTGCCTCGTGGCTCCCTATGAAGCTGATGCCGCAGTTGGCCTATCTTAACAAAGC
GGGAATTGTGCAAGCCATAATTACAGAGGACTCGGATCTCCTAGCTTTTGGCTGTAAAAAGGTAATTTTA
AAGATGGACCAGTTTGGAAATGGACTTGAAATTGATCAAGCTCGGCTAGGAATGTGCAGACAGCTTGGGG
ATGTATTCACGGAAGAGAAGTTTCGTTACATGTGTATTCTTTCAGGTTGTGACTACCTGTCATCACTGCG
TGGGATTGGATTAGCAAAGGCATGCAAAGTCCTAAGACTAGCCAATAATCCAGATATAGTAAAGGTTATC
AAGAAAATTGGACATTATCTCAAGATGAATATCACGGTACCAGAGGATTACATCAACGGGTTTATTCGGG
CCAACAATACCTTCCTCTATCAGCTAGTTTTTGATCCCATCAAAAGGAAACTTATTCCTCTGAACGCCTA
TGAAGATGATGTTGATCCTGAAACACTAAGCTACGCTGGGCAATATGTTGATGATTCCATAGCTCTTCAA
ATAGCACTTGGAAATAAAGATATAAATACTTTTGAACAGATCGATGACTACAATCCAGACACTGCTATGC
CTGCCCATTCAAGAAGTCGTAGTTGGGATGACAAAACATGTCAAAAGTCAGCTAATGTTAGCAGCATTTG
```

FIGURE 490 cont'd

GCATAGGAATTACTCTCCCAGACCAGAGTCGGGTACTGTTTCAGATGCCCCACAATTGAAGGAAAATCCA
AGTACTGTGGGAGTGGAACGAGTGATTAGTACTAAAGGGTTAAATCTCCCAAGGAAATCATCCATTGTGA
AAAGACCAAGAAGTGCAGAGCTGTCAGAAGATGACCTGTTGAGTCAGTATTCTCTTTCATTTACGAAGAA
GACCAAGAAAAATAGCTCTGAAGGCAATAAATCATTGAGCTTTTCTGAAGTGTTTGTGCCTGACCTGGTA
AATGGACCTACTAACAAAAAGAGTGTAAGCACTCCACCTAGGACGAGAAATAAATTTGCAACATTTTTAC
AAAGGAAAAATGAAGAAAGTGGTGCAGTTGTGGTTCCAGGGACCAGAAGCAGGTTTTTTTGCAGTTCAGA
TTCTACTGACTGTGTATCAAACAAAGTGAGCATCCAGCCTCTGGATGAAACTGCTGTCACAGATAAAGAG
AACAATCTGCATGAATCAGAGTATGGAGACCAAGAAGGCAAGAGACTGGTTGACACAGATGTAGCACGTA
ATTCAAGTGATGACATTCCGAATAATCATATTCCAGGTGATCATATTCCAGACAAGGCAACAGTGTTTAC
AGATGAAGAGTCCTACTCTTTTAAGAGCAGCAGCAAATTTACAAGGACCATTTCACCACCCACTTTGGGAACA
CTAAGAAGTTGTTTTAGTTGGTCTGGAGGTCTTGGAGATTTTTCAAGAACGCCGAGCCCCTCTCCAAGCA
CAGCATTGCAGCAGTTCCGAAGAAAGAGCGATTCCCCCACCTCTTTGCCTGAGAATAATATGTCTGATGT
GTCGCAGTTAAAGAGCGAGGAGTCCAGTGACGATGAGTCTCATCCCTTACGAGAAGGGGCATGTTCTTCA
CAGTCCCAGGAAAGTGGAGAATTCTCACTGCAGAGTTCAAATGCATCAAAGCTTTCTCAGTGCTCTAGTA
AGGACTCTGATTCAGAGGAATCTGATTGCAATATTAAGTTACTTGACAGTCAAAGTGACCAGACCTCCAA
GCTATGTTTATCTCATTTCTCAAAAAAGACACACCTCTAAGGAACAAGGTTCCTGGGCTATATAAGTCC
AGTTCTGCAGACTCTCTTTCTACAACCAAGATCAAACCTCTAGGACCTGCCAGAGCCAGTGGGCTGAGCA
AGAAGCCGGCAAGCATCCAGAAGAGAAAGCATCATAATGCCGAGAACAAGCCGGGGTTACAGATCAAACT
CAATGAGCTCTGGAAAAACTTTGGATTTAAAAAATTCTGAAAAGCTTCCTCCTTGTAAGAAACCCCTGTC
CCCAGTCAGAGATAACATCCAACTAACTCCAGAAGCGGAAGAGGATATATTTAACAAACCTGAATGTGGC
CGTGTTCAAAGAGCAATATTCCAGTAAATGCAGACTGCTGCAAAGCTTTTGCCTGCAAGAGAATCTGATC
AATTTGAAGTCCCTGTTTGGGAATGAGGCACTTATCAGCATGAAGAATTTTTTCTCATTCTGTGCCATTT
TAAAAATAGAATACATTTTGTATATTAACTTTAAAAAAAAAAAAAAAAAAA

FIGURE 491
SEQ ID NO: 483
Genbank ID        : AC074331
Unigene ID(#167)  : acc_AC074331
Unigene name      :
>gi|17437317|gb|AC074331.2|AC074331 Homo sapiens chromosome 19, BAC CTC-204F22
(BC228680), complete sequence
AAGCTTTACTTGCCCACATCTCTTAATTCTGTGTCATTATAGGAGGCAAGATCCAAATGGAGATGGAGAC
TGTTTCAGAATCAGGAACACATGAAGGCTTGTTCAGTCATCAAACCTGGGAACAAATTTCAAGTGACTTA
ACCAGGTTTCAAGACTCCATGGTAAACAGCTTTCAGTTCTCCAAACAAGATGATATGCCCTGCCAGGTTG
ATGCAGGACTATCTATAATTCACGTAAGACAGAAACCTTCTGAGGGTAGGACGTGTAAAAAGTCCTTTAG
TGATGTCTCCGTCCTTGATCTTCATCAACAACTACAGTCAAGAGAGAAGTCTCATACATGTGATGAATGT
GGAAAGAGTTTCTGTTATAGCTCAGCTCTTCGTATTCATCAGAGAGTTCACATGGGGGAGAAACTCTATA
ATTGTGATGTGTGTGGTAAGGAATTCAATCAGAGCTCACATCTGCAAATTCATCAGAGAATCCACACTGG
AGAGAAACCATTCAAATGTGAGCAGTGTGGGAAAGGCTTTAGTCGTAGATCAGGACTTTATGTTCATCGT
AAATTACACACAGGAGTGAAACCTCATATTTGTGAGAATGTGGGAAGGCCTTCATTCATGATTCCCAGC
TTCAGGAACATCAAAGAATCCATACTGGGGAGAAGCCATTCAAATGTGATATATGTTGTAAGAGCTTCCG
TAGTAGAGCAAATCTTAATAGGCATTCCATGGTTCACATGCGAGAGAAACCATTCAGATGTGATACATGT
GGTAAGAGCTTTGGTCTGAAATCAGCACTTAATAGTCATCGCATGGTCCACACAGGAGAGAAACGGTACA
AATGTGAGGAATGTGGAAAACGCTTCATTTATAGGCAAGATCTTTATAAGCATCAGATAGACCACACAGG
GGAGAAGCCATATAATTGTAAAGAATGTGGAAAGAGCTTCAGATGGGCCTCAGGTCTTTCAAGACATGTG
CGAGTCCACAGTGGAGAGACAACATTCAAATGTGAAGAATGTGGGAAGGGATTTTATACAAATTCACAAC
GTTATTCTCACCAGAGAGCGCACAGTGGAGAAAAGCCATATAGATGTGAGGAGTGTGGGAAGGGCTACAA
AAGGAGGTTGGATCTTGACTTTCATCAGAGGGTCCACAGAGGGAGAGAACCCTATAATTGTAAGGAATGT
GGGAAGAGCTTTGGCTGGGCCTCGTGTCTTTTGAATCATCAGAGAATCCACAGTGGAGAAAAACCATTTA
AATGTGAAGAATGTGGGAAAGATTTACTCAGAATTCACAACTTTATACCCATCGTAGAGTCCACAGTGG
AGAAAAACCATTCAAATGTGAAGAGTGTGGGAAAGATTTACTCAGAATTCACAACTTTATTCTCATCGC
AGAGTCCACACTGGAGTAAAGCCATACAAATGTGAAGAGTGTGGGAAGGGCTTCAACAGTAAGTTTAATC
TTGACATGCACCAGAGGGTCCACACCGGAGAGAGACCTTATAATTGTAAAGAATGTGGGAAGAGCTTTAG
CCGGGCCTCAAGTATTTTGAATCATAAGAGACTCCATGGTGATGAAAAGCCATTCAAATGTGAAGAGTGT
GGGAAGAGATTTACTGAGAATTCACAGCTTCATTCCCATCAGAGGGTTCACACTGGGGAAAAGCCATACA FIGURE 491 cont'd

```
AATGTGAGAAGTGTGGAAAGAGCTTCAGATGGGCCTCAACTCATCTAACCCATCAGAGACTCCACAGTAG
AGAAAAACTACTTCAATGTGAGGACTGTGGGAAGAGCATTGTGCACAGTTCATGCCTTAAAGACCAACAA
AGAGACCAAAGTGGAGAGAAAACATCTAAATGTGAGGACTGTGGGAAGCGCTACAAGAGGCGCTTGAATC
TTGATACGCTTTTGTCATTATTTTTAAATGACACATAACTGTTGTACTCATTTATGGGGTACAGTGTGAT
AGTTAATGCAAGTATACAATGTGTAATGATCAAATCAGTGTAATTAACATACCTATCACCTCAAACATTT
ATCATTTATTTATGTTGGGAACCCTTAAAATTCACTGTCCTAGCTATTTGAAAATAATACGTTGTTAATT
ACTGTCACCCTGTAGTGGTGTAAAACACTAGAACTTATTCCTCCTACCTGCCTGTATTTCTGTATTCATT
AACCAACCTTTGGCTACCACCCTGCCTCCTCACCTCTAAGAACTACTATTCTACTCTCTACTTCTATGAA
GTTAACTTTTTGAGCTTCCACATATGTGTGAGAACATGTGGTATGTATCTTTCTGTGCCTGGCATATATC
ACTTAATATAATGCCCTGTAAGTCTCATTCACTTTGCTGTGAGTGATAGAATTTTGTTGTTTTTCATGGC
TAAATAGTACTCTGATGTGTATATTTGCCCCATTTTCTTTATTCATTCATCCAGTGGACACTTAGGTTGA
TTACATACCTTGGCCTATTTCTTGGCTATCGTGAATGGTGCTGCAATAAACATGGGGGGGTGGAGATAAC
ACTTTAACATACTGATTTCCTTTTCTTTGGATATGTACCAAGTATCATATAATAGTATGACATGACTCAA
AATTAAGGAATAAGATTGTGGAAATTGGTTTTCAAAAAAAAATTCTCTAGTTTGAATATAGAGAAAAATT
GGTGAGTGTCTTCAGCTGTCCTCATACATAATGCATGTGAGCTCGCTTTAAGCATAAGTGAAGGAGTGGA
AAAATCCTGGAGATAGAAATCAAGGGGTATACATGTGGATGTAAAAAATCAACAAAGATTCTTTTAAGAA
AAGGTGTGTATGGGTAGGGAACAATAGCATGACAGCAGTGCGGCCTCTAACAGTCTGGAACCAGTTAGGA
AAAAGAGCAGGATTGAGCGCCATTCCATTCATAGACACCGTGGTGATATTTTGAGTACATTAGGTTAAAA
GGCTTTCTTCAGCAAAATCTATCTCTAGAGATAGATTTGATTTTTATAATCAAATCTACTAGAGATAGAT
TTGATTTTTATAATCAAATCTACTAGAGATAGATTTGATTTTTATAATCAAATCTACTAGAGATAGATTT
GATTTTTATAATCAAATCTACTAGAGATAGATTTGATTTTTATACTTAATGTTCTAGACTGTATCTTTTC
AGGATGCTAGGTACTTTATGAAGATCCATGCTGTCTCAATTTGCATAGTGGGTTGGAGGCCCTAAGACAA
TCTCTCCAGATTCTATGATTTGCTAAGAGGACTCAGAATATAGTTGTACTCATGACTATATTATAGTGAC
AGGATACAAATAATCAGCAAAGGGAAAAGGTTCTTGTATAATATCTGGAGGGAATCAGATGTAAATTTGT
AAAGATCCTTTGTGCATGGAGTAACAGGTCTCAATTCCTCCAGTATTGAATTGTGACTGTACTTGTGAAA
TGTCTACAATGGAAATTAATTATCAACCCGTACCAAAGGTTCTTATTGGAACTAATCATGTAGGTACCAT
CCCTCTGGGACATATCAAGATTCTAGACTCCAAGAAGGGGAGCAAGTGTTCAGAATAACTTGAACCATGC
CTACCAGTTATGGAATGGGGGCAACCCTCTCAAACTCCGTGTTTCCTAACACCAGCTAAAGGCCAGTCTT
ATAAGCAGTCCTTTCTAAGATTTGCAGTCTCAGGCCTGTCGTTATATTAACTTTTTGTGCACATAGTACTAGA
AAACTGTTGGCTCAGTCTTCTTTTTGTTTTGTGTGTTTTGGTTTTTAACTGTCACCGATACCAGAATAGC
TCATCTCCAAGGTAACTGTAACAGAACACTCAGCAGATTAAACAGAAAATACTTGCTTATTATAATTATT
AAAAGTTTGGTAGGGTCTATGTCTGCTCTCTGGTGTGTCCTGGATCATCAACTTGGTTACAACATGGTGT
TAACATGTGGGACTGATTGTGTTTCTTGTTAATATTTCTGTTTCTCCCAACCACGCTGAATATTAAATAC
CTAGTTCTATATCTAGTACCCTGAGCTTATGTGGGGCTAATATTCTTTGCCATTTTTCACCACAGATTTG
ATTTCCTTTTTCTTTTGTGGACACTGGTGAGTTCCCTAATATAACTTTGACTTGGTTATATTTTCACAAT
CGGTGGGGATTATTACAGATTATCATCCTTCCTCTGCATTTGAAAAAGGAGGGAGGCTTCAAGTCAGGTT
AGTTGACCTTCCTTTGTTGGTCTTATTATCCATAACATAATAAATAAATTGATGAGGATGGGCATGGTGG
CTCACGCTTGTAATTCCAGCATTTAGGGAGGCTGAGGCGGCGTTTTAGACCAGCCTAGCCAATGTGGTGA
AACCTCATCTCTACTAAAAATACAAAAAATATGCCAGGTGTGGTGGTGTGCGCCTGCAATCCTAGCTACT
CAGGAGGCTGAGGCAGGAGAATCGCTTGAGCCTAGGAGGCGGAAGTTTGCAGTGAGCCAGAATCGTGCCA
CTGTACTCCTGCCTGGGTGATACAGTGAGTCTCCATCTCAAAAAAATAAGTTTATGAGAAGTCTATTAAA
TTGTTACATAATCTATATAGGTAGAAGGTTTCTATTTCAAGTGAACGAAAGTGTAACTTGAATCGTCTAA
TGCAGACTCACAGCCCAAAAATAAATTCCAAGACATGTCCACTTTACAAATCCACAATTCCTTTGATGGG
GTGGGAGGGCAGTTCTGGATAAGGATGGACCCTGCTAGATTGCAAAAAATTTACAGCACTAATTTTTTCC
CCAGAGATCTCCATAAGGACCTATGGTCATGAACTTCTGTGACTGTGTACTCAAAAAGAGAAATAATCAC
ACATTTTGGCAGTGACTGAATTCTTGTTTTCAAGTAGGATAAATCCAAAAGAGACTCACACTGAGACACA
TTATAATCAAAAAGACAAGGAACATCTTGAAAGCAGCAGCATGAAAGTGACTTGTCATGTACAAGAGATC
CTCAATAATATCATCAATGGCTCTGGCCAGGTACAGTGGCTCATGCCTATAATCGCAGCACTTTGGGAGG
CTGAAGCAGGTGGATCACTTGAGGTCAGGAGTTTGAGACCAGCCTAGCCAACACGGTGAAACCCTGTGTG
TACTAAAACTACAAAAATTAGCCAGGCGTGGTGGTGTACACCTATAGTGCCAGCTACTCAGGAGGCTGAG
ACAGGAGAATCACTTGAACCTGGAAGGCAGAGATTGCAGTGAGCCGAGATCATGCCACTGCACTCCAGCC
TGGGTGACAGAGGGAGACTGTCTCAAAAAAGAAAAAAAAAAAAAAAAAAGATCATCAGTGGATTTCTCAG
CAAACCTCCAAGGCCAGATGATGTATTAAAGTGCTGGAAAAAAACCTGGTATATTGAGGATTCTATATTC
AGCAAAACTATACTTCCAAAATGAGAGATCAATTAATAACTTTTCAGAAAAACAAAAGCTGAGAGAATTG
CCAGTAGACAAGTTATTCAAGAATTGAAAAGGTTGGGAGGCTGAGGCAGCAGATCATTTGAGGCCAGGA
GTTTGAGACCAGCATGGCCAACATGGTGAAACCCTGTCTTTACTAAAAATATAAAAATTAGCCGGGCGTG
GTCGTGGGCGCCTGTAATCCCAGCTACACAGGAGGCTGAGGCAGGAGAATTGCTTGAACCTGGGAGGTGG
AGGTTGCACTGAGCCGAGATTGTGCCACTGCACTCCAGCCTGGGCAACACAGTGAGACTCCATCTCAAAA
AAAAAAATTGATAAAGGGAATCAATCCTTCAAGTTGAAATGAAAGGATTTTAGACAATAACTTGAAATCA
TATGAAAATATAAAGATCTATACTAAAGGCAATTGCATGAAGCAATACAAACAACATTATGATAGTAATT
TTAGTTTGTAATCCCAGTTTTTATTTTCCATACAACGTAAAAGACAAATGCATAAAAATGACTACCAATC
```

FIGURE 491 cont'd

```
TATGTAAATAAGTACACAATATGTAAAGATGTACTATGAGATCAGTAACAGTGCGGGAAGGAAAGAGCTG
TGAAGGAGTAGGGTTTTTATATCTGATTGAAGTTAAGTTGGTATCAATTTAAAAGACTGTTATAACTTTA
GGATGTTACATATACTTTTGGTGACTATAAAGAAAATATCAATGAAACATGCACAAAAGAAAATAAGAAG
TGATTCAAGGCAAGGCAGGGTGGCTCATGCCCGTAATCCCAGCACTTTGGGAGGCCAAGGCGGGTAGATC
ATGAGGTCAAGAGATTGAGACCATCCTGGCCAACATGGTGAAATCCCATCTCTGCTAAAAATACAAAAAA
AATTAGTTGGGGATGGTGGCACGTGCCTGTAGTCCCAGCTACTCGGGAGGTTGAGGCAGGAGAATTGCTT
GAACCCGGGAGGTGGAGGTCTTGTAGTAAGCTGAGATTGTGCCACTGCACTCCAGTCTGGGCGACATAGT
GAGACAACATCTCAAAAAAAAAAAAAGTGATTCAAAATTAATCACTACAAAAAAGAACTCAACACAAA
GGACAATTGTAATGAAGGAAATGAGAGGCAAAAACACAATAGGACATATAAAAAACAAATTTAAAATGGT
AGTCCTTACCTATGTATAATTAGTTTAAGTGAAATTAATGAAACTCCCCAATAAAAAGATGTAGTTTGTC
AAAATGATTGAAAGACAATATGTAATTATATGCTCTGCACATTAGAATTAATGACATGCATAGGTGAAAG
GCAAATGATGGAAAAAGATATCCCATGTAAAAAAATAACAGCACAGGTAGCTATACTAACAGATAAATT
AGATTTTAAGTCAAAAACTGTTAAACGAGACATTAAATATTGCTAAAAGGTTCATTTCACTAAGATGAAA
CAGTTATAAACATATGTGCACCAAATATCAGAGTTCCAAAATATAAAATGTAAATACTGACAGAATTGAA
GGGAGAAATATACAGCTCTCCAATAATAGTAAGAGACTCCCTACCTTTCTTTCAAATGCATAGGACACCC
AGACAAAGATAAATAAGGAAACAGATAATTTGAAGAACATTATACACCAATTCAACCTGAGAGACATTG
ACATAACTCTCCGCCCCCAACAGAATACACATTTTCTCAACTGCACATGAAACATTCTTCAAGACAGAC
CATATATTAGGCCACAAAACAAGTCTTGATAAATGTAAAGTTTGACACCATAAAAATATATTTTCCAAC
TACAGTCTAGATCATAATAACTAGACATCAATAGCAGTATAAAAAGTGAAAAAGCCTGAGGCGAGAGGA
TCACTTAAGTCTAGAAGTTTGAGACCAGCCTGAGCAACATGGTGAGACTCTGTCTCTACCAAAAAAACAA
AAAACAAAAGGCTGGGCCGAGGTGGGCAGATCACTTGAGGTCAGGAGTTCAAGACCAGCCTGGCCAACA
TGGTGAAACCCCGGCTCTACTAAAAATATAAAATTATTCGGGCGTGGTGGTGCATGCCTATAATCCCAGC
TACTTGGGAGGCTAAGGCAGGAGAATCTCTTGAACCTGGGAGGCAGAGGTTGCAGTGAGCCGAGATCACG
TCATTGCACTCCAGCCTGGGCAACAAGAGGGAAACTCCGTCTCAAAAAAAAAAAGTATATATTTGCTAG
TTTTGTCAGCTGAGAGGGTCAAGAATAAAAAACACTAAGGTAGCAGCGATCATACCTAGCACTCAGTTCT
TTGTTTCTAACTACATTTTCCACAAATAGGAACCAGAAGTCCTAGGAGAAATATCTGATCTCATGGCTAG
GGTAGGGAAAATACCCAATGAACTTGAAAAATACCTAATGAACTTGGAACACACAGTATCAGAAAGTAAA
CCAGTGCACAAAGAGCTCATATCATGATGAACAGGAGGAGCCAGAAGGCAAGAGGGGACTGCTTGAAGAG
GATTTTACTGGCAAAATCTGAGACAACCAGAGAATCAAAATACATAATAACAGTAGTAGATGTGAACTCA
TTAATATAACAAGAATTCACAAATCCACACTGGTATAAACAAATAAATAATATAGATGGAAAGCTTTTTC
TTAGAGCATAATGCCAAAAAATCAACATAGAATGAGTTGGAGTATCTCAGTTTTTCACCAGATAGTAGTA
ACTTTTTAGGGGAAAAATAATTTTAGAGTGCAGAATTCTGGAGAGAAACCCCTTAATCAACTGTTCAAGT
TTAGCAGCACCAGTAATGGATAAAAACTAGTATCTGGTATATCCTGAGATCATGCACTAAGGACAGAAAT
TGATCATAATCCAGAAAGACATAATCTTGAATGTTGGAATCGCTGAAGATCAAAATGTTAAAAATATAAC
CCTGGAAAAAATAATTTTAAATTTTTAGAAGATATTGACTGATTTACATTTCTTTCTTTTCTTCCTTTT
TTTTTTTGTTTTTTTTTCTGAGACAGAGTCTCGCTCTGTCACTCAGCTGGAGTGCATTTCCCTTCCTTCC
TCCCTCCCTTCCACTTTTTTTTTTTTTCTGAGACAGTGTCTCGTTCTGTCACCCAGATTGGAGTGCAG
TGGCGTGATCTCGGCCTCCCAGGTTCAAGTGATTCTTGTACCTCAGCCTCCTGAGTAGCTGGGATTACAG
GCATGTATCACCATGCCACGCCCAGCTGATTTTTTGTATTTTTAGTGGAGACAGTGTTTCACTATGTTGG
CCAGGCTGGTCTCAAACTCCTGGCCTCAAGTAATCCGCTGGCCTTGGCATCCCAAAGTACTGGGTTTACA
AGCGTGAGCCACTGCGCCTGGCCGAGATGGAGCATCTCAATAAATTTTGTCATTTGGAAGGGCCGACTAG
AGCAACAATACAGCTGTAACTAGTATAGAAATAGCAGTCAGTCAATTTTCAAAGAGGGGGATGTGTGGCA
TTGTGTGGTTAGCATAGTAACCTTGTTTTATGTAAACACAATTGTGAAAAGGTATTTTTTAGTTTATA
AAATGAATCTAGAATGTGAGACTTCATTTTTTAAAAAACAAAATATAGATTGATAAGTGTATTAGTCCA
TTCCCCCATTGCTATAAAGAAATACGTGAGTCTGGGTAATTTATAAAGAGGTTTCATTGGCTCACACAGA
GTCCTGCAGCCTGTAAAGGAAACATGGCAGCATCAGCTCAGCTTCTGGGGAGGCCTCAGGAAACTTACAA
CCATGCTGCAAGGCGACTAGGGAGCCAGCACTTCACATGGCCAGAGTAGGAGGAAAAGAGCGAGGAGTGA
GATGCTACACAATTTTAAACAAGCAGATCTCATGAGAACTCTATCAGGAGAACAGCACTAGAGGGATGGT
GCTAAACCATTAGAAACCTCCCCGGTGATCCAATCGCCTCCCACCAGGCCCCAACTCCAACACTGGGGAT
TACATTTCAACATGAGATTTGGGTGGGGACACAGATCTAAACCATATCAATAGGCCAATGTATGTTTATG
GGGAGAAAAAAATCTGGTTATCTTTTTTTTTTTTTTTTCCGTGACAGAGTCTTGCTCTGTCGCCCAG
GCTGGAGTGCAGTGGCATGATCTCGGCTCACTGCAACCTCTGCCTCTCAGGTTCAAGCGATTCTCCTACC
TCAGTCTCCCGAGTAGCTGGAATTACAGGCACGCACCACCATGCCCGGCTAATTTTTGTATTCTTAGTAG
ATATGGGTTTTCACCATGTTCTCCTGGCTGGTCTCGAACTCTTGACCTCATGGTCCGCCCGCCTTGGCCT
TCCCAAAGTGCTGGGATTACAGGCGTGAGCCACCGCACCCAGCCCCTGGTTATCTTGAAGAAAGATTTTA
GATGGGTTTTTTTCTGATTTTGCTTTATTCTATTATTTATTTGTATCAACCAATGTAAGCCAGATTCCAA
ATTGCTAACTATAATGACGATATTTTAACCAAAAAATATAAAGGAAGAAAATAAAATATGTTCCTTACG
TATAGGATCCTCCTTAATGCTACTGCATTAAATAAATCATAGGCATTGGGTGTCTGACATCAATGCCAAG
CGCTTCACCCAGTTATACTTGCTTTGAAGTATTGGGCAATTTAAGAGCTTCTCTGAAATTTGGTGTTTTA
CCTCTTCAGTAGACATAATACCATGAAAAGTGTAAACGAAAGAAGATAGCTTTTCCATGAGGACAGGGCT
TCCCCACTGGCCCTCTCAAATGATGATTGTTTTCCTGCCAAACCAGTGGTACCACAGCGTCTGGAGTAG
```

FIGURE 491 cont'd

```
GGGCTGGCACCTTCTTTGTTCTTCATTGCCTCTCCCAAACCATTGTACTTGCTCACTCTTCCAACTTTTA
GTTTTGGCCTCATATTATCAGTTTATAGTAATCAATCATCAATCATCTACTGACCCCTAAAAAGTCATTC
CCCATTTAGTCCTTGAAGATTGTATCTCCTCGCTTGTTCTCTTTCCAATAATCCTCCGTAGTCCTGGGAG
GCGTTTAGACTTCAGGAATTGCTGTCTATTCAATATTTTCGCTCAAGGACTCAGGCAGAGGGAAGGACGA
CTCTCAGGGTCACAGTCCACATTCCCTACCAAGCGCTCAGCGATATAGGATTCGTTCCCCATGGGCAGTG
CGGGAATCGTAGGCAAGGAGCACCGCGGAGTCCCATCGCTTTTCCCTGAAGGGTGAGATTCTGAACGTTT
TTCCCTCAGCATTCTGAGTGTAATCCAAACGCTCAGTGGAGTCGTGGTCCATTTGACCCACGCAGGGGGA
TCCGGGGAATTCTGGGAAATGTAGTCCCGCCAATCAGTGGAGTCGCGGGCACTTCCGCTCCAGGGAAGAG
GGGGCGATTGTCACGGCACATTCCACGGTAGTTTCTTCCAGTTCCGCGACTCGCGGCCCCTCCTAATGTC
AGGGACTTAAGATTGGGGCTCGCTGGGACCTGGTGGTCCGGTTATGGGAAAAGAAGCCTCGTGGGAGAGC
AGAGGTTTGGTGGGGCGAGGGCGGCGGCTTTTGTTGTGTCAGCGGAGCCTTCTTGGGCTGGGGCTCCCCT
CGTGTCCCGCGGCGGGAGGCGGGGGGCATTGGGACTTGGTTGGGTCGCGTCTCGCCTGGTTTGAGGGTTT
CCGGGGCTCTGAGCTCGCCCACTCCGCCTCCCTGCACTCCAGGCGCGCAGTCACTTTTTTACAGTGCAAG
GTTGGCGTGTTAATCTCCCTGGGCCTCTCCTTGCTGTTCTTTAAAATGGGGACGTTAGGACCATCTTTGT
AGAATCGTTTTGGTAACTGGAATAGGTTACACAACACAAACAGTCCCTGTCACTTGGTGAGTGGTGGTTT
CTTGTTACTTTCCCACGAAACCTGTTAGGTCCCCGGTGGGGTCAGAGCTCCAGCAGCAGGGCCTCAGC
CCTTATCTCTGATCCCTGCAGGACGCTGGACGATCCCGGACGCCTTCTGACCTCTTTTTAGGCAGGCGAG
GGTTGCGTCCACTTCCACGAAGGGAGGGGAGCATTTAACTTTTCTCAGGGACAGCGACCCAGTCAGGATG
TTTCACAGCTTTCTCCTTCCCCAGCCTGAAAAAGGACTGCGCGGACTGACTTCTTGGCTACTGAAAGCAA
AGCTCCACGTGAGTGTGACTTGTCATTTTTCTTTTACAGAGACTGTATCTTTGTAGCATGTGTAATAGGG
CATGGGCATTTATAATAATTAAGCCTTAATTGCTAACTTCAATTCTAGGGGATTTATACAATTAGATACG
TTTAAGCCGCAACGTGACTCTGTGGAGAGGTACTGGTCATCCAAGTAGTAAGAGGTGAAACTTGGGTTGG
AACCTAGGCATTCAGGGTCAGAGCCCGAGTTGATCATCTCTTGGATATATTCTCATTGAGGCAGAGGAAC
TAGCTGTACTCAGGTGGGGAAAGTAAGTTAGAACTTGATTAAAGGACCTTAAGAGCAAGGCTAATTGCCT
TGGAGTTTTCTCAGTTTTTAAAAACTGTCAACTATTTTGTTTCATTTATTACAAATATTTCACATTCTAA
TAGAACCGTATCACTGTGAAGCATTCAGAAATTACAGAAATACGAAGATACAAAAATTGTAATTACCTAT
GAAATCAGGATGTAAAGATAGTAATGGTTAAATTTCTAATGCATTTTGTTTTAGTGGTTCCATGTTTATA
TTACTTATAAATGTTTTACAAAATTTTTATTATACATTTCTCAATGTTTTTCTATTTATCTGCTTATCCA
TGGAAATTTCCAGATAAAGAGATAATAAACTAGTGACCTGCCATATTCTATCATGCTCATTCTTATTCTT
CTCATTATTATTTCTCCTATGACTATTTCCTGATTTTTTAAAAAAACTTTAACACAGTAATTATATAATT
TTAAGTCTATAGAAAAGTTGCAAAAATAGTATAAGAGGGCAGGGCATGGTGGGTCATGCCTGAGTCCTGA
GTTATGGAACTGAGGCACTCAGGGTCACAGCCCGAGTAATCCCAGCACTTTGGGAGGCCAAGGCCTGTGG
ATCACTTGAGGCCAGGAGTTTGAGACCCGCCTGGCCAGCATGACAAAAACTCGTCTCTGGCCGGGCGCGG
TGGCTCACGCCTGTAATCCCAGCACTTTGGGAGGCCGAGGCGGGCGGATCACGAGGTCAGGAGATCAAGA
CCATCCTGGCTAACATGGTGAAACCCCGTCTCTACTAAAAATACAAAAAATTAGCCGGGCGTGTTGGCGG
GCACCTGTAGTCCCAGCTACTTGGGAGGCTGAGGCAAGAGAATGGTGTTAACCCGGGAGGCGGAGCTTGC
AGTGAGCCGAGATTGCGCCATTGCACCCCAGCCTGGGCAACAGCGCAAGACTCTGTCTCAGAAAAAGAAA
AAAAAAAAAAAAGAAAACCCGTCTCTACTAAAGATACAAAAATTAGCCACATGTGGTAGTGCGCGCCTG
TAATCCCAGCTACTCTGGTGGCTGAGGCATGAGAATCGCTTGAACCCAGGAGGAGAAGGTTGCAGTGAGC
CAAGATTGCACCACTGCTCTCCAGCCTGGGCAACAAGAGCAAAACTCTGTCTCAAATAAATTAAAATAAA
ATAAAATTAATTTTTATGAGTAGATATACTTGTTAGTGGGCAACATACTGTAAAGACCAGCATCCCTGT
TCCCCTGTTTGCTTATTCATTCATTCAAAAGTAAATATTCTATCAATATGGACTCAGAACGCAGTCTTGT
TAAATTAAATGACATGTAGATTAATAATTTTTTTCCAACTTTATTGAGGTGTATTTATGTATCAGAATT
CACCCATTTCAAGTGTACAATTCAGTAATCTTTAGGAACTTTGCTGAGTGTAGTAATCATCATCATCATT
TAGTTTAGATCATTTTCATCCCCCAATTGGACTCCTCTTGCCCATTTACAGTTAATCCCCATTCTTATCC
TAAATCCCCATCAACAAGTAACCTACTTTCTTTATAAACATTTGTCTGTTCTGAACGTTTCATATACATG
AAATCATACAATCTGTGGTTTGGTGTGCCTGGCTTCTTTCACTCAGCATAGTGTTTCCAAGGTTCATGCA
TGTTGTAGCATGAGTCAGTACTTCATTCCTCTTAATTTCCAAATAAGATTCCATTGTATGGATATGCCAG
GATTTGTCTATCCATTTTTCCATAGGAGGGCATTTGGTTGTGTGCAGTTTGGGATTATTATGAATAATG
CCACCGTGACCATTCGTGTGCTAATTCACAGTACACATCTGTGTTGGTGGGACATCCCTGGCCACGCTT
TCATGTCTCTTTTTGTGTCTTCCATAGTGTTCCAGGCACGATTCTGCCTTCTCTCAAATGGCATAACTCA
GGACTCTGCAAATTCCCAGAAACAGGAGGAAAATGACCACATTCAAGGTGAATAAGGCTTGCCACTCTT
GCTGTTAAAATTCCATCTCACTATTCTCATGTTTCCTGAGGAAGACTCAAGAACAACGGGCATTTGAGAA
CCTGTTTATGCTAAGTGCATCCTTCTGCCTTTTGAGTTGACTTTGTTTTAGATGTTGTTTATTTTATTA
TTTCAGTTGACCTTCTGTATCTGTGGGTTTCACATCTAGGGGTTTTGCGTCTTTGAATTTTGCATTTGTG
GATTCAACCAACCACAGATTGAAACCTGAGTCTATGTAAAGCTGACCATACATATTTTCCTTTTGCGGTT
GATTGAGTCTGTGGATGTGGAACCCATGGATGTGGAGGGCTGACTGTAGTACAAACACTATTTTAGATAA
GGGACTTGAGCATCCACAAATTATGGTATCCTCAGGGGTCCTTGAACCAATTCCCCAAGCGTATTGAGCG
ACAACTGTATTTATTTTATGGAGTAGAAAAATTGGTGTGAATGAACAGTTCTCCTACTTTACTTCTCTGC
TTACGTATTAGCTGTTTTTATTTTCTTATAGTCTTTTCCTAATGTGCATTCATAACTATATTGGTATTCA
TGATATATATCTCATTTTTGTTATTTTTTCCTTAAGTACTAAATAATGTTCATTTTTTGAGGTTATGCCA
```

FIGURE 491 cont'd

TATACCCATTTAATTAATGTGCCTTTTTATTTTTGACTACTTCCCATTCATGGACATTTAGGTGATTTAA
GAATTTTATTGTTTTACATAACACTGCAATGACAATTTTCCTACATAACCGTTTCCTCAAAAATCAATTC
TGAAAACTTTCTGCTGATTTTTTTGTCACCACAACCTCTGCCTTCTGGGTTCAAGCAATTCTCCTGCCTC
AGCCTCCCGAGAAGCTGGGATTACAGGCATGTGCCACCATGCCCAGCTAATTTTGTATTTTTAGTAGAGA
TGGGACTCCTCCATGTTAGTCAGGCTAGTCTCGAACTCCTAACCTCAGATGATCCACCTGCCTTGGCCTC
CCAAAGTGCCGGGATTACAGGCATGAGCCACAGTGACTGGCTGTAGATAGAATACTCTAACATGGCACAG
CACAACAGGCTATAATGCTGCTTCACACAAATAATATTGTTGGAGTTTTCATATAGGAAGAGCTAGATTC
TGTGTGCTTTGTGCCTCGATCATACTTTGTATGTATTTTATTTACTAGTGTCTTATTGCCTTTATAAAGT
AACCAGTTTGACCAAAGTAGTAGGTAATAACCTTCATTTAAAATGTCCAGTGACACGGAAGATTTGCCAG
TCACTTGTGTTCTGTTACTGTATTTATTCAGAACAGCAGAATGAGGAGGTTTGTGGTCTCTTCTTCCTCT
TAAACAGGTGAAATATGAGAAACCTTCTCAGATTGGCATAGAAAGTCAGGGGTCAGAAACATTAGCCATT
CCATTTAAGTGAAAGTGAGAGACAAAAGGAAACAAATATTTCTCAATGAATGACCCGTGGTGTGGGTGTC
TGGAGTGCCCTGTTGGGTGATAACGTCCACAGGTAGTGGGGGACCTCTTGTGTTCCTAATGTGGTGGCAC
CTCAGATGCACTAAGATGCTCAGCACTCCAGGTGCACAAGGACAGTGATTAGCACAGTGGTTATATAAAG
TCTTTAAATTACTCTACGGATATCCCCCTCAGATAGTGGTTTCTCGGGTATATACCCAGTAATGAGATGG
CTGGGTCAAATGGTATTTCTAGTTCTAGATCCCTGAGGAATCGCCACACTGTCTTCCACAGTGGTTAAAC
TAGTTTACAGCCATCATTCTACTGTCAATTCTACTAATAAGTGGTTCATTCAACCTCTGCACCCTCATTA
CAACACAAGAACATCTCTGAGGAGTACCCTGAAGCATGGGATCAGGGGGTGAGGTTTTTGGTAAGTGTT
TTAGTGGGTGTGACAAAAGATACCTTACAGAGTATTAAGAGAAAAACAAGTTGGGCAAAAATATTTACC
ACACAGGTGCCAAAAAAGATGAAATTCATAATAAACATTGGTATTCATTTATAATCAAGTAAGTAAGAAT
AATAGAATTGTTCTTCCTAATTAGATTATCAAAACCATTGGAAAATTTATAACCTGCTTTTGGTCATCAT
ATAGAGAAGCAAGGTGCTTGCATTCTCTCTCTCTCTTTTTTTTTTTTTTTTTTTTTTTGAGACA
GAGTCTGGCTCTGTTGCCCAGGCTGGAGTGCAGTGGTACGATCACGGCTCACTGCAACCTATGCCTCCCG
GGTTCAAGTGATTCTTCTGCCTCAGCCTCCTGAGTAGCTGGGACTACAGGCACGCACCACCATGCCTGGC
TAATTTTTGTATTTTTAGTAGAGATGGGGTTTCACCATATTGGCCAGGCTGGTCTTGAACTCCTGACCTC
ATGATCCACCTGCCTCGGCCTCCCAAAGTGCTGGGATTACAGGCATGAGCCACTGCACCCAGCCAAGTGC
TTGTATTCTCTTGAAAGATTAGGGAGGCAGGAAAAAAGGAAGAAAATCTGCCATTATGTGGTCATAATTT
TTAATGTGCTTTTTTTCTGATGTTTTATTTTTTATTTGCAGTTATTTAGTTTAATTTATTTTTTGGGAC
GGGGTCTCACTCTGTAACCCAGACTAGAGTACAGTGGTGTGATCATCGCTCACCACAACCTTGATTACCT
GGGCTCAAGCAATTCTCTCGCCTCAGCCTCCTGAGTACCTGGGACCACAGGCACACGCCACCACATGCAG
CTAATTTTTTGTACTTTTTGTAGAGACAGGGTCTCACCATGTTGCCCAGGCTGGTCTTGAACTCCTGGGC
TCAAGCAATCCTCCATCCTTGGCCTCCCAAAGTGCTGGGATTACAGGTGTGAGCGACTGTGCATGGCCTG
CAATCATTTTAAATACACACGAAGGTAAGATCTGACAGTCGGGTGACTCATGCCTGTAATCCCAGAACTT
TGGGAGGCCAAGGCAGGCGGATCACCTGAGATCAGGAGTTCGTGACCAGCCTGACCAACATGGTGAAATC
CCATCTTTACTAAAAATACAAAATTAGCTGAGCATGGTGGCGCATGCCTATAATCCCAGCTACTCGGGAG
GCTGAGGCAGGAGAATAATTTGAACCCAGGAGGCAGAGGTTGCAGTGAGCCAAGATTGTGCCATTGCACT
CCAGCCTGGGCAACAAGAGTGAAGCTCTGTCTCAAAAAAAAGAAAAAAAAAAGGAAAGAAAGTAAGATCT
ACATGAAATGATGTTCTTTGCTGGATTGGTTATAATGAAAACAATATTGAAAATTAAATATTCATTAATT
AGAACAGGTAGATGCAGATTTCAGTTCCCTCGAATAATATACAGTCATGAAATGAGGTGAAATAGATGAT
GATGGTAATAATAATAGATAATAGCTAATGTTTCTTAGGTACTTAGTCTGCGCCATACACTATTCCAAAT
GCTATATGTAGTTTCTTTTTCAACGTTTGAAAGAACTCTGTCATGTAAGAACTATCATACCAAGATGAAA
CTAGGTGAACTTATCCAAGATCACACAACTTTGAAGGGTACCCTTGTGTGCACTGAGGCATGATGGCTCC
AGATCATGACACTAAATGCTGCAGGTAATGCTGGTGCTGTGTGCCCTGGGTGTACAGAAGGAAAACTACA
TAGCAGTTTTAGATATGTTACCAAAAGCTTGTTAGTTTGGCAGACTTTAATGAAAAGGGATAGCATCCAG
CGTTCCTATGTGAGAGAGGAGGAAGGTGGGTGTTATCATGTATGTTGGTTCTGACTTGCTAAATGTTTCT
GGGGCAATTGGTAATATTTACCGAAAGGTGAAACCCGTGTGGCTCAGGATGCGTCATTTAGAGTTCTAGA
TGGTTACTTACAAATAGACTCAGTGAAGCCACAAAGGAATTGAAGGCTATTGTTACTGATGTACTTTTAC
TGACACTAAGGAAAATCAAAGTGTGGCATTGGTAAGATGGAAGGAGAAGGGCTGAGAAATCTACACATTA
AGTCTCTGAAAATCTGGACCAGCTCCCCCTACATACTCTCCACTTTCTCAGTGCTGTTTCTTTTCAAGAG
TTTGTTAAAAGGCTGAAGTAAGGTGTGTTTGATGTTATAGGAGGGACTGACCTTCAAGGATGTGGCTGT
GGTCTTCACTGAGGAGGAGCTGGGGCTGCTGGACCCTGTCCAGAGGAATCTGTACCAAGATGTGATGCTG
GAGAACTTCAGGAACCTGCTGTCAGTGGGTGAGGACATGAGCTTTCTAACACTCAATGTCAGTCTCTTGG
AGTGATTTTGTGTCTTCAGGGGTTCAACACTTTGGAGGTCTTGAATTAGTCGCCTACATTTGTAGACCTG
ACTTTCCTATCAGTAGTTTTTAGTGAAATAAAATGAGATAGAAATATCAGAGTTCACTAAAATTAATGGA
ATACATAGCAAATAAAACTGGTAAATTGCATGAGTGGTGTGAGAACTTGTGGGAGGAGATTTAATGAAAA
TAAACGGGGCCAGGCACAGTGGCTCACGCCTGCAATCCCAGCACCTTGGGAGGCTGAGGCAGGTGGATC
ACCTGAGGTCGGGAGTTCGAGACCAGCCTGGCCAACATGATGAAACTCTATCTCTACCAAAAAATAAAAA
ATACAAAATTAACCAGGTGTGGTGGTGCATGCCTCTTATCCCACCTACTTGGGAGGCTGAGGCATGAGA
ATCGCTTGAATCCAGGAGGCAGAGGTTGTAGTGAGCCTAGATCACGCCACTGCACTCCAGCCTGGGTGAC
AGAGTGAGACTGTCTCAAAAAAAAAGACATTGGTTAGAAATGTAATTTTAGTAATGCACCAAGATGTAA
CAGTTTTTCTGTTGTTTGAGATAACACCTGGAGTTTTTTGTTTATTTTTAAGAAGATTAATGAGTGCAG

FIGURE 491 cont'd

```
ACAGAAATGTGAGGTTAGAGTGAAGGTTTAATAAGCAAAAGAAGAAAGCTTTTTGCCAGCAGAGAGGGGG
ACCCAAATGGAATTCCCCCTATGAGGCAGGGGTTTGGGGTTTTTATGGACTGGGAAGGGGAAGGAATGTG
CTTAGTTTGTGGGCTATTTTGGAGAAAGTGTGACTTAGCTTGGCCCGGAACCTTGGCCCAGGACCAATCA
GGTTGAAGTAAAGATATATAGAGACCGGACTTACAGTTTGAAAAAAAGAAAGTAGAGTGCCCACTGGAAC
CCACTGGAGCCCACTGTACCTATGCCCACAAAAGGAGAAGAAACCTTTTCCTGGGAGCCCGCTGACTATA
CAGAGGACAAAGGCATTCTTATGCCAGGCCTTGCTCCTTTATCTGAGCGAGCTGGAGGTATGTACAAGCT
TTTATCCAAATGGGCTGGAGGTTTTTCTATCTGTGCAGCCGTGGGCATGTCTCCAGGCACAACACCCTGT
GGTAGTTCCCTTATTGGTGCCTGCAGCTTAAATTTTTTTTCCAGGCTGCTTTTTATGTTATATAAAAATA
AGACACTAACCCATGGGTCAGGGGCTCTCCAAAGACCCTTCCCTTGCTGTCTACCTAAGGCAAGCGAACT
AACTCCTTTCAGAAATAGGTTTTTATAGCACATATTTATGTCTATGTGTCTGGATCTTGAAATACTGATA
TTTCTTCATTAGGTTCTTCTAAAAGTGTTTGAAAACACTACTTTTGATTGATTGATCAGTATACAGTAGT
AATTCAAATTGCCAGTAAGTTCAGTTGTACCTTTAGTGTGTTTGTTTTAAATATGTGACTTTGCGTGTTC
TAGGGCATCACCCCTTCAAACATGATGTATTCCTTTTAGAAAAGGAAAAAAAGCTTGATATAATGAAGAC
AGCAACTCAAAGAAAAGGGAAATCAGGTAAGAACCAAGCAGCTAAGAGTCCTTGTACGTGATTGTCCATC
TGTTGTACTTCTCTCCCCTGCTCTTGCTGCCATCGGGTCCAAATTGCCAAACCTCTGTCCTGGATGATTG
CAACAGCCTTCGTACTGGGCGCACTGCATCCACCCTCAATAGTATAAAGTATGTTCTCCTACAGGCGTTC
TCCATATCATAGCTAAAGTGATCCTTTGGAAATGTAAGTCAGATTGCCATTCCTCTACTTAAGACCTTGT
ACAGGGCTGGGCACAGTGGCTCATGCCTGTAATCCAGCACTTTGGGGGCCAAAGCAGGAGGATCAGGAGT
TTGAGACCAGCCTGGCTAACATGGCAAAACCTCGTCTCTACTAAAAATACAAAAATTAGCCAGGCGTGGT
GGCCAGCGCCTGTAGTCCCAGCTACTCAGGAAGCTTAGACAGGAGAATCGCTTGAACCCAAGAGGCAGGT
TGCAGTGAGCCAAGATCGCACCGCTACACTCCAGCCTGGGCAACAGAGCGACACTCCATCTTAAAAAAAA
AAAAAATACTCTGAATGGCTTCTTATTTTTCTTAAAGTTGAAGTCTCTTAAAGGAGCTTATAGAGTCCTG
CGTGGTCTGCTGTTCATCCTCCTCTGCGTCTCTGACTACATCTCCTGTATTCTACCTCTTGCTCCATCTT
TTCCAGCCACATCATCCTCCCTGCTATTTCCCAGACCTGGTAAGGACATTGCTCGCTCTGTCGCCCAGGC
TGGAGTATAGTGGTGCAATCTCAGCTCACTGCCACCTCCGCCTCCCAGGTTCAAGCGATTCTTCTGCCTC
AGCCTCCCAAGTAGCTGGGATTACAGGTGCCTGTAACCACGTCCGGCGGATTTTTGTATTTTTTATAGAG
ACAGGGTTTCACCATGTTGGCCAGGCTGGTCTCCTGACCTCAAGTGACCCGCCTGCCTCAGCCTCCCAAA
GTGCTGGGATTACAGGCATGAGCCACTGTGCCCGACCTGGACACTGCATTTCTTACTGCTGCTGTAACAT
ATTACCCCAAACTGAGTGGATTAAATGATAAAAATGTATTGTCTTTCAGTTCTTTGTTTGAAGTCCAACA
TGGGTCTCACTACGCTGAAATCAAGCTGTCAGCCCGTCCCTGTTTCTTCCCGGAGGCTCTAGGGAAGGAG
AATCTGTATCGTTCCCTTATCAGTGTGTAGGGGCTGCCAAATTTCATAGCTTGTGGCCCTCTTCACAGCC
AGCAACAGTGCTTCTCTGATCATTCTTCTATAGTTGCATTTCCCTTTTATTCTCTCTTCATCCTTTTTCC
ACTTTATAAGGACCCTCTAATTGCACTGGGCCCACTTGGATAATGTAGAATTGCCTTCTATTTTTAGTTC
AGCTGATTTGCAACCTTAATTCCCTCTGCAACCTTAATTACCCTTTGTCATAACCTGACATATTCTTAGG
ATGAGAATTAGAACGTGGATTCTTTGGGGGTTGATTATTCTGCCAACTACAGATACTTCTGCCTCAAAGC
CCTTATTTGCCCTTGTCTTTGCCTGGAAAAACTCACCTACAATCCTCTCGGCCCCTCTCTTACTTCATCC
TGGTCTCTGCTCAGTTTTAATTTCACAGTGGTGGCCTTTTCTGACATCCTTACTGGAAATGCCATCCTTT
ACTCTCTGCCCTACCTTCTCTTGTGTCTCATAGACTTTGGTTTACTTGCTTGTCCCCTCTCTCTCCCCAC
TGGAATATAATCTCCAAGAGTGGAGGAATTTTTTGTTTGTTTGTTTATTACTCTATCATCAGTGCCTAA
ATAGTCCTGTTACATGGCAGATATCTGTTAATATAAATATCTGTTGGCATAATGAAGGCATTAATGGATG
GATGTGACCTCACTCTAGGGGTCTTGCAGCTAGGACAGGTCATACACAAACCAAAATGAATGAAGGGGGT
TGCAGAACGTTATTTGTTTTCTGATGGCTGCACATCCAGTTTCTTCTGCCTTAGGTGCCCTTCACGTGAA
TGTTTGTGTGTGCACTTGAACCTCATACCATGAAAACTTACAAGCATCGTGGTTGTGACCACACTTTGAG
TAACAAGCCTTCCCAGTGGCTTTCCTGGAGGCTTCCATCATATGGAACACATTCATTTCTGGGAAGGAAT
AATTTTTGAATGAAGATTCTGATGTCTACTTCTGAGATAGCTCCCCCCACAAGAAGATAACTATTTCCTA
AGGTGTCAGATAGTAACTAGGTTGCAAACTGCTTTCCTTTCAGCACACTGCCCATCTGAACCTCATTTGC
TTCTTCCAAAGTGCCCATCCGTATCACTGCCCCAGGTTTTGCCTCCCCTGTGCCAGAGGTGGAAGATTT
AAGATTTGAGTGGCAAAAGTGACACAGCTGAATGTTGCCTGACTCTCTGGTTCAAAAATATGCTGTGCTT
TTATTTTCTACAAATGTAGTAGCCATTAAGCATATATTAAAGAATATAGATGTCATACAATTTTTCCTTT
ATTTTTATAAAGACCTGGCTTTTATGTTCAACTAGTTGACATTATAACCTGGGAAAAATGAAGAAACTTC
TTGCTCAAAATTGTCACATCATCATAGAGACTTGTCCTCCTCAAAAAAACTACAATTTTTAAGGGTCAGT
TTGTTAAATCTAATCATGTATTCATCATATATATATATATATATATATATATGCGCCAAGAGTTACATAC
TCTCCTATGAATATTTTCCCAAGGTGTCACGGTTGGAAATTGTCTTTCCATTTGAAGCAGTTTGTTTAAT
TAAGGACCAGGTAACTTCTAGAACCAAAGTTTTTGAGCTCTTTTGAGCATGAGCCATAGCAAGAAACCA
TTTTTCATTGAAATTAGAACAATGAAACAAACATTTCATGTCTGTATAGATTGATATTATAGCTTTAGTA
AGCATTTCAGAAGGACCCCTTTCCTGCTGGTGGTAGTACTCTGATAGTTTCTATCCTGGTTCTTTTATTC
TGAATGCTTATTACAAGCTTTTAAATTTATTTCACAGCTCACTAAAGGGCTACAGTTTTTAATTTGAAAA
ACTGTTGTGAAAGGCCCAACTTACCTACACTGAGAGCTTCAGAAGGAACCAGTGTATAGGGCTTCCTGCT
TTCTTTTTATCCCAAGTGATTCTTGCCACCTTCAAATTTTCTTATTAGCCTCACCCTGGATATACCTGTC
TCTTGTACAACTTTTCAGCTTCTCTGCAAAATTACAATTTTCTGTTCTTTTCCTATTTCAAATAACATTT
GGAAAAGATGCTTTTCTCCTAGGACTTGGCTTAAATTCTCACACAAAAAAAGTCAAGTTGGGGTTCATTT
```

FIGURE 491 cont'd

ATTCATTTGACATGCATTTATTGAGCATTCACTGTGACAGGCACAGTTCTGGACAATGGTTATAAAGTAG
GAAAGTGTAAAACGAGTATTATGTCAAAATTAGAAAATGCTTCCCTCATTGATGCTGCATTGTGGTGGGA
AGGACATACATTAAACAACCAGTAATTTAGTGTGTCCAGTGGTTAAAAGTGCTGTGAAGAACATAGACAA
ATTCAAGTTGCTAGAGGTGAATTGGGTGAAGACAGGATTCATTATTTTTCAATGAGTAATAAAGCAGCCC
TCATTGGTGAGCTGACATTGAGCAGAGACCCACAAGACGTGAGGAACCATCCATCTCGCTATCTGGGAAG
AGTTCCTCCCTGAATATAACTCCTGCTGTGGGGGTGGCTTTCAAAGTTTACACTGTGACATCTTTTTCTT
CTCCCTGTCTCCATCTCAATTGTGAAAGATTGGAGTCTACTTCTTTTTCACTTTTTTTTTTTCTGGAGG
TCTAAATTACTGTCAGCTTTTAGAATAATACATGTTATCAGTTCAACTTTCTTTCCCTTTAGTCCTCATG
TAGGAAACTTGCTGACAGAAGCTAAAGTTTCACCATCTGCTTATCTGCTAATATTTTAGTCAGTATGTGG
TTAGGTACTTGCTCCCAGCCTGCAAGTCATGTTAACCATTCCAGTCACCTGGATATTGAAGTAACTTTCC
AATAAAATGACTCAGGGCAGAGTTATATAGACACCATTTAACAAATGTCTACTGATACAAAGGAGGAGGT
AGATTTTTTTCTCTTTTTCTTTTTTTTTTTTTTTTTTTTGAGACAAAGTCTCACTGTGTCCCTCAGGC
TGAAGTGCAGTGATAAAATCATGGTTCACCGCAGCTTCTAACTCCTGAGTTCAAGCGATCCTCCATCTCA
GCCTCCCAAATAGTGTTAACTACGGGTGCGTGCCACCACATCTGGCCAATTTTTTAAAAGTTTTTTTGT
AGGGCCAGAGTCTTGCTATGTTGCCCAGGCTGGTCTTGAACTCCTGGGCTCAAGTGATCCTCCGGCTTCA
GCCTCCCAACATGCTTGGATTACAGATGTGAGCCACTGCACCCTGCCAAGAGGCAGCTTTTAAATGACTA
TTCCTGCAGGAGGGGAGTAAGTTTTCCTCTGTAAAAATTTCCTTAGAGGTACGTCTTTCTGCTAAACTT
TTGTGGAAGAGTTCATTTAAAAAATAATTTCCAAATATTTATATCTCTTTATCAAGATTAAACATTTTG
GAATATTATTAAGGATAAACCTTTCAGAAGGGTTTAAACATTTTAAATCTAAGTTATATTAGAAGTGGTC
AAGAGTTTATAATAGTTGTCAGCTCATTTAATGTCTGTCAACACAGAAAAATAAGATTAAGTGTATATGT
TATGCAGAATATTCAAGAATATGGTTGATCCTTGAACAACTTGGGGGTTAGGGACACCAACTCCCCTCAC
AGTAAAAAATCCAAGTATAACTTTTGACTCCCCTCTAAAACTTTACTCATGGCCTACTTTGACTGAAAGA
CCTACTGATAACATAGTCAATTAACACATATTTTGTATGTTATAATGTATTGTATACTATATTCTTACAA
TAAAGGAAGAATTCTTTATTCTTACAATAAAGAGAAGAGAAAATGTTATTAAGAAAATTATAAGGAGGAA
GAGGAGGGGTTGGTCTTGCTGTCTCAGGGATGGCAGAGATGGAAGAAAATCCATGTATAAGTGAACACAT
GCAGGTCAAACCTGTGTTGTTCAACGGTCAACTGTATTTTGAACATGTAAATATAAACATTTCAGGTTAT
TTAATAATTTGAATATGTAACATGAACCTAAACTGCAAAATATTTGATTATTTTCTTACTTTCCCTTGAA
GTTCTTGTTGATTTATATTATCTACATTTTTTTTAACTTTTAATATTTTAATAGAGGTACATTCTTGC
TTTGTTGCCCAGACTGGTCTCAAACCCCTGGCCTCAAACTATCCTTCTGCCCCAGCCTCCCAGAATGCTG
GGATATACAGGCATGACCATGCCTGGCCTATGCTTTTTATATTTAGATAATTTACTATTTATTATTCTAC
ACTGACTTTAAAATTCGATGGAAATGGCAGTACAATTTGTATCATGTTAATTTTTAAAATTAACTCTGAC
TTCTAACTTGTGTCTCACATAGGAGACTTGGTATGGTCTAATGCCTGGTAGATAGCAGCCAATTGGACCA
CCTCTTGATTTATCTAGGCATGGAAATCAGAGATCATGATACACAGTGGAAAAGACCATTACACAAACTG
GACCTTCTCTGGATTTGTTAAAATCGCATGCTCTCGCCTAAGTATGACATCTTGAAAACTTTTAACAGAG
CCTCCACATCTCTGAATTCTCTGTCCTTACAGCAGACAAGATCCAAAGTGAGGTGGAGACTGTTCCAGAA
GCAGGACGACATGAAGAGCTTTACTGGGGGCAAATCTGGAAACAGATTGCAAGTGATTTAATCAAGTATG
AAGACTCTATGATAAGTATTTCTCGGTTCCCCAGACAAGGTGATTTGTCCTGCCAGGTTAGGGCAGGACT
ATATACAACTCACACAGGACAGAAATTTTACCAATGTGATGAGTACAAAAAATCCTTCACTGATGTCTTC
AACTTTGATCTTCATCAACAGTTACACTCAGGAGAGAAGTCTCATACATGTGATGAGTGTGGAAAAAGCT
TCTGTTACATCTCAGCCCTTCATATTCATCAAAGAGTCCACATGGGAGAGAAATGCTATAAGTGTGACGT
GTGTGGTAAGGAATTTAGTCAGAGCTCACATCTTCAAACTCATCAGAGAGTCCACACTGTAGAGAAACCA
TTCAAATGTGTGGAATGTGGGAAAGGCTTCAGTCGTAGATCAACACTTACTGTACATTGCAAATTACACT
CAGGAGAGAAACCTTACAATTGTGAGGAATGTGGAAGGGCCTTCATACATGCTTCCCATCTTCAGGAACA
TCAGAGAATTCATACTGGGGAGAAACCATTCAAATGTGATACATGTGGTAAGAACTTCCGTCGTAGATCA
GCACTTAATAATCATTGCATGGTCCACACAGGAGAGAAACCATACAAATGTGAGGACTGTGGTAAGTGTT
TCACTTGTAGCTCAAACCTTCGTATCCATCAAAGGGTCCACACAGGAGAGAAACCTTACAAGTGTGAAGA
ATGTGGTAAGTGCTTTATTCAGCCTTCACAATTTCAGGCCCATCGGAGAATCCACACTGGAGAGAAACCA
TACGTATGTAAAGTGTGTGGTAAGGGTTTCATTTACAGTTCAAGTTTTCAGGCCCATCAGGGAGTCCACA
CTGGAGAGAAGCCATACAAATGCAATGAGTGTGGGAAGAGCTTCAGAATGAAAATTCATTATCAAGTGCA
TCTGGTAGTCCACACAGGGGAAAAACCCTATAAATGTGAAGTATGTGGTAAAGCCTTCCGTCAGAGTTCA
TATCTTAAAATCCATCTGAAAGCACATAGTGTACAGAAACCTTTTAAGTGTGAAGAGTGTGGGCAGGGCT
TCAATCAGAGCTCACGACTTCAGATTCACCAGCTGATCCATACCGGTGAGAAACCATACAAATGTGAAGA
GTGCGGAAAGGGATTTAGTCGTAGAGCAGATCTTAAAATTCATTGTAGGATCCACACAGGGGAGAAACCA
TATAATTGTGAGGAGTGTGGGAAGGTCTTCAGTCAGGCCTCGCATCTTCTAACCCATCAGAGAGTTCACA
GTGGGGAAAAACCATTTAAATGTGAAGAGTGTGGGAAGAGCTTCAGTCGGAGTGCACACCTTCAAGCCCA
TCAAAAAGTCCACACTGGAGAAAAGCCATACAAATGTGGGGAGTGTGGAAAGGGCTTCAAGTGGAGCTTG
AACCTTGACATGCATCAGAGGGTGCACACAGGAGAAAAACCCTATACATGTGGGGAGTGTGGGAAGCACT
TCAGTCAGGCCTCAAGTCTCCAACTTCATCAGAGTGTCCACACAGGAGAGAAACCATACAAATGTGATGT
ATGTGGTAAAGTCTTCAGTCGGTCTTCACAATTACAGTATCATAGGCGAGTTCACACTGGGGAAAAACCT
TACAAATGTGAGATATGTGGTAAGAGGTTCAGCTGGCGATCAAATCTTGTAAGTCATCACAAAATTCATG
CTGCTGGTACATTTTATGAAAATGATGAGAATAGTAAGAACATCAGAGAGTTGTCAGAGGGAGGAAGTTC

FIGURE 491 cont'd

```
TACAAGGTGATTAAAAAAAAAAAAACAGAACTCATGTACAACCTGAATGCTTGTAATTAGATTTCATAGG
AGGGAAAAATTTTCTTTATCAACCTCTTTGAATTTATTTGATTTGTAACGCTCCACATTTCCACCTAGAC
TTTTTTTTGTTTTTATTTTTGTTTGAAACAGAATCTCGCTCTGTTGCCCATGCTGGATGCAGTGGTG
CTATCTCAGCTCACTGTAACCTCCACTTCCCGGGTTCAAGTGATTCTCCTGCCTCAGTGGATTACAGGTG
CACACCACCACGCCTGGCTAATTTTTGTATTTTTAGTAGAGATGGAGTTTCACCATACTGGCCAGGCTGG
TCTCAAACTCCTGACCTCATGTGATCCACCCACCTCGGCCTCCCAAAGTGCTGGGATTACAGGCATGAGC
CACCGCCCCTGGCCTCCATCTAGACTTTGAAATGATTGCCTTCTAATTACAGTAGCATTCTCTTATTTAA
AATATTTGTTTTATTTAAGTCAGTGTTTAAGCAATAGCTCAGCATATCCCAGTGGTCCAGTGACCACACA
GCTGAGAACCCTTGTTAAGTGGTACAGTAAAGCATTCTGTCAAAACTTTGACATTTATGACATGTTACCT
AGGAAATAGGACTTAGAAAATGAGTTTGACCTGGGCTTTAAAAAAGTATACTGATGAAGGTGCCAGAATT
GATGTCCATTAGACTGTAAGCTCCATGGGGCAGGAACTTTGCTACCGAATCTATACAACCTTAACATTG
ACTAGTGCTTGTAGGTGTGCTCAATACTTGTTTGTTAACTGAATCAAAAGGAGTAAATGCACAATATTTG
AACATTGTATCCAAAGGAAGAAACCTGCGAAATAAAATTATTTGCAGAAATGAACATTTGTTGAAATGCA
GAAACCACTGGATACTGCAGCCTACAATATTAATATGATATTACTCTTTTACAGTTGACACCTGTCCTC
TCTGTAGTCTCTTCTCTCAAATTTGGTTCTTATTGAGAGCCTGTCTAGTTTCCCAAAGGTTTTATAAAAC
ATAAGTTGAAGTACCTTTATTTTTAATTTTATTTTTGAGACAGGACCTCGCTCTGTCACCGAGGCTGGAG
TGCAGTGGCATAATCATGGCTCACTGCAGCCTCGTCCTCCCAGGCTCCATCCATCTGCCCATCTCTCCCT
CTGAGTAGCTGGGACCACGGGCACGTGCCACCACACCCAGCTAATTTTGTATGTTTGGTAGAGAAAGGG
TTTCACCACATTGCCCAGGCTGGTCTTGAACACCTGAGCTCAAGCAATCCAACCTCCTTGGCCTCCCAGT
GTTAAATTACAGGCGTAAGCCACCACACCCGGCCAAGTTGAAGTATATTTTGTGATTTTTCTGACAGTGC
AGACTGAAAAAAATTTAATTAACCTGACAAGAGTTTACTGAATATCACACAATTGAGTTTTAATCCATT
AATGTTAAGGCAGGGGTTTACTCTAACACTTTTAAAGTGTCAGAAGTAGTTGCCAATGCCAAATTTTTAT
CAGCCCCCTTGAATTTATTTGATTTCTGACTTTCCACATTTCCATCCAGACTTTGACATGATTGCCGTCT
AATAACTGTAGCATTCTCTTATTAAAACTTCTGGCTGGGTGTGGTGGCTCATGCCTGTAACCCCAGCACT
TTAGGAGGCCAAGGCAGGTGAATCACCTGAGGTCAGGACTTAGAGACCAGCCTGACCAACATGGTGAAAC
CCCATCTCTACTAAATACAAAAATTAGCTGGGCATGGTGGCAGGCGCCTGTAATCCCAGCTACTCAGGAG
GCTGAGGCAGGAGGATTGCTTGAACCCGGGAGGCGGAAGTTGCAGTGAGCCGAGACTGCGCCATTGCACT
CCAGCTTGGGTGACAGAGCAAGACTCCGTCTCAAAAAAAAAAAAAAAAAACTTCTGAGGTAGGGGCTGTAC
CATATTTTTGCCCCACACCCATTAAGCGAATACCAAAAACAACTTGTGGAAATTTGATAATTTTATCAAA
TTTATTATTTGGGCAGGATTGGCATTTACCATGCTTTTCCCTATTGCTGGCAGTAAAACATGGGTTTAAG
GAAGAGTGTTTTTCAGAATTTACACTGTATATCTCTGATTTGGAAGTTATATAATTGGAATTTATGATTA
TGAGATTAAAATACCAAAAGACTAAGTAACATATCAGTGATGTCAATGAATTGTTTTAAATGGAAGTGT
GTGTTCCTCTATAATAATTTGACTTTTGATATTTTCATTCCTGTATTGACCTGAAGCTATTAAAATGGCG
GCAGGTATCTGTAATGACAGGATAAAGAAAAATATGGGCTTTGAAGATCATAGACTATTGCCTTTGTA
GCATAATGAAATCTATACATTTTTATGAGTGAGTGTGTATGTACATGCATAAGATAATATGTAAAGGATA
CTTTTTTTTTTTAGCAATTTTCTCTTGCAATGAGCATTTTGTGGTATTTTTCCATTTTATAATTCCATA
AATTACATTTTAATTTCTTATTGAACATCAGTATTACCAAAGCAGTAAATTATGTACATTAGAATTTTAA
AAAGTGCTATATGATAATCCCTTCAAAATATGATTGTTCTATATTGTTATATGGCACATAAGATCATAAT
TAATAGATTCTGGAAGCCAATTTTAAAAACAAAAAAATTCTCTGAATATGTGGATAAATGGATGAGTGTG
AACAATTGTATCTTTGCAATTAATGTCTGCTACACTTCTTTTTTTTTTTGAGATGGAGTCTTTCTCTGT
TGCCCAGGCTGGAGTGCAGTGGTGCAATCTTGAATCACTGCAACCTCCGCCTCGCGAATTCAAATGATTA
TCCTGCCTCAGCCTCCTGAGTAGCTGGGATTACAGGGGCGTGCCACTATGTCCAACTCAGTTTTTTTTT
TTTTTTTTCCCCGAGACGGAATCTCACTCTGTTGCCAGGCTGGAGTGCAGTGGCGCAATCTCAGCTCACT
GCAACCTCTGCCTCCCAAGTTCAAGCAATTCTCCTGCCTCAGCCTGCTGAGTAGCTGGGACTACAGGTGT
GCACCACCACGCCCAGCTAATTTTGTATTTTCAGTAGAGACGGGGTTTCACCATGTTGGCCAGGATGGT
CTCGATCTCTTGACCTTGTGATCCGCCCTCGGCCTCCCAAAGTGCTGGGATTACAGGTGTGAACCACCGT
GCCTGGCCTAAATTTTGTATTTTTAGTACAGACGAGGTTTCACCATGTTGGCCAGGCTGGTCTCGAGCTC
CTGACCTCAAGTGATCTGCCCGCCTCGGCCTCTCAAAGTGCTGGGATTACAGGCATGATCCACTGTGCCC
GGCCTTGCTTGCTACATTTTTTAAAGCATTAATTCTGTAACACAGAGAGAATCCTGGAAATGAAACAAAG
TGGTATACATATGTTAGGGAGGTATGTTTAAAAAGGTTCACTGAGGAAAAAGTGTGCATAAGAGCAGAAT
ATAGTGCAATCCACTTACTGGATGTGGAACCAGTAAGGACAAAGAGTGGGTTTGAATGACATTCCATATT
CCTTGGACATGATGGTGATATTTTCAGTGTAGTTGATTAAAGCATGGGTCCCTAACCCCTAGGCCACAGA
CCCTGTTAGGAACAGGGCCAGACAGCAAGAGGTGAGCAGTGGGCAAGTGAGCAAAGCTGAGTTCTGCCTT
CTGTCAGATCAGTGGCATGAACCCTATTGTGAACTACGCATGTGAAGGATCTAGGTTGCAGCCAGGCGCA
GTGGCTCATGCCTTTAATCTCAGCACTTTGGGAGGCTGAGGTGGCGGATCACCTGAGGTCACGAGTTGG
AAACCAGCCTGGCCAATATAGTGAAACCCCATCTGTACTAAAAATACAAAAATTAGCCAGGCATGGTGGC
AGGTGCCTGTAATCCCAGCTACTTGGGAGACTGAGGCAGGAGAATCACTTGAACGCAGGAGATAGAAGTT
GCAGTGAGCCGAGGTTGCGCCATTGCACTCCAGCCTGGGCAACAAGAGCGAAACTCTTTTTTTTTTTTA
AAGAAAGGATCTAAGTTGCTCGCTCCTTGTGAAAATAAAATGATAAATGTAATGTGCTTGAATCATCCCC
AAACCATCCCCATCCCCCCACCTCACCTTGTGGAAAAATATTGTCTTCTGCAAAGCTGGTCCCCTGTGCC
AAAAAGGTTGTGAACTGCTGGATTAAAGGGCTTTACTCAATAAATTATATCTAACTGGGGAGACTTTTTT
```

FIGURE 491 cont'd

```
CCACTATTGATTTTCTTCAGTATACCTTCACTGGATGCTTGCTACTCATTAAGGTCCATGCTACCTCAAT
GTGCATGGTATGCTGGGGATTGATAATACCACCTTCACATTCTTGTAATTCACTAGGAGGACTCAAGACA
CCCTATGTTATCATAGTCACTATGATTTATTGTAGTAAAAGATACCAAGTCAGTTGAGCAAAGGGAAAAT
GTGCATGGGATGAAGTCCAGAAGAAATCAGGTACAGGCTTCCAATAATCCACTCCCTGTAGAATCATTCA
TGATGTACTGTTTTTTCAGCATTGAAACATGTGAAATGTCTACCCAGTAAGCTCAATGGAGACTTAGTGC
CCTAGGCACTACGTTGTGTTTTGTTTTGGAACTGGTCACATAGGCCAGCTTGGGCCAAAATTCTAGATTC
CCAGAAGGAATTCAGCATAAATCACATTATACAAATAGCCGGGGCATGGTGAGCCACTCTCATCAGAGAA
TTGTGGAAATCCTCCTGAAATTCAAGTTCCCAGATACCAGTCAAGGGCTAACCTTATATCTTGCGCTGCT
ATAACAGAATACCACAGATTAGGTAATTTATAAACAATATAAATTTATCTGTCATAGTGCTTGAGGCTGG
GAAGTCCAAGGTCAAGATGCTGGCAGGTTTAACATCTGGTGAGGGCTGCTGCTGTCTGCTTCCAATATGG
CATCCAGTTGCTGCATCCTCTGGAGGAGACAGATGCTATGTCCTCATATGGTGGAAGTGATGAAAAGCA
AGAAGGGATTAAGTTTTAACAAGGGAACACCATCAAACTATAGCATGTTGCAAGCAGGCCTTTTAAGTAC
AACAGTCTCAGGCCTATGTTAACTCTTTTCTGAACAAAGGGCTTCAGAAATCCAGTACCTATATTCTTTT
CTTTCTTTTTCTTTCTTTGTATCACCAGATACCACATTAGGTCATCTTCCTTCAAGGTAATTTGTAACCA
AAACCAGTAGACTAAACCAAATAATTTCTTGCCCCTCTGCCCCATAACTGATAAGACTGTAGGTACAGTC
TACATCTACCCTCCTCATGACCAGAGTTTTCAGGTTAGTCACAAGACAGCTGTAGAAGCTGGGAGCTATC
TGGCTTTGTTTTTGGTTGGTTGTTGTTTGTTCACAGTCAAGAGGAGAGAACTGTTTCATTTGTAATATTG
TATAGTTCATGTCTCCCAAAATGCATGGCTACTCTAACTCCCATTCACACACAAGATTAATTCCTTAGCT
CTTACCTAGTATGCCCAGCCCTTGTGGGATCATTCAGTTTTTTCATCTGTGGGCCTAACTTGCCTGTTCA
TCTTTGGCCGTTGGGATTTCCCTGTCTTAGCTTTGAGTTTAGCTACATTTTAACGCTTTAGGGGATATTG
TCACATAACATTTTTCTATCTTTGAAAAGATCCACAATATTATGTAATGATTACCACTATCTAATCCTAG
AACTCTTTCATCTGCTCCCAAAAGAAATCCCCTACATGAGCTGGGTGTGGTGGTGCATGCCTGTAGTCTC
AACTACCCAGGGGGCTGAGGCGGGAGGATCACTTGAGCCCAAGAATTTAAGGCTGCAGTGTGCTATGATC
ATGCCTGTGAATAGCCACTGTACTCCATTCTGGGAAACATAACAAGACGCTGTCTCTAAAAAAGTAAGAA
AAAAAAAACCCTACATATTGACAGTCACTCCCCATTCCCAACTACATCTCCCCAGCCTTGGAGACAACTA
ATTTACTTTCTGTCTCTATGGACTTGCCTATTCTGCACATTTGATATAAATGGAATCATACCATATATGG
TATCTTGTGTCTGGCTTCTTTCATTGGACATAATGTCTTCAGAGTTCATCTATGTTATAACATGAATCAA
TATTTTGTTCATTCACATTACTAAATAATATTGCATTATATGGCTAGACCACATTTTGTTTATCCACTCA
TCAGCTGATGGACATTGGGTCTTCTCCACTTTTTGACTATTATGACTAATGCTGCTATGAACTTTTTTAG
AACAAGTTTTTGTGTGGATATCTTTCAGTTCTCCTGGGTATTTACTTAGGAGTGAAATTGCTGGCACATA
AGCCCCAGATCGGGTGCCAGCAGATTCAGTGTCTGGTGAGGTCCCGCTTTCTAAGTCATACATGGTCCTT
CTGGCTGTGTCCTCACATAACTAAAGAGGCAAAGGAGCTCCCTCAGGCCACTTATAAGAGAGCATTAATC
CTATTCATGAGGGCATTGCCCTCTTGATCTGATCACGTCCCATAGGTTCCACCTCCTAATATCTTCTTGG
GAGTTAGGATTTAAACATACGAATTTGGTGGGGGCCATAAACACTCAGACCATAATAATACCTAAAGAGA
AGTGAGGGATTCTGGGAAATGAAAACCAGGAGCTCAAGGTAGTTGGACACTTCCACATCAGAAGGCTTGG
ACATTCCGGAAGTGTAGTCCAGGAGGGCGGTACTGTTCTGTTTTTCCCCAACTCCAGCATTCTGTGATA
TGTAGTCCGGAGTTCCGTGTAGTCGCGCATAGCTCAGCTGCAGTAAGGCTGTAAATGTTTCCCCTGCGGA
ATCCTGGGAACTGTAGGTCCAATCGTTCTAGGTAGTTGTAGGCACTTCCGGCTCGAGGAAGGCAGTGCTG
TGGAATTCTGGGAAGCGTAGTCCAGGTCCTCCTGATACTCGCAGGCACTTCCGCCCAGGAAGACGACGTA
GCAGCCATCTTTTCCCTGGCTTTGGTGATTCAGGTCAGCTTCTCAGGAACCTTTCAAACTTCCCCGAAAT
GCACTTGTGGTCAGCAGCTAGCGGTCTTTTGTTTGGGGAAAAAAAGGAGTAGCGGCTAAGAGCGGAGGTT
TGAGGGGCCAGGATGCTGTTTTGCGTTTCCCTGGGCGGAGCTTGTTAGAATTGGGGGCGTACTGGCTTCG
GGCGGCTGGGGTGATGCTTCGTCGGGTTTGAAGGTCTCTCGGGCTGTTCGCTCCCTCATTGTGACTCCCC
CACCTAATGAGCCAGCCCTACCACTTCATACAGTATCACATTGAGCGAGTTAGTTAATCCCCGTGCCTTC
GTTTGCTGTTCTGAAGGAAAATAAAAGCAAAAACTTCCTAATAGAATGTTTTGAGAGAAAACGAGGTAAT
ACAAAAAGTGTAAAACTGCCTGGCACGTGAATTACCAATACTACTGTAATTTTCCTAGAAACTCCCGTTC
TGTGGCGAAATTCTGTGAGTCCATGAAGCTGGATTGTCCCTGACCTCTTTTGAGGAAGGAGAGGGTTGCT
TCTAACTGGTCCTGGGAGATGCCACTGTGATGTATCCGGGATGAAGACACAATCCTGGTTACTTCATAGC
CTGTTTTCTTCCCCAGCCCTGACTTCTCAAAAGCACTGCACAGAGGAGGAGGCAGCAGAACCCCATGT
GAGTAAGACTTGTTGTTATTCTTGTTTTATTCACATAAATCAGAGAATGTGTGGGTCATGTATTTGGGC
ATGAGAAGTGATTATAATTTAGCGTTAGTTGCTAAGTTCCATTCTAAGGGGTTTATACAAATGAACACCT
TTCCACTATACAGTGGCTCTGTGAAGTGATACTCTTTTTCCGAGGAGACTGAGACATAAGAACATAACTT
GTTTGCTCATAGCCACCTAGCTAGTAGGAGGCAGAGCTAGCATTGAAACCGAGGCAGTCTGAGTCTAGAC
CTGAGTCTTCTTTGGTATGTTCTGCATGAGCCATAGGCAGCTGGCTAGTATCATGTGAAAATAGGTTGGG
ACTTCACTGTGGGGACTTTGCTCAAGGTCTGGGCTATTCTATGACTTTTAAAAAATAGTGGCTGGGCACA
GTGGCTGACGCCTGTAATCCCAGCACTTTGGGAGTCTGAGGCGGGCAGATCACTTGAGGCCAGGAGTTTG
AGACCAGTCTGGCCAACATGGCGAAACCCCATCTCTACTAAAAATACAAAAATTAGCCAGGCGTGGTGGC
CAACACCTGTAATCCCAGGAGTTTGGGAAGCTGGGCAGGAGAATCGCTTGAACCCAGGAGGCGAGGCTG
CAGTAAGCTGAGATCACACCGGTGCACTCCAGCCTCGGCAACTGAGCAAGACTCTGTCTCAAAAAAGAA
AAGAGTTTTTAAAAATAGTTTTCTCAATTATTAGTTTTATTTGTTTCAAATAATATAGAGGTAACACATA
ATCATGGAAAACACAGAAATACATTTAAAAATGTAAATTCCCATGACCTTAGGGTATAAAGATAACAA
```

FIGURE 491 cont'd

```
CTATAGTTTAGTGCCTTTCTGTCAAGTTTTTCTTGTATATATTTCTGTTTATTAGGGGCTGTTTTGGGAG
AGGGACTGAGTACAGTGCAACACTACTCAAACTGTGGTTCACAAAGCAGCAACATTGGCATCACCCAGGT
AGAAAGGCTCATTCTTGAGCCCTACCGAAGGCCTTCTGATTTAGCATTTTTGCAGATAGGACCCAGAAAT
CTGCATTTCAACAAGATCCCAAGGTGAGCGAGATGCATGTTAAAGTTTGAGAAGCTCAGGAAAAGGTCTT
ATCTGGAAACTCAGGACTAGAAAACTGACCCTGCCAGATGTCACAGATAAAACTGAGCTGGCCATACTAG
AACCCTACTCAGTCCAGTGATTTTTCTTTCCCACTAAATATTAACTGTCAAGTTTCTTTGCAAAAACCAT
GACATGAGTAGAAGGCAGCTGTCAAGTCTAGAGTCAAAATGGAGAAACTCAGAGTCCTGAAGATCTATTT
CTCCCAGGCTTTGGGGAGTAGATTCCTTCCCATCTTTTGTACTGGAGGCCTTCTGCCTGAAGTGGGAAGA
TCAGCTACCTATTTATTGTTAATTAACGTTAGATATTATTGCCATAGTTGTCATCATCTCGTCATCGTTA
TTATTCTGATTAATGACTTTCCTAATTTCTTTAACTTTTTTTTTTTTTTTTTTGAGGCAGAGTTTCA
CTTTTGTTGCCCAGGCTGGAGTGCAATGGCGTGATCTCGGCTCACTGCAACCTCCGCCTCCCAGGTTCAA
AAGATTCTCCTGCCTCAACCTCCCAAACATCTGAGATTACAGGCACCCGCCACCACACCGGCTAATTTTT
TTGTATTTTAGTAGCGATGGGGTTCCACCATGTTGCCAGGCTGGTCTCGAACTCCTGACCTCAGGTGA
TCCACCCACCTCGGCCTCCCAAAGTGTTGGGATTATGGGCATGAGCCACCGTGCCCAGCCAACTTTTTT
AAAAATATAATTTCAAACTTGTAGAAAAGCTGCAAAAATGATAACGTAAGGAAATCTCATATACTCTACA
CCCAGATTCACCAGTTGTTACGTTTGTTTGTTATGTTATGTTTTCCCTGTGTGCTCTGTTGATGACCATC
AGCCATCACCAGGAACATACCTGTAACCAACAACAATTGTTTGTTTTAGCTTGCTGCATCCAAGGAGCCC
ACACATGCATGGGGTGTCTTGGTAAGAGGCAATTAGGAGGACCCTGGTTATAGGGTTTTGGTTTATGTTA
GATGAGTTGGGGAGAGTTTTAGGCAATGGGTTTGTTCTGGATTGGATGCTGTGAAGAAGCAGTAGTAATT
TGATCAGACTATTGTAATTTTTATGTTGGAGGTGGGGAAATAACAAGACTGGAGTTGTCACTGATAACAA
AGTGGTCATGTTAGATGGAAGAGGCAATTATTTGGCTATTTTATCAATGTAGGATGTATTTCTCTCTGT
GTTACAAGCTGTTTTGTTTTTTCTTTTTCACCATGATCACTGAGTAGACCTGTCTCATTCTTGTTGATA
AATTGGAAACACCAGGTTCTGGTTGTTGCTGCTGTTGTCAAAGTAGTTTTTTGTTTTGTTTTTTTTTTG
TCTTTTTGCTTTCACAACTTTGTCATACTTATATTTTGTTTTTGTCTTTTTGCTGAAGTATTTGAGAGCA
AGCTAGAGATAGTGATGAAAATGAAATTAGTTACATTGATAACTTACTGTTATCTAACCCACAGTTTGTA
TTTAAACTTACTCCATTTTCCCATTAAAGACTTTGAAAGTAATTTCTTCCCCAGATGAGTTTCCAGTCT
AATTGTATGCATTGCACTTAGTTTTGGTTTCATTAGTCACCTTTAGTCTAGAATGATTCCTCAGACTTTA
TTTCTTTTTTGCTCTCGATATCTTTCTAGAGTATTGAGAAATTATTTGTAAAATGTTCTTATTTTTTTGT
TTCCTTAATATTTATTCATGATTAAATTCAAGCTATGCATTGTCAGCAGAGATGCCATAAAAGTAGGGAG
GCATCCTTCTCAGTGCATCATAGGAGTCAAATGTTGGTTTGTGGGTTTGTCCCACTAGTGGTCTCAACTT
TGTTTTTTTGGATAAAATGTCTGCCAGGTTACCTTTTTCCTTTTGCACTTAATACTTTGAGACTATGTAG
CCATCTTATTCCTCACCAAACTCACCAGTTTTTAGCAGCTATTGATGATGTTCTAGTTATCTTTCATTCT
ACCTTTATTAGTTTATGTGTTCTACTATAGGAGCTTTCTTTTGTCACCCATTTATTTATTACACATTCTT
TTGTTTATAACAATATAGACTCAGGTTCCTCCCTTTTCCTTTTTTTTTTTTTTTTTTTTTTTTTTTGAG
ACAGAGTCTCACTCAGTCGCCGAGGCTGGAGTGCAGTGGGGCAATCTCAGCTGACTGCAACCTCCGCCTC
CTGGGTTCAAACAATTCTTGTGCCTCAGCTTCCCAAGTAGCTGGGATTACAGGTGCCTGCCACCATGTCC
AGCTAATTTTTGTCTTTTAGTAAAGACAGGGTTTCATCTTGTTGGCCAGGCTTGTCTTCAACTCCTGACT
GTAAGTGATCTGCTTGTCTTGGTTTCCCAAAGTGCTAGTAGGATTACAGGCATGAGCCACTGTGCCTGGC
CAGGTTCCTGCATTTTTAATTTAAGTTAGGTATGGATTGTCAAACGGTGTTTTTAATTGCGGTATCTTC
GGTTTTATTAGTTCAGTGTTGGCAAATTATTGGAAAGACGACAAGATGTTTTTCAGAAGTTATAAGACAC
TTTCACGTGACATAGCAACAACCTGTGAACTCCAACTATCTTATAATATTCTGTTGGTGGAAATTATATT
TTTAAGGATAATTTCAAACCATAGACCATCTTCTACTTATTGCAGTTGCAAATAAATAAGATACCTGACT
GTGTTGTAAGAGCTTTCTACCTTCCAGCAATCCGATGAGGTTGGTACTGTTATTCTTTACCACTTGCAGA
TGACAGAAGTAAGGCAAAGAGATGTTAATAGTTTCCCCAAGGTGACGCTTTTAGTGTCAGGATTTTAACC
CATGCATATCAATTCCAGGCCTACTGTACTTATATTGTCTCAATTTACGCTGTACTCAAAATAAGAATTA
CTGGCGTGCAATTACAGGCACATGGGCAGTGAGGCCACTGTGTGGTTAGCCTGGTTCTGAACTACTGCTG
AAAGGGGTAGTTGGATATCTGGGATCCATGTCATAATCTGCTTAAAAGCCACATAAAGCTGCAGCCACCC
CAAGAAGCACACACCTTTGCTAATTCCTAAAGAGCAGCCACGTGCATTAGCAACATACTTACCCAGTTTT
GATTTATTTCTCTCTTCTTTCCTAGTTCAGCTTCTTAGGACTCTGCACTTCCCCAGAAGGAAGAATTAAA
AATGAATATGTTCAAGGTGAGTAGAGCTTGCCTTTCCCAGCTGTTAAAAATACCATTTTAGTACTCAGAG
ATGGAACCAGGTTTTCTTTTTCAAGTAAGAGTCAAGGCATCTGATGACCTGTTGAGTGTGCTAGGTGCT
TATTTTGTTCCGTTTGAGTTTAGCTGGTTTTGGTTTTAGTTTTATTTCGTCATTTTTATTTTACAAATAA
AGGTAGAAAAATTAATAGAAATGATGGGTGGGCACAGTGGCTCACACCTGTAATCCCAGCACTTTGGGAG
GCCGAGGCAGGGGGTGGGATCACTTGAGGTCAGGAGTTTGAGACCAGCCTGGCCAACATGGTGAAACCCC
ATCTTTACTAAAAATACAAAAATTAGGCCGGGCATGGTGGCTCACGCCTGTAATCCCAGCACTTTGGGAG
GCTGAGGCGGGTGGATCACAAGGTCAGGAGATCGAGACCATCCTGGCTAACATGGAAACCCCATCTCTAC
TAAAAATACAAAAAATGAGCCAGGCGTGGTTGCAGGCACCTGTAGTCCCAGCTATTCGGGAGGCTGAGGC
AGGAGAATGGCCTGAACCTGGGAGGCGGAGCTTGCAGTGAGCAGAGATCGTACCACTGCACTCCAGCCAG
GGTGACAGAGCGAGACTCCGTCTCAAAAAAATAAATAAATAAAAAATAAAAAAATTAGCCAGGTATGGCG
GTGCACACTTGTAATCCCAGCTACTCAGTTGGCTGAGGCAAGAGAATCACTTAAATTTGGAAGGCAGAGG
TTGCAGTGAGCCAAGATCGTGCCACTACTCCAGCCTGGGCAATAGAGCAAGACTCTGTCTCAAAAAAAAA
```

FIGURE 491 cont'd

```
AAAAAAAATTAATAGAAATGAAAAAATCTTATTTCCATAATCTCTTCATTGTATGTACTTGTAATTATAT
ATTGGCATTCATAACATAGATATAATTTTACATTTCTTACATTTATAACATTTATTTTTGTTGTATTTCT
ATCAAATTTATGTATCCAGTTTTTAAACTATTCTCTATATACAGTTAGTGTAGGATTTTTACTGTTTTAG
GAACTACAGTGTTAGTTTTCTTGCATTTAACTTTTTCTGAAAAAATCAATTTTGAAAAATACTGCCTTTT
AAAATCCGTAACATTAGGTATTCAGAATTGAAAGGTATGTTTTGTGTGTGGTACTTCAGATTTTTTTTG
ATAGAATATTCAAATATGGCACAGTGTGTCAAGATTTAACAGCTGCTTCACCCAGAAAAAATATTAGACT
TTTTTTTACTACAAGAGCTAGATTCTGTCTTCCCCATGCCTCAGTCATACCCTGTGTGTTTACTGGTCTT
TTTCCCTTTTAATATTTTTTTTAGTTAAAGTAGTATGTGACCTTAATTTAAAATGCCTAGTGGTAGGAAA
GGATTTGCCAAGCACTTACACTCTGCCCCTGTATTGAGACCTCACAGCAACTATGAAGAGGTTCTTTGTT
TTGTCTCCATTTTAAACATAAATAGAAAAGGGCTTGTGAAAATGAGGAACGTGCTCAAGTTCACATGGA
AAACTAAAGATCCGGGATCAGTGTATTATATTCAAGTGAAAGACCAAGACAGGAGGACAGAGAGAGTCCT
TCATTCAGAAACCTGACATGCCCTTTAGGTTTGTTTCCACATATAACGCTGCTCACTTGGCTCCCACCTC
AGTAGGAAGGCAGGTGCTATCAAACACTATTGGGACTCAATTGGTAAACCTTTCTGGGGAAATTGGCAAT
GTTTTAGGTTCAGCAGGTAACAGTTCCAGGAAATTCCCTTATAAGAGTACTCACTGAGAGCATCCAGTAA
ATATACAAAGCTTTCTTTTTCACAGCAGCACTTTTGGTAAGTCAGTGTATGGCATTGGCAAGACAGGAGA
AGGGCTGGGAAATCTACAAACGGCTGGGCATCCAGAACAACTTTCCACCTGTTCTCAGTGTTACCCATCT
TCTAGTGGACATTGGTTGTAAGATTGAGGTCATTTGTTTTGTCGTAGGAAGCGGTGACCTTCAAGGACG
TGGCTGTGGCCTTCACGGAGGAGGAATTGGGGCTGCTGGGCCCTGCCCNGAGGAAGCTGTACCGAGATGT
GATGGTGGAGAACTTTAGGAACCTGCTGTCAGTGGGTGAGGACAGCCTCCCTCTGGAATATCTTTGTGCC
CTTGGAGTTTTAAGGCTTTGTGGCCCTTGAAATTGTTCCCTGAGTGTGGGAATCTGACTTTCCTAATTTT
TGTGGGATGCAGNGACACTGGATGTTTCTGGTCTTTCTGAACNGAATATTTTAGGTCTTTTTCATTTGTG
TTTTATAGAAGAACTGTAAATGAACAGAATACTGCTATGCCTTGTCTATTCTTTTTCATGTTTTACACCT
GTCCCAGTATTGAATTATAAAACCAACTTATTGAATGTCATCAGCAGATTTTAATGAAATAAAATAGGGT
AGAAAATACTAGAACTCCTTAGGAAGAATGGCACACACTGCAGCAAAAACTCTGGCCAATTGCTTGAGTG
ATGTGAGAACCAATGGGAGATTTAAGGAAAACAGACATTAGTTAAAAATAGGTTATTCAAACTTGGTTTT
CATAATATGTATTTACGCATGTGTGTCTGGGTCATGAAATAAATGGTGTTTCTTTACTGAAGTCACAATT
TAAATAAAGTTTGAAAAACACTGCTTTCAGTGTCTTGAATGTGCAGTTGCAACTCAGATTTCCAGTGTA
TTTTAACTCTAATATGTTCATTTTCAACTTGTGATTTGGCATTTTCACAGGGCATCCACCCTTCAAACAA
GATGTATCACCTATAGAAAGAAATGAGCAGCTTTGGATAATGACGACAGCAACCCGAAGACAGGGAAATT
TAGGTAAAAACCAAACAGTTATGAGTTCTTATAGTTAACTGTCCATCTGCCTTTGCTTCTTCTTAGCCTTG
TTGCCATCACCTGGTCCAAATTGCCAACTGTCTTTCCTGGATTATTGCAACACCCTTTGTACTGCTTGCC
CTGCTCCCACCCCTCTCCTCTTACATTCTGTTCTTTAAGTGGCAAAGTGAGTTTTTGTTACCTTGTGTCA
GACTATGTTGTTCTTCTGCTCAAAATTCTCTGTGACTTATTTTACATAGAGTAAAATCCACTTAATGTGG
CTGACAGAGTCTTACACGGTGTGCTTTTCATCCCCCACTACCTCTCTAAATATATCTTCTATACTCTCTT
TCTGTGAATTCCAGCCACATTGTCCTCCCTCTTGCTTTTCAGACCTATCAAGGATGCTTCTGCCTCACAA
CCCTGTGTGTTCTTCCCTCTGCCTGAAATAATCTTTTACCTATAATCCTTCTGGTCCCTTCTTCATTCAT
TTCTTTGCTCAGTTTTAGTATTATAAGAAAGGCCTCGGCCGGGCACGGTGGCTTGCGCCTGTAATCCCAG
CACTTCGCGAGGCTGAGGTGGGCAGATCAATCATGAGGTCAGGAGATCGAGACCAACCTGGCTAACACGG
TGAAACCCTGTCTCTACTAAAAATACAAAAAATCAGCTGGGCGTGGTGGTGGGTGCCTGTAGTCCCAGCT
ACTCGGCAGGCTGAGGCAGAATGGTGTGAACCCAGGAGGCAGAGGTTGCAGTGAGCTGAGATCGTGCCAC
TGCACTCCAGCCTGGGCGATAGAGCGAGACTGTCTCAAGAAAAAAAAAAGAAAGGCCTCCTCTGACCAC
CCTATTAAAAATACATTCTCTCCATTTACTCTCTGTGCACTGCCTTATATTGTGTGTAAGCACTGATTAT
CACCTCATATATGTTTTGTTTAGTGACGTTTGTCTCCTCACTGGAGTGTAATCTCCAGGAGTGGAGGAA
TGTTATCTATTTGCTTCTGTCTCCTCAGTGCTTAGAATAGTCCTAGTATATGGCAGAGACACTATAAATA
TTAGTTGAATAAATGAGTTAATGGAAATCTGTCTTCCATGGAGGTAACTAATAGGTGGTGAACAAATCAG
CATAAATAAGGGATATTGCAAAATATTTTTGTCTTCTAATGAATTCCTAACCTAATTCTAATTTCTCTT
TGTGTGTGTGTGTGTGTGTGTGTGTTTGCATGTGTTTGCCTGTCTGTACAAGTTGACCCATATCTTGG
GGAACCTATAGTGTCATAGTTGTAACCAAACTGAATAACATGCTTTGTTTATGACTTTCTTTGAGCATTT
GTAGCAGAGCATATTCATTCGGGGAGGGAATATTTTACAATAAGGACTTTTATTTCTATTTCTTAGGTAT
TCCCCCATAGAAGGGAATAAAATTCGATTTCCTTATCCATTATATCAGGAAAGAAAAGTAAAACTAAAA
ACCAGGACATGAGCATTAGCCTTTCCCTCAAAATGTTTGCACAGTTGCATCCCATTTGCTTCTTCCAAAG
TCCACATTCATAAAAAGAAATGGATCTTACATTGTTGCCTCTCAAACATTTATATCGTGTAGGCTTATAT
GTATGTCTTTAGAAGGCCTTTTATGTAATGACACCATTACTGCTTGTGATTATTCTGATATGATACTTTA
TCTGTTTTTTTTTCCTAAATATCACAAGCTATTAAATTTATTTCACAATTGACTAGTAGACCACTTTGTC
AATTTGGAAAACATTCTTGTTAAAGACAAAACATATCTACATCCAGAAACTTTCTATACCTTGCTTTCAAA
GAGACAGCATTCTTTGCTAGCCTTCCAATTTTGACTCAGTGCAAAAGCCTTAGAAGGATCCAGTGCATAG
GTCTTCATGCTTTCCTTTCACCCCAAGTGATTATCAACTTTGATTTTTCTCTTCAGCAATAACTCACTTG
GTGTACCCCTACCTCAGGTACAGCTTTTCAACTTTGCAGCAAAACTGTACTTTCTAGTTCTTTTTGTATT
TCAGATACCTTACTTGTAAAAGCTCTTTTGCTCTATGACCTGGCTCAAACTTAAACTTGGATTTGAAGTT
AGAAGAAATGTTGGAAGTCATTTATATATGAAGAAATGTTGGAAGGACTCATATATGCATACATTCCTTG
AGTGACTATGAATGACTGCCGGGCAGTAACTTCTGGGCTGTGGTTGTAAACTGTGAGCACTACAAAATGT
```

FIGURE 491 cont'd

```
TTTTCCTTATTGATACCATATTATGGTAGGAAAGACATGGAATAAAAAATTTAGATAGTATGTCAGTAGT
TGTGTTTTTAAATGGGTTTCATTAGTGCTTAGCAATTGGGAGCTTGGTGGACCATCTCTTGGTTTTGGAC
CATCTCTTGGTTTCTGTCAGTATGTAAACCAGAAACTTCAAATGTGTCACAAAAGATGAGCAGAACTATC
CCGAGGTTCATTAAAGTCTTTTACTCTGTCCTCAGTGTGAAATCTTAAATCTTTGAACAAAAAAATTCAC
TATCTCTCTGAATCCTTTGTCCTTACAGGAGAGAAAAATCAAAGTAAGTTAATTACTGTTCAAGACAGAG
AATCAGAAGAAGAGCTTTCTTGTTGGCAAATCTGGCAACAAATTGCAAATGACTTAACCAGGTGTCAAGA
CTCCATGATCAATAATTCTCAGTGTCACAAACAAGGTGATTTCCCTTACCAGGTAGGGACAGAACTGTCT
ATTCAAATTTCTGAAGATGAGAACTATATAGTAAATAAAGCAGATGGTCCCAATAATACTGGGAATCCAG
AGTTTCCTATCTTGAGAACCCAGGATTCTTGGAGGAAAACATTCCTGACTGAGTCACAGAGATTGAACAG
AGATCAGCAAATTTCCATAAAAAATAAATTATGTCAATGTAAGAAGGGTGTTGATCCCATCGGTTGGATT
TCACATCATGATGGTCATAGAGTACACAAAAGTGAAAAATCTTATAGACCCAATGATTATGAAAAGACA
ACATGAAGATTTTGACATTTGATCACAATAGCATGATTCACACAGGACAGAAATCGTACCAGTGTAATGA
GTGTAAAAAACCCTTCAGTGATCTCTCCAGCTTTGATCTTCATCAGCAGTTACAATCAGGAGAGAAGTCT
CTTACATGTGTTGAGCGTGGAAAAGGCTTCTGTTACAGCCCAGTTCTTCCTGTTCATCAGAAAGTACATG
TGGGAGAAAAACTTAAGTGTGATGAGTGTGGTAAGGAATTCAGTCAGGGCGCTCATCTACAGACCCATCA
GAAAGTCCACGTGATAGAGAAACCATACAAATGTAAGCAATGTGGGAAAGGTTTCAGTCGTAGATCAGCA
CTTAATGTTCATTGCAAGGTCCACACGGCAGAGAAACCTTATAATTGTGAGGAGTGTGGGAGGGCCTTCA
GTCAGGCCTCTCATCTTCAGGACCATCAGAGACTCCACACTGGGGAGAAGCCATTCAAATGTGATGCATG
TGGTAAGAGCTTCAGTCGGAATTCACATCTTCAATCCCATCAAAGAGTTCATACAGGAGAGAAACCATAC
AAATGTGAGGAGTGTGGTAAGGGCTTCATTTGTAGCTCAAATCTTTACATTCATCAGAGAGTCCACACAG
GAGAAAAACCCTATAAATGTGAGGAATGTGGTAAAGGCTTTAGTCGGCCTTCAAGTCTTCAGGCCCATCA
GGGAGTTCACACTGGAGAGAAGTCATACATATGTACTGTATGTGGGAAAGGCTTTACTCTGAGTTCAAAT
CTTCAAGCCCATCAGAGAGTCCACACTGGAGAGAAGCCATACAAATGCAATGAGTGTGGGAAGAGCTTCA
GGAGGAATTCCCATTATCAAGTTCATCTAGTGGTCCACACAGGAGAGAAACCCTATAAATGTGAGATATG
TGGGAAGGGCTTCAGTCAAAGTTCGTATCTTCAAATCCATCAGAAGGCCCACAGTATAGAGAAACCTTTT
AAGTGTGAGGAGTGTGGGCAGGGTTTCAATCAGAGCTCACGACTTCAGATTCACCAGCTGATCCATACGG
GTGAGAAACCATACAAATGTGAAGAGTGTGGCAAGGGATTTAGTCGTAGAGCAGATCTTAAAATTCACTG
TAGGATCCACACAGGAGAGAAACCATATAATTGTGAGGAGTGTGGGAAGGTCTTCAGGCAGGCCTCAAAT
CTTTTGGCCCATCAGAGAGTCCACAGTGGAGAAAAACCATTCAAATGTGAAGAATGTGGGAAGAGTTTCG
GTCGGAGTGCACATCTTCAAGCCCATCAAAAAGTCCACACTGGAGATAAGCCATACAAATGTGATGAGTG
TGGGAAGGGCTTCAAGTGGAGCTTGAACCTTGACATGCATCAGAGGGTGCACACAGGAGAAAACCATAT
AAATGTGGGGAGTGTGGTAAGTACTTCAGTCAGGCCTCAAGTCTTCAACTTCATCAGAGTGTCCACACAG
GAGAGAAACCATACAAATGTGATGTGTGTGGTAAAGTCTTCAGTCGGTCTTCACAACTACAGTCTCATCA
GCGAGTTCACACTGGGGAGAAACCTTATAAATGTGAGATATGTGGTAAGAGCTTCAGTTGGCGATCAAAT
CTTACAGTTCATCACAGAATCCATGTTGGTGATAAATCCTATAAAGTAATAGGGGTGGTAAGAACATCA
GAGAATCCACACAGGAAAAAAATCTATAAATGATTCTTTGTGAAGACTCGTGTCATTTGAATTCTTCC
AGTTATCAAGTCTCAAAGTCAGTGTTTCAGCCGTAGCTCCTCATGTCCCAGTGGTCCAAAGACAACAAAA
CAATCTTTATGATTAGCATAGCAAGGGCTTCTTTAGTCAGAACCTTGACCTTTATAAAATGTTACTTAGA
AGAGGGGTGTTAAGAGTGAAATTTTTCTCAGGCCTTTTATAAAAGTATCATGGTGGACATGCCAAAATTA
AGTGTCCACTAGAATGTTAACTCCATAAAGACAGAAACTTTGTTCACTACTGAATCTACATAATCTTACC
ATTGCCATATACTTCACAGGTGCTCAATATTTGTTAATAGGTCCTTTTTGAAAATTATGTTGAGATCACC
TGCAGAATATCATGAATTTGTAAACAGGAAACCTGAAAGTAGCCTTAATAAGATTAAGTCGGGAGACCAT
TGAAATGTAGAAAACCACTCAATACTGAACTCCCCAATGTTAATTTGGCATTGTCTTGTGATTAGATCCT
GTCCTCCTTTAGCCTCACTAATCAAGTTGGGTCCTATCTTCCCAGATGTCTAGTTTTCTACTGGTTTTAT
ACCATATAGATTCAATTATCTTTGTAACAGATAATTGTGTTCATCTTGTAATAACTGGACACTACATAC
TACACTTATTTTTTCAACACTGTTAAGGCAGGGGTTTAAGTGTCAGAGTTGCTAATGACACATTTTTAG
TAGATGTTGATCATTGGTTTTTTCACATTTTCATTCAGGCTTTGACATGATTGCCTTCTAAGGGCTTTAG
CATTACTTTAATCAGAGTTTAGGTTGCGGCTATTGCAGATTTCTTTTGTGAACTTCTCTCCCCCATATTC
TGAGAAAAGGACAAAATATTAGTTAAAATTTGATAAATTTCATCAAAAATCGATTTTTGGAGCATGACT
TTCACCCTTTTTCCTAGTGGTGGCAGTGAAAAAAATGCTTTTGGAAGAGAAGTTAGTATGTATCAGAATA
TAGAATGTGCATCTCTTTTTTCTGGAATTCATAGAATAGGAATTTTTGATTAGGAGATTCAAGTAGAAAA
TGTAAGTAGCACATCAGTGTTAATGAATTTTGTAAAAATAGAAATAATTTTTTATATACTACAGTAAAAA
GGATCCTTGAAAATGATGACCAAATTTTATGACAGAAGAGTGTAACAGTTTAGTTTAAGAACATCACAGG
CTGGGTGTGATGGCCCACGTCCATAATCCCCGTACTTTGGGAGGCCGAGGTGGGTGGATCACCTAAGGTC
AGGAGTTCGAGACCAACCTGGCCAACATGGTGAAACCCTGTCTCTACTAAAAATACAAAAGGTAGCTGGG
CGTGGTGGTGCGTGCCTGTAATCCCAGTTACTTGGGGTGTTGAGGCAGGAGAATCGCTTGAACCTGGGAG
GCGGAAGTTGCAGTGAGTCAAGATGTTGCCACTGCACTCTAGCCTGGGCGATAGAGTGAGACTCAGTCTT
AAAAAAAAATCACATACCTTAAATTCGTGTGTGTCCATGTGAGTGAATAGTGCATCTAATCGTGAGTCTG
TCCTATGCCACCACAGCATCGAAGAGAATGCAGGAATTTTTTCACATTTAACTTCTATATTTTAATTTT
TTAACTGAGCATCGGTTTTATAGTAAAATACTGTTATTTTACAGTAACATAGTAAAAATATAATTTAAAA
AATTACTAGAATATATTAATCCCTTACAGTTAAGAAATCTTGTGTCATCATATAGCATATAAGGCCAAAA
```

FIGURE 491 cont'd

TTAAAGAATGGAACTCTGGAAATCAATTATAAAAACTTGTATGGTGGTTCAAAGATACAGATGCATTGGT
AAGAGTGAATATATATTTGCAGTGAATGCATTTGAAGCTGCTTCTTAGGTACAAATCTATGCAATCAATA
CAGTTTTAATGTAATTCCAGTAGTAGGAATGCTTCTTAATTCTTGACAGACTTACTCACTGGCTGAATGG
ATAGATAACCCAGGGCACTGGCTTGTCTTTTCAAGTGCTTGGTCTGATTGGGGGAAATGGCTGGGCCTTT
CTAGGTACTGTATGGCAAGGAAAATCGAGCTGTGGAAAAAAGGAATAATAAAATTTACAGAGGCCAGGTG
CGGTTGCTCGTGCCTCTAATCCCAGCACTTTGGATGGCTGAGGCAGGTGGATCACCTGAGGTCAGGAGTT
TGAGCCCAACCTGGCCAACATGGTGAAACTCCATCACTATTAAAAAAAATACAAAAACTAGTCGGGTGA
GGTGATGGGCGCCTGTAATTCCAGCTACTCAGGAGTCTGAGGCAGAAGAATCATTTGAACCCAGGAGGTG
GAGGTTGCAGTGAGCTGCGATCGTGCCACTGCACTCTAGCCTGGGTGACAGAGCAAGACTCTGTCTCAAA
AAAAAAAAAAAAAAAAAAAAACCCAAGAAGGTGAGGGCAAATTCAGAAGCTATAGAGTGGAAATATGTA
ATTTTTGAGGTAAAATTTAACAAAGATTCCCTGAGGAAAAGATGTGCGTAGGGAGAGAACAGCATGATGC
CAGTGAAAACAAACTGGGAACAGGCAGTTAAGCAGGATCGAATACCATTTCTTTCTTAGGCGTTTCTGTG
ACATTTAAAGCTTATTTGGTTAAAGGCTTTACTCAGCAAAGGATATATCTGTGAGGTTTCCACAATTTTC
TCTATTTGGATTACAATTCCTGTTGTTCCTGGACTGCATCTTCACATGCTAAGTATGTAAAGTCCATGAT
ACCTCAAGTTGTGTTAGATATCAGAAATCCTGAGTCTTCGATGTTTAGTTTGCTCTTAGATATCAGGATA
GCCCACCAACTCTCAGTAGCTTAGTGAGTTAAGTCAGGGGTCAAAAAACTACCCCCTGTGGGCCCAATCC
AGCCCACTTCCTTAAAGGTTTATTAGAATATAGCAATGCCTGTGTTTTAGTGTATTATCTATGCTTTCTT
GCTGCAGTGTCAAAATTTAGTAGTTGTGACAAAAACTATGGACCACAAAATCTAAAATATGTGCTTTCTG
GCCCTTTACAGAAAACGTGTACTAAGCCTTATGTTAAACCAAATGATTTGTCTCCCATAACTTAAAAAA
GACCCCAGGTAGAGCAGGACTTAGACCTGCTTCTGTCAGGATTCCAAAATGATTTTTTTGATTCTCATA
TCTGCCCTTCTGGTTAACCCTGGTCTTTAGGTTCAAGATGGGGCTAGCAACCAGGGAGCACCTATCTTTT
CTTTTCAGTCAGTGGAAGGGAGGTGCTCTTTCATTTGTAGTGTTAGGTAGTTTACTACTCACAGTGTTTG
TGGCTCCTCTGGCCTTGATTCTCATCTACACTCAAGATTAGACAGCTAGTTGTGTGTCCAGTTCTTTTGG
CCTTTGTGAACTATCAAGTTTCAACTCAGCCAGGTGCAGTGGCTCACACCTGTAATCCCAGCCCTTTGGG
AGGCTGAGGTGGGAGGATCTCTTGAGCTCAGGGGTTCAAGATTAGCCTGGGCAATATAGTGAGACCCTGT
CTCTCCAAAAAAAGTTTTAAAAGTTAGCTAGCCATGGAGGCACACATGTGTGGTTCCAGGTACTCAGGAA
GCTGAGATGGAGGGATCACTTGAGCCCAGGAGGTTAAGGCTGCAGTGAGCTGTGGTCCCAACACTGAACT
GCAGCCTGGTGACAGAGTTGAGACACTGTCTCAAGAAAAAAATAAGTTTCATCTCTCCCTTGCACCATGG
ACTCAACTTCCCTATTTTGAGCCTCCAGGAGATTTTTCTATCTTAGCTTTTAGCTTGGCTGCATATTAAC
ATTTGGGAGAATTTGTTATATATTATCAGGATTCCTTTGTTTTTGAGAAAGAGGGATGCAAAGCCAAAAT
CAGCGGCTGAATGACAACACATTTAATTCAGAACTTTTAGGGTGTCTTATGTCACAAGGCATCAATGAGA
AGGAATGGAATCCTGAAAAATTTGGGAACAGATGAGCAGATTCCAACAAAGCTGAGGGTTTTGCTCAATC
TAGCTGAGCATCTCTTGCCGTTAGAAGGAGCCCTTCTTCCTCTATTTGAAGTCAGTCTCCCTTGCCTGAA
AAGCCTGTGATGACCTTCCCTGAGATGGTTTCCTTGCAAAAGGCTTTAGATCCTCAAGACTTGCTTCCAC
TACCTCTCATTTTTCTAGACCAATAATGAAACTCGGGTCTTCACAGACAATGGGAGGAGTCACCAAGTAG
AAAATACGACCATGAGGAGATACATCGCCAAAGTAAGGATTTTTGTAATTTATATCAATAGAAACCTGAG
AAATAGATATGGTTGTAGATCTTACCAGTGTTAATCAGGTGGAAATAATACAATGATGGATTAGGCTGG
ATTTGCTGATATGGGTGTAGTGAACAGTGATTCCAGACCCACTGTTAGCTTGAGCACCTGGGAATAGTTT
CAACAGTTTTCTCAGTTGTATGAAACTTGGATGCAAAAACGTTAGCCTACCCTAAAGTAAAAAAAGCCA
GAACTTTGTAAGTATGTTATAGAATTTCTCGACCTTGGCACAACTGACATTTTGGACTGGATAGCTCTGT
TAGGGGATGCTCTATGCATTGTAGGATGTTTAGCAGCATCCTTGGCCTCTAGCCACTAGATGCCAGTAGC
ACACGTGATGCGCGCGCGTGCATACACACACACACACAAACACACACACCTCAGTTATAACAAGCA
AAAATGTCTCCAGACACTGCCAGACAGCAGTGCGGGGGTTTGGAAATTGTCCCCAACTGAGAACCAGTGT
TATAGAACATATACAGAGACATAGGAATGCCAGAATGCTGGAGTGGATGTATGTAAAGCCTTACTCAACC
CTTGTACTCTGGGAAGATTCGGAAGACACTCTTTGCCAAGGACTTGAGAAGTTCATTGGCGAGAGGAGCA
TTGGCAGTTTGGGAGAGCTCTGTAGTAACTCTTCTCGGCAGACCAGGAATGGGAGAGGAAAATTGTGACA
TTGAAATGGCTTTAAAAAAAAATTCAATGAGGATGATGGGATCCTGGAGCATTAGGGGTCAAGTGGAGG
CACTTTACTGGTAGAGACAAAATGAGTGCGTTTATCACAATGATCAGCAAAGTCAAAGGGATTATCAGAG
ATCTTTGCATTTGTTCATAGATTGTGGTGTCCCTCTGGCTGAAATAGACCAGAAGCCTACTGAATCCCTG
CTTGATTTGAATAAGTGGAAAGACTCTGGGTCTGGTAAATCAACATGAGAGAGAATTGTGGCCTCTAAGG
CAATTACATAATGTGAATGAGTTCTCATTCCCAGAACACCTTGAATGAAGTGTAGGTCAAGTCTTCTTGA
GAAAGTACACTGATACGCTGCCGAAACTGACTTATACTACCATAAATCATCCTGCACTTCTGCAAAGTGA
CTTGGCAACCATATTTAATGGAGCTGTGATTAGGTAATTGGAAACAGCCTGAATGTGAGGGATTGATTA
CTGGTCACTAGAGCTGAATTGACATTAACTCTGAGAACCCTAAAATGTCACTGTAGCCCACCAGGTAGCA
GAAGGGCTTATAGAGGATGAATAATTAATGAATGTTTTTGCTTAGGCCCGTTTGTGGTGGTCTGAATGGA
GCCCTGAACTCATCCTCTGATTATTTCCCAAGTTTCAGAATGCAGAATTGCACCAGCTGCATTCAATAGC
TGACAGAATCCTCATACTGAATGTTCCCTGATCCATGGAAAGAGGGCTATTTTGCCAAGGACAAACACTA
TAAATGCTTTGTATGTGCCAAAAAAATGATAACCTGAAAGCAAAACCACATTCATGGAGGAATTGCAGA
GGTTAGTGCCACTAGCAGTATCTTGAAAGTTGCAAGGGTTATGGTTCTATCACATCCTGATTCAACCCTG
GTGATCAATAGGGTGACAGATGTTGCAGCCAGATCACCTTCATGTTCATATGCTGATTGATTCACTCAAT
TGACGTGTGCAGAGATACTTATATCCTAGAGAATTACATGAAATTATTTGAAATTTAATTAGAAATTGAC

FIGURE 491 cont'd

```
TTCATTTGCAGTTCCAGATGTGGTTTTATTTCTACAGCAAATCAACATGTCTGCTGGCACCTGATATAGA
GAGCCACCAAGCCAATATGTGCCTTTTTCTCTATACCTGCCTGTAAATGTCATCCACAGAAGTTTAGTTT
GGTAGGGCCATCAATACACTTTTAAGGTCCCAGCTCAGTTCTGTATCTACTTTCCAGTATTTTTCACAAT
TTACCCAGGGATTGGTAAACTATGTTTCATGGACTAAATCTCCTGCAACTTGTTTTTATAAATTGTCTCA
TTGAAGCATAACCATAACCAGTTTTTACATATTACCCAGGAGTGCTTTTATGCTAAAATGACAGTGTTGA
GTAGTTAGGCCACAGAGATCATGTGATCTGCAATGCCTAAATATTTACTGCCCGGCTCTTTACAGAAAT
AACTTTCTGACCCCTGCTCTACTCTGTAGATACAATGCTGATTGTACTTTCTAAGCAGAAAGAAGCAATT
ACAATAGACATTTTGGTTAGAAGATGGATAATACAAAAATTCAGGAGCTGGCCATGTTCATTAGATTCCT
AGAGGACTGGCCGGGTGCGGTTGCTCATGCCTGTAATCCCAGCACTTTGGGAGGCCGAGGCAGGTGGATC
ACGAGGTCAGGGGTTCAAGACCAGCCTGGCCAGGATGGTGAAACCCTGTCTCTACTAAAAATACAAAAAT
TAGCCGGGTGTGGTGGCGGGCGCCTATAATCCCAGCTGTTCAGGAGGCTGAGGCAGAGAACTGCTTGAAT
CCGGGAGGCGGTGGAGGTTGCAGTGAGCCGAGATTGCGCCACTGCACTCCAGCTTGGGTGACAGAGCGAG
ACTCCATTAAAAAAAAAAAAAGATTTCTAAAGGACCAGTGGTATCGGATATTCCAAGATACCTGTTCCAA
AGTGAAGAGCAAATAGCTGCATATGACCCTTCTAAAACCACCAGGGAAGAGACACAATGACTACTAGGAT
TCTTAGTGAGTTTTGTATGTGTGTGCTTCACTTTAAACATTTATTATGGTACAAAAACACATAACACTAA
ATTTACCATCTTAACCATATTTTATCTTAACATTTTTAAGTGTACAATTCATTAGTGTAAATTGTATTCA
TATTATGCAACAGATCTATAGAACTTTTCATCTCACAGCACTGAAAATCTATACCAGTTAGATACTATTT
CCTCCCCCCTCCTCCCAGCCCTGGTAACTACCTTTCTAAATTTTGTTCCTATAATTTTGACTACTTTAG
ATACTTCATGAGTAGACTCTTACAGTATTTGCCCTTTTGTGATTTGCTTATTTCACTTAGCATAATGTTC
TCGAGGTTGATTAATGTCGTGCCATGTGGCAGGATTTTCTTCTTTTTAAAGGCTGCATAATATTGCATTG
TCTGTGTACAGCACATTTTCTTTATCCATTCTTCTGTCAATGGACAGTTGGATTGCTTCTACATCTTGGC
TATAATGCTGTGATGAATATCTATTCCTTTGAGATCCTGCTTTGAGTTCTTTTGGATATATACCCGGAAG
TGGGATTGCTGGATTATCCAGTAATTCTATTTTAATTTTTGAGGAGCCTCCATATTATTTTCCATAAT
GGCTATACCATTTTACATTTCCACCAACAGTGCACAGGTCTTCCAACGTTACATCCTTGACAACACTTGT
TATTTTTCTCTTCCTTTACCAGTGACCACAATAGTGGGTGTGAGGTGATATCTCATTACAGTTTTGATTT
GCATTTTCTAAAAGATTCATGATATTGAACATCTTTTCATGTACTTATTGACAATTTATGTATCTTCTCT
GGACATGTGTGTTTAAGAACTTTGCCCATTTCTTTCATTGGATTATTTGGGGTTTTTTGTTGTTGTTGT
TATAGAGTTGTAGAAGTTTCTTATATAATCTGGATATTAACCCTTTATCAGATATATAACTTGCAATTTT
CCTCCATTCTGCAGGCTACCTTTTCACTCTGTTGATTGTTTCTTTTGATGCACAGAAGTTTTGAGTTTG
ATATAATCCCATTTGTCTATTTTTCTTTCCATTATCTGTGCTTTTGTTGTGATAGCCAAGAAATAATTGC
CAAATCTAATGTTCTGAAGGTTTTCCTTTATATTTTCTTCTAGGATTTAACAGTTTTAGGTCTTACATT
TAGGCCTTTAATCCATTTTTATTTAATTTTTGTATACAATGTAAGGTAAGGGTCTAACTTTATTCTTTTG
CATATGGATATCCAGTTTTCCCATTACCATTTTTTGAAGAGACTGTCCTTTCCTCATTGTGTAATCTTGG
CACTCTTGTCAAAATCATTTGGTTATATATGCAGGGGTTTATTTCTGGGTTCTGTGTTATATTGGTTATA
TGTCTATATGCCAGTACCACGTCATGTTAATTACTGCTGCTTTTGAAGTATGTTTTGAAATTAGGGAGTG
TGAGGCATCTGAGATTGCATACAAATTTTAGAATTTTTTTTCCTATTTCTGAAAAAAAGTCATTGGGAT
TTTGATAGTGATTGCATTGAATCTGTAAATCACTTTGTGTAGCATGGAAATTTTAACATTATTAAGTCTT
CAAACCCCTGAGTACAGGATGAGTTCCCATTTGTATCTTCTTAGATTTCTTCTTTTATTAATAACA
ATGTTTTGTAGTTTTCAATGTAAAAATATTTCAGTTATTTGATTAAGTTCTTTCCTCAGTATTTTACCCT
TTTTGATGCTATAGTAAATGAAATTTTCTTTTCACGTTGGTGATTGCTAGTATATAGAGATGCAACTGAT
TTTTTAGTGCTAACTTTGTATCTTGCAACTTTGCTGAGTTATTAGTTGTAGCTTTTTGTGTACGTGGGA
TCTTTCTACATATAAGACCAAGTCATCTGCAAATGGAGAAAATTTTAATTCTTCTTTCCAATTTGGATGT
CTTTTTAAAAACTTTCTGATTGACCTGGCTAGAATATCCAGTACTATGTCAAATAGTAGTGGTAAGTTGG
GCATCCTTGCCTTGTTCCTGATCTTAGAGTAAAAGCTTTCAGTATTTCTCCATTGAATATGATATTAACT
GTGGGCTTTTCATATATGGCTGTCATTATATTTAGGTACTTTCCTTTCATTTCTAGTTAAGTGGTTTTTT
TTTTTTAATCATGAAAGGCCCTTTATTTTGTTATGTGGTGTATTACATTGATTGATTTTTATATGTTGAA
TTATACCAGGTATAAATCTTGCCTGATCATGACCTGTGATTCTTTTAGTGTGCTGTTAAATTTAGTTTGC
TAGTGTTTTGTTTAGGATTTTTGCATCAATATTTATCAGAGATATTGGTCTACAGTTTATTTTCTTGTGT
GTCTTTGCTTTTGGTATCAGGTTAATGATGACTTATAGAATGAGTTTGAGAGTGTTCCTTCCTCTTCACT
TCTTTGGAAGAATTTAAGAAGAATTTGTATGTTAATTCTTCTTTAAATATTTGGTAGAATTCTGCAGTGA
ATCCATCAGGTCCTAGAGTTTTCTTTCTTAGGAGGCTTTTGATGACTACGTCCAATGCCTCACTAGTTAT
ACACCTGTTCAGTTGTTTTCTTAAAATTTCTTCATGATTAAGTCTTGATAGGTTGCATATTCCTAGTTTA
TCCATTTCTTCTAGGTTATCCAATCTGTTGGTGTATTCTTCTTCATAGTAATCTCTTATACTTTTTTAT
TTCTGTGACATCAGTCATAATGTCTCCTCTTTCATTTCTAATTTTAAATATTTGAGTCTTCTCTTTTTCT
TAATCTAGCTAAGAAATTAATTTTAATTATTTTACTAATTAATTTGTCAATTGTGTTAATCTTTTCAAA
ACAGACTCTTAATTTTCTTTTTAAAAGTTATTTTCTTCTCTATTTCTACTCTAATCTTTACTATTTT
ATTCCTTCCGCTGACTTTTGGTTTGCTTGTTCTTCTTTTCCTATTTCCTTAAAGTATAAGCTTAGGTTGT
TGATTTGAGATATTTCTTGTTTTTAAAGGTAAGTGTTTACCAATATAAATGTCCCTATTTGGATTGCTTT
CACTGCATCTCATAAGTTTTGAAATGTTGTATCTCTGTTTTTATTTGTCTCCTGATGTTTTCTAAATTCC
TTTATGATTTATTTTTGGCCCATTGGTTGTTTAAGCATGCATTGTTTAATTTCCACATATTTGTGGAAT
TTCTTGTTTTCCTTCTACTATTAATTTGTAGTTTTATTCCAGTATAGTTAGAGAAGATACTTTGTATAAT
```

FIGURE 491 cont'd

```
TTCAGTCTTCCTAAATTTATTAAGACTTGTAATATAGCCTAACATGGTCTATCTTGGAGAATGTTTCATG
CACACTTGAGAAGAATGTGCATTTTACTGTCGTTAGGTGAAGTGTTCTGTATGTATCTGTTAGATCCAGT
TGGTCTTTAGTGTTGTTCAAGTCCTCCGTTTCCTCATTGATCTTCTGTCTAGTTCTATCCATAATTGAAA
GTGGGATATTAAAGTATCCTACTATTATTGTGTTGCTGTTTATTCCCCATTCAGTTCTGTCAATGTTTGT
TTTATATATTTGGGCACTCTAATGTTAGGTGCATATATATTTACGTAGCCCTCTGTATCTGCAGGTTCTG
CATCCACAGATTCAACTAATCTTGGATCAAAAATATTTGAAAAGAATGAACCGTTGCATTTGTACTGAAT
ATGTACCAACTTTTTTGGGTGATTATTCCCTAAACAATACAATATAATGACTATTTGCATGGTATTGACA
TAATATTAGGAATTATAAATAGCCCAGAGATGATTTAAAGTATATGAGAGGATGTGCATAGGTTATATGC
AAATATTGTGCCATTTTATGTAAGGGACTTGAGTATCCATGGATTTTGGTATCCACAGAGTGTCCTGGAA
CTAATCCCCTGTGAATACTGAGGAACAACTGTCATTGTTGTATCTTCCTAGTGAGTTGAACTTTTAATCA
TTATATGATATCCTTCTTTGTCTCTTGTGACAGTTTTTGTCTTAAGTCTATTTTGTCTGATATAAATGTC
AATCTAAATAGAAGAGACAGAGTCTCTCTAAAATAAAATTACATTTATTCAGGAATGAGCATTTCAATGG
GAATACAGTGGGTATATTCAGGGAGGTAAATGAAGACAAGAGTTTTATAAGGAAAAATGAAAAGGGCCAC
ATAAGTTGTTTTGAAACAATTTTTCTTGACCACAGGGTTCAGTAACAACGGTGGTATCAGTCCAAGGTTG
GACAGCCAGTTGCTGGGTAGATGTCTTCATGGAAGTAGTTTTGTTTGTGTAAGGTCATGACATTTGAGCA
ACAATGGAGGTTTGGAGGGAGTGGCTCTTAGGCTAGGTCTACCTGGAGTCCGTTGTTAAGTTCAATTTTG
TTTGTTCTGTAGGTGTGGGCTATTATTTCAAAGCTGTAGGCCAGCATTATTGTGTTAGGAGTTGTACTTC
CACAGAAATTTGACAGGCAACAGGTACAAAGTTTAAAAAGAAAGATACGAAGTAAAATTTATACTAATAT
GATCATCCCAGTTTGCATAATGGTTTCGAGCCATGAACCTGGGCTTAAAGGCAAGCAACTGAATCAATCA
AATGATCATTGGGAATTAGGTGAGACCTAATGTAACTATGTGCGTGTTTTCTTATTTTGTGTATTTGGGT
CTCAACTTCCCCAGAGGAATTTATCCAGGTATGCATGTAGTCCTAGCAATAGCATAGACACTACCTTATT
TAACCAGTAGATAATATAGAAAATTTTGTCATCTGATATCTCATGACTGGGTTGAATTAAAAGCATAGA
GTGAGTGACAGTTGTATTAGGAATATTTTTAAAGTTGGACTAAAGGATTCTTTGGTCATGTAAAGATCTA
CAGTTGGCATAACAGATCTAACATTTTGTCAAGTTGTCCACATAAGCTACTAATTGTAAAATTTTAACTA
CACCATTATCCTGCCCAGTGAAAAAGTTAAGCATAGGCAAGGACAAACTAAGAGGGGCAACAGTCTCATT
ATGATAAAGATTGTTCTGGCATCTTGAGAAAGCTGTCCACAGCATAAAGACATCAACTTCTCATCCTGGT
TTGTAGTTTGAATGTCTCTCGTTATAGCATCGGGTGGTTTGGTGAACTTTCTGCATGACCCACAAATCAG
GCATGAGGCTTGTCTCTTAAAATTTACATCAAGTTTTCTAGCTTCAGCTTACAGGGCTTTAGGAAAGAGT
AGTTCCCATTCTTAGTAATAACATGGGAGAAAATTAGATTAGGGAACCTAGAATAACTTAGGATCCAGTC
TGGTCTACAGTAGATAATAAAAACTCAAAGACAATGCACAGAACTACAATCTAATAACAGATGTATTATA
GTCCTTTTCTAGAAACATAATTTTGTCTCTATATAGTTATCCTAATTTCTACCAAAGATAATTACAGTAA
GACTGATTTGTTTGTAAATAAGTTTAGTTTTATTATTATTTTAGGTTCTTGTATTATTTTATTAGTTTTA
TTATTTTAGTTTTTTAAAGTTTATTTATTACTTAATAATTTACATAAGAGCAGCAAGAGTAGTAAATTGA
GCACAAAAGAATCTCAGATTTTATTTTATTTTATTTTTTTGAGGCGGAGTCTCGCTGTGTCGCCCAGGCT
GGAGTACAGTGGCGCGATCTCGGCTCACTGCAAGCTCCGCCTCCCGGGTTCCTGCCATTCTCCTACCTCA
GCCTCCCGAGTAGCTGGGACTACAGGCGCCCGCCACCACGCCTGGCTAATTTTCTTTGTATTTTTAGTAG
AGATGGGGTTTCACCATGTTGGCCAGGATGGTCTTGATCTCCTGACCTCTTGATCCGCCCGCCTCGGCCT
CCCAAAGTGCTGGGATTACAGGTGTGAGCCACCGTGCCCAAGAATCTCAGATTTTAAACCTCCTTG
AGTCTAGAAAGCCAAACAAAGGCAGACTTCAGACTTTGTTTGCAGTACCAATAAAAATTTAAATATGGCA
TTCCAGTTTTAATTGGTAATACAACCAATGTTTTTAACTGTATCATGTTACAAGGAGGTACAGATTCATA
CTGAATGTATGCAAATAATTATATTGTCATTTAAGAAACACTAGCAAATCACTTCCAAATTTTGAAGGGA
TCAAATAGAAAAAATAAATATTTCCACCTTTGTTCACAGAAGTATATTTTACCAAATTGTTGTAAACTA
TAGATAGCTTAAGAGAAAATGTTTCCTTAAACTTGGAAGACAAAACATTTCAGTAAAAACCAACAATGT
TTAAATTAAAAGTTATAAAAACATTATCAGTTATTCAATTTCATGTAATTAGTTTTTGTTATGCTTGATC
TTGATTAGCAGTTTCACAAATTCATCAGTTTCTTCACTGCAGTTGTGAAAAGTTTTATTTAGTTCATTAA
TCTTGAAGTTATTAGAAACTTGTATTTAAGAGTACTTATTAGAGTCTTTTCCATGAATCTGATTGCAGAT
ACCTTTAGAGAAAATCAAAACTATGGATGTCAAAGACTTAGAATAACCATCATTAAAAATCTGATGGGA
GTTCAGCAGTTGAGAAGGAAATTCAATTATTTCTATTGTATTTAGCATTTTAAGGTAACAACCAGAATCG
TGGTTGATAGCATTACATCAGGACCATCAGACCTTTTTAAATTTCACATAATATTTAATATACATCAATA
ACATATCCATGTAACTTAAAGAAAATATAGCATCACTTTATTATTTGACATTGATTCCCATACAATTAAT
CAAATAAGCCAAATTAGTTTAACATCTCTACAAGATGATACCTCCTTTAAGGTTCTCCAGGGGCCCAACT
GGAAAATCTCTCAGTTAATTATAGGTCAAAAGACTTAATTTAGAACTTTGATCCTGGAGAGACCTGCCA
AAAATGTCAAAATGGTTAAAACATTTAATTAAAACAGAATCACAGATTATTGTGGAATAATAGTCATTCA
CTTAATCAGAGTGAAAAGAGATTCCAAAAGCAAATACAGAACATTACATGGATTAAAAAAAAAAACCTTA
ATTCTTTCAAAGCTCCTAAGTAATGAAAAACCTAATAAAGACAACATGAAGCATGAGAAATTATTTGAT
AAAACAAAAATCTTTGTTTCCTAGGCCAGCTATCAAAAGATAAAAACCTTCTACATATTTAAAAACCCC
TTGTGATTGCTTCTCCCTATGGGAAACCCATTTCAATAACCTGGAAGTTGAGCCTGATGAAAAGGTACTT
GAATTCAACTAAACACTGGAAGAGTGTGTATCCAAGGTTATGAGTGTACCATATTATAGAAAAGATAAAC
AAGAAAACAAGTACCTTGAGCAGGCGGATATGTGGCTCTTAGAAAAAGTAAAAGAATGTGGAATTTATTG
GTTAAACAGCAATTCAGACACATCAAGAAAAGACAAAATTACAGAATCAAATTATACTGGAAGAAAATAT
TATTCCCCTAGATTCTCCTAGGCCTTAAAGACAAACATTTTTAGTGTTAGGCCACAATAGCAGAGTCAGA
```

FIGURE 491 cont'd

```
ACTGGAGAGAGAGCCAGAGAGAGAGCGAGCGAGAGAGCGAGAGAAGCAAGAGGAGTGAGAGGTGAGAGAG
GGAGAGAGTTACAGGAGCTGACTCCAAAGTTGAGGGAGAGGGTTATCATCCCTAAGGAGACAAGGAAGAG
CTGAAGGCAATGATGCATGATTTTAGTCGTTCACTTAATCAGAGTGAAAAAAGCTTCCAAAAACAAATGC
AGAACTTTACGTAGATGTAAAAAAAACAAACCTTAATTCTTTCAAAGCACCTAAGTAATCAAAAACCTAA
TTAAAGACAACATGAAGCATGTTTCTCATCAAATCATGTGCAATGAGATACAGCAAAGTGGAACTGAGAT
ATGAATTTGAAAAGCTTCAAAAGGAAAGTTCTTTTGAGAAACTAAATTACTATTTTAAATGAGGGAGAT
AGTATTTTAAAGCTGGAATAAGGGAAATTAAGTGGAAAGTGTAAAACAGGAAAAAGCTGCAGTTCAGAAG
ACGGCTGAAAATTTAAACGGATTTCAGAATATCAAAACCTCTTGCAGATTTTTTTTAACTAAAATCACAT
AAATACATCAAGAAACCTTGTTGCTTTAAACATAGGTGAATGGATTCTGGTTTTGTATCACTGTATTAA
TACTCAATTTTTGATAAAACCTGTGAATAATTCCCTTTTAACTATAGGCAACTTGATTAAACACAAATTT
TTTCCATAAGATTCATCTTATATAAAAGAAAATTGTCTGACAAATATATCCAGGCAAAATGTATGCTTG
CAATTCTGAAGACCTCACTATTTTAACAACAATTTTAAAATCAGTTTATTTACCAAAGATTTACCTAAGT
CACACAAATTTTTAAAAGTTGGGTTTATTACTATTTTTAGTAAATAGTTTATTTACTATTTTTTCTGATAA
ATTGCTTAATTTTTTTTCTTTACATCAGTTTCATAAAGTTCTTTTATATATTTCTGTAGAAGAATATTAT
GTATGTATAACACAGACCAAGAAACATACAGAAACACAAAAAGATCTTATAGCTTATCACTGTAAAATTG
TAGTCAAGAAACTGTAAAATATACTAATATAAAATCACAAGTGTATAAAAAAAGACAGTTGGATCCAAAT
TATATTTCTGAAAAAATGGGACAAGTTAAGATCAGTTTTTCATATTGCTAATCTTTTTTTTTCTTTTGC
CTTTGATAGGTAATCTTATGAGGGAAGTGGACCAAATTTTGGGTAAAGCTGTTTTATAGCATTTTAGTT
TTTGAAAAATCTTTTACCCTTTTTTCCTCTTCAATTTTAAATGAGTTGTTTTAATTAACTTCTGGATATT
TACATTTCAGTTAGGATTGGCTAGAAAAATAAACTTCCAAGAATCCTTGAACTTATTAACAAATTTAATA
CAAGCAAACAAGTTAGCAGATTCAGAGCGAGCAGAGAAAAAAAGAGAGCTAGCTTAGAAGCCCGTACATG
TTAATCCTACAGTTCCAGTCTCTTAATTCAGCTCTAAGGAAACAAGCTTAGAGAGTTTAAATAATTCCCA
TAATGGCCGTACATTATCCTTAGTGTAATTTGCCAATTATTTTTAAATGTGCATGAGAAAGGACCATAA
ATTTCAAATGTATAGCTGCCTCAAGTGCCAGAGGGCTTGGCATTCTTTAGAAGTTGAAGATCCCATTGCA
TTTCTTATCAATCTCTCAAGAGCAAAGAAAAGCCCAAAAATTTTGTCAAAAGCATTGACCAAGCTGTTTT
GTTTTAACTAGTGTACCTGACACAGAATTCATCTTTTTATACTTGGCAGATGGCCTTTGTCCTAGTTGTC
TAACCTATGACCAAGTTTTCCCTGGTTGTGTAGAAATTTTCTTGAGACTGGCAGGTGCCTCAGTGGTAAT
CTTCCTTGTCTGTGACTATTTTATCCTTACATGGGAGACGTTTTCTTTGGAGACTGGAGTCCGTCATAGA
TGGCAGTGACGTTCCTAGTGGCATTTATTATTATTCTTATTTTGTTGTTACTGTTGTTGTTTAGATACAA
GGTCTCACTCTGTTGCCCAGGCTGGAGTGCAGTGGTACAATCACAGCTCACTACAGCGTTGAACTCCTGG
GCAAAGTGATCCTGTTATCGCAGCCTCCTGAGTAGCTGGGGAGACACGCGTGCATCACCACATCTGGCTA
ATTTCTAAAGAAATATTTTTAGAGACAGGGTCTTGTTATGTTGCCCAGGCTGGTTTGGAAGTCCTGGTTT
CATGTATTTCTCTCATCTCAGCCTCCCAGCTGGCTGGGATTACAGGCACAAGCCACCATGCCTGGTCCTA
GTGGCTTTAATTGTCCACTAAAATCAGTTTATTTACCAAAGATTTACCTAAGTCATGTGAACTTTAAAAA
AATGTGAGTTAACTACTATTTTCTGATAAATTACTTAAGTGCTTAATTTTTTCTTTAAGTCAGTTAAA
TAGAGCTCTTTCATACATTTTGGTAGAAAATATTACATACATATATAGACACAAGAACATACAGACAACA
CAAAAAGATATTTTCCCTTTTCCCTTTAAAATTTTAGTCATGATACATTAAAACAGTAATATACTGTGCC
ATTTAGAATGTTTATTTTTGCTCTTTGAAAGTGTTCAGAAACAAGCAGGGAAAACAAAAGAGCCAAATTA
TTTACAGTTGCATGTAACCAAATTGACATGAAACCAAATGAAGCGTGCTCACAAAAATTTTAAGCCAGGC
TTGCAGAGCAAACAAAATATAAAACCGTGTTTGCAGAAAAACCAAAGCAAATTCAGTAGAAAATACATGC
CTCACAGAACGTAAGTTCTGTGGGAACCAGAGTACTCTCCAAAAGAACACTTGGCCTTATACCAGAAGAG
GCTTTCCAGAAAAGACAAAAGTCTTTTGTAGTCCCACAAGGGTTGCAAGGTCCTTAATTTAAGGTGGCC
TTATAGCCAAATCCAGATCCTGAATAAAGTCAAAGAACTTACCAAACGAAGGACGTCTGAGAATCTAAG
CAGAGATTCACCAGAGCAGAGAAGGAAGGCCATAGAAGCAGAGGCCACAAAAGGGGTCAATGTTGGTACC
TCACTAGATTCCAGGGGATGCTGGCCTGTTGAGGTCAGCTGACTTCTTGACACAAACTTTATGTCAACC
TAAATAGCAGACACAGAGAGAAGATGTCTAAAAGAAAATTGTATTTATTCAGGAATGAGTATTGCAATGG
GAATATAGTGGGTGTATTCAGGGAGGTAAAGAAAGACAAGGCTTTTAAAGAAGTGAGGAGGGTTACATG
AGTTTTTTGAAACAATTATCTTTGGCTACAAGGATCACTAACAAAGGTGGTAGTAGTTCAAGGTTGGACA
GCCAGTTGCTGGGCAGCTGTCTTAACCAAAGTATTTTGTATGTGTAAGGTTGTGGTGGCCTTTGTGCAA
GGTTGTTGTGATTTTTGCAGTCTTTGTGATCGTTCCTCTTATCAGGTATATGTGCATGAGAACCTTCTTT
TCATCACCTTCCCTGGCTCCATTTGTCCTGCTACGGTGACACCAGTCTTTTAGTCCATACATTTGACTTC
ATGAGGAGTTTGCTATAATCAATTGAATGAAGAAGAAACATGTGGACCTGCTTTATAGGTAATTCTGCAT
AATGTTCTAGCATCACCTAAAACCGGACAGCTGGCACACTTACAGCCTCAGGCTGTGGTGGCCCCAAAGG
AGAGTGGTAAAGAAAATATTCCCATTTGTTAGAATTTTGAGTAGTGTACTTCATAGTTTTTTTTTTTCC
CAGAAGGAATGATGCCAGGGGATGAATAGTTTTGCTGGATGGTCATGGACTTCAAAGAAGCATGATTGA
TAATTGGTTGACAAGGCAAATTGACAATGAGGTATGTGAGTGGACTACTTTTAATGAGCAGAATATAAAA
TTACTTGCGGCCTATTTAATTGTCAATAATCAGCAACCTCACCAGAAGATGAGCTTAATAATCAGGTGAT
CAAGATGGTACATTCTGTGAATATTCTTCAAGATTTTTCTCTAGTCAACCATGTCCATTCCCAGTGGGTG
CATGAACAGTGTAGTCATGGTGGAAGAAATGGAGCTTATTAGTTCAGTACTATGAAATTCCATTTACTAA
ATCCAATCTGGCTACAACCACATTTATATGGCCAAGCTATCAAAAGTATGGACTAACACTGGACCTCAGA
TAGGCACTGTTCTTCAAAGGGGACTACCAACCTCCTGCTGGAATTTGATTACACCGGACCACTTTGATCA
```

FIGURE 491 cont'd

```
TGGAGGAGACAGCACTTTGTTTTCAGTGGAAAAGACAATTACTCTAGATATGAATTTGCCTTTCCTATTC
CAATGTTTCTGATAAAAGCATCACATGTGGACTTTACAAAATGTTTTATTTTCTGCCATGGAATTCCACC
CAGCATTTCTTGTGACCAGGGCAGTCATTTTTCAAAAAATGAATTGTATCCATTGGGCTCATGTTGATAG
AATTCACTAAACTTACCATGATTCCTGTTAACAGTTCCATTTCAGTAGTGGGACATGCCTCAATTCTCAG
AAGTCCTACCATCTCTGATTTGTCTTCCCATGTTTGTTTACCTAATTCCTACTTTAAAATGTCCTTGTCC
CTAAAATCCTAGTGATTCTGCTTCTCTGATTGAACCCTGACTGATATTGAACCATTTCTGCTCCTTTTCA
GACACTACCCCTCTCTCTCAACTATAATCACTTTCCTAACTTCTATCACCATTGACTACTTTTCCTTTTA
TCTTTATATATATGAAACCATATTGTATATATCCTTTTGTGTCTCTGTTTTGCCCAACATTATGTTTGTG
AGATTGAACTATGCTGCTGTTTTATAGCAATTGTTTACTTATTTTGTTACTGTAGAGCAAGTGTAGGCAC
ACTACATCCCATGGGTGAAATCTTGTATATATTTCGGGGTGCACATGTGTGTGTGTTTCTGCTTGCTAGA
AGTGGAATTTCTGTGTCATGGAGAATACATAAATTTAACTCTAGCAGATACTGTGAAACATTTTCCAAAG
TGATTGTACCAATTTACACTCTTACAAGGACCGTGGTAGAGTTCCATCTGCTCCACGTGCTTGCCAATGT
TTGGTGTTGTCAGACTTAAATTATTTTTAAATTATTTTTTAAATTCACCATTCTAATTTTTTAAAAGAAG
TAGAGTATAATGCTGGTTACCAGGGGCTGGAGTGGAGGGGTTGGGACATATTGGTCAAAAGATATAACAT
GTCAGTTATACACGAGTAATTTTTAAAAAATCAGTGATTCTGGTATGGCAATAGAGTTGTCTCATTGAGG
GTTTAATTTATACTGCTGTAATGACTAATGAAGTTGAGCAAACAGAGCATGTATCTGAAGCCTTGTACAT
TTGTATATTCTTCATATAGTGCTTACTCAAGTGATTTGTTGATTTGTCTATTTGGTTGTCAGTCTTATTC
TTGTATTTATAGGATTTCTTTATATTCTGCTTACAAGCCTTTTGACATATGTGTGTATTGTGATTATCTT
TTCAACTGTGGCCAGCATTTTCACTTTCCTTATGGTACATTTGATAAACAACCATTCTCATTTTAAGTTT
TTTAATTTTACTTTTCAGTTGGTACTTTAAAAAATCGTTGCCAACATTAGAGAAGGTCACAAAGATATTT
TAGTAGCTATTTAAAAAAATCTTTTAATTTTAAGATCTATATTCCATATCATATTGATATTTACATATGG
GATGTGCTAAAGGTCAAGATTAATTATTTTTCTATGTGAAGAATATACAATATCCTCACTTCTTAAGAGA
TTTCTCCATTTTATTATCTTTGTCAAATATCAAATGACTAGATATATGTAAATCTGTTTCTGAACTTTCT
ATTATCTTCCATTAGTCTATTCATATTTGCATATATAGCACACTTTTAATTACTGCAAATACATAAAATG
TCTTGATGTCTTATCGCATAAACCCACCTCTTTCTATTTTCTTTTGATGTTTTGGTTATTCTTGACTGTT
GCTTTTGTTTACAGATTTTAGACTCAGCTTGCCAGTTTTCACCAAAAAACTGCTGAGAATTTTATTAAAT
ATATAGATTATTCAAAGGAGCACTGATAGCTTTACAACATTGAATTGTCCAGTATCTGAATAGCACCACA
TATTTTAAATTTTCATTGAAGTATAAATATATGTAGAAAAATGTATATGTCATATGTGTCATGATTGTTT
AATTTTCAACACACTCAAAATACCAGCATCTGTATCAAGAAACTGCACATAACCAGCATGTGGTAGCCAT
GAAAATGTATTTCACAAATATTTTAATGCAAGTAACCAAAGACCCCTATTGTTGTGTTTAAGGTCAATC
CTGTGTTTGCATCAAGGCCAGATTTTCTGAAGGCTGCTGCTCCCAGTCAATATCTGAGAGCAGTAAGGAT
TCTAAGGTAGACCTGTTCAGGGAGACATGGATCTTCTCTGTTGGATAGATAAGATTGTGAATACCTGACT
TTAATGGCTTTTTTCTTTAATATAACTTTTCTTTTTTTTGAAATTTAGTCTCGCTCTGTTATACAGG
CTGGAGTGCAGTGGTGCGATCTCGGCTCACTGCAACCTCCACCTCCAGGGTTCAAAGGATTCTCCTGCCT
CAGTCTCCCAAATAGCTGGGATTACAGACATGCCACCACACCCAGCTAATCTTTGTATTTTTAGTAGAGA
CGGTGTTTCACCATGTTGGCCAGGTGGGTCTTGAACTCCTGACCTCAGGTGATCCGCCCGCCTTGGCTTC
CCAAAGTGCTGGGTTACAGGTGTAAGCCACTGCACCTGGCCTAATGTAACTTTTCTTAAGCTGTATGGAA
GTCTAGAATGATTTTATCAAATCTTCCTTTGTTGTTGTTGTTGTTGCTGTTGTTGTTGAGACAGG
GTCTCACTCTGTCACCCAGGCTGAAGTGCAGTGGCACAATCTTGGCTCACTGCAACCTCTGCCTCCCCGG
CTCAAGTGATCCTCCAGCCTCTGCCTCCCAAGTAGCAGGGACTACAGGCACGTGCCACCACACCCAGTTA
GTTTTTGTATTTTTTGTAGAGACAGAGTCTCACTTTGTTCCCTGGGCTGCCTTTTGTTCTTTACTCAGT
GTTAGATTTACATCATGGTGCAGCTTCTCTCCTGTTTTCTCTCACAATCATTTCCCCTAATAAAATTCTT
ACACAACTAATTCTGCCTTTGCATTTTTTTCTTTCTTTCCTTTTTATTTTTCTTATTTATTTATTTTT
TGAGACAGAGTCTCACTCTTGTTGCCCAGGCTGGAGTGCACTGGCGAGATCTTGGCTCACTGCAAACTCC
GTCTCCTGTGTTCAAGTGATTCTCCTGCCTCTGCCTCCTGAGTATCTGGGATTACAGGCATGGGCCACCA
TGCCCGGCTAATTTTGTATTTTTGTAGAGATGGGTTTCTCCATGTTGGTCAGGCTGGTTTCGAACCCCG
AACTCAGGTGATCCTGCCCACCTTGGCCTCCCAAAGTGCTCGGATTACAGGCATGAGCCACTTCGCCTGG
CTGCATTTTTATTTCTAAGAGGACCTGCATTAGCACATCACCCTAAAAACGTTCGTGCCCAATTCAAATT
CCTACTTTTCTCTCAAGGTAGGCACTGTTCTGATTTATAATAGCATAGATTTGCTTTGCTATTTTTATA
CTTCATATAAATAGAAAAAATATGTACAATTTTGTGTTTATTTGTCCACATTATGTCCGTGACATTTAT
CCATGCTGTTGGAAGTGAATATAACTGGTTACTCTCATTAATATGTATTATTTTAATGTATAAATATCA
CATAACTTATTAATTCATTTAATCGTTGATTTTGTGTAGTTTCTTGTCCTTGGTTATTAAAATCAGTGCT
TGTAGGCTGGGTGTGGTGGCTCACACCTGTAATTCCAGAGCTTTGGGAGGCTGAGATGGCGGATCACAA
GTTCAGGAGTTCTGGATCATCCTGGCCAACATGGTGAAACCCTGTCTCTACTAAAAATACAAAAATTAGC
TTGACTTGGTGGCATGTGCCTATAATCCCAGCTACTCAGGAGGCTGAGGCAGGAGAATTGCTTGAACCCG
GGAGACAGAAGTTGCAGGGAGCTGAGATTGCAGCACTGCACTCTAGCCTGGGTGACAGGGCAAGGTTTCA
TCTCAAAAAAAAAACATAAATAAAAAATGAATAAAATTAGTGTTTGTATAAACATAAAAAGACAT
GTCTTTTGCTGAACATATGAATCTCCTTCTATTGATAATATATATATAAGCATGGATCTAAGGGTTATAC
GACAGTTTTAGTAATAGCACTGAAAGTTTTAGTGGTAGCACTAAAACTACTCAGCTTCAGTAATTACTGC
AAAACTTTATTGCAAAGTGGTTGTATAAAACTACATTCCTACACGATGCAAGTATTTGCATTTTTGTCAA
CCTTTCTTTGACTAATTCTTAATTTTAACCTTTATGGTTGGAATGTAGTGGAGTTCTCATAATATTTGA
```

FIGURE 491 cont'd

```
GTTTCTTTGATGACTCAAGAACTTGAGTATCTTTTTATTTGATTATTGAGTATTTATGTCATCTTTTCTG
AACTATCTGTTCAGTTATTTTTACATTTTTCTGATTTGTTTGCCTGACTTTTCTTACAGATTTTAGGATT
TACGTATTCTTATATGCTCAGGATATGAATCTTTTGTCACATATATGGTTTACAAATTTTCTCAATTTGA
GAATTACCTTTTCATTTTCTCATTGGTGCCTTAATTAAGAGAAGTTCTTCATTTTTAAAATAATCTAAGT
CACCTAATTTTTTAAAAATTGTGGATTATTTTGGTCTCATATAATATTTTTTTCCACTTCAGGGCAACAA
ACAGGTTCTTTTGTTTCCCTAAGTGTCATTGCTTTACTTTCCAAAATTAGATCTGCATTTTTTCTGAAAG
TTATATTTGTGAATTCTGTGAAGTACAGACGAATATATATTTTCCCATGTGGATATCTAATTGATGAAGA
AGCACATATTAAAAGAATTTTTATAATCTGTACAGTAGCATATTCTTTTCACAAATGAAATGACAGTAT
TTACTTTGATCTACACTCTATTCTCTTCCTTTATCTATATATCTTTAAGCAAATGCCACACTGATATTGT
AGCTTTATAATATGATTAGATATCTCATAAGTAAGTCTTCCATTTTGTTATTCTTTCACATTATCTTGA
CTATTCTTAGCTCTCAGATTTTACTCCAAATTTTTATAATATTTGTATCAATTTCCAGAAAAAATTCTAG
TATTTTTATTGGGTTTGCATTGATATGATGGATTACTTTGGTGAAGAATATTGAGATGTTTAAAATATTA
AATTGTCTATCCATAAATATTATTTATTATAATTATTTTAAAGGTTTTTTGTATATGCAGGAAAATAAAA
GCAGATCTTTACCTAATAATATTTACATAGATTTCAAAAGGATTAAAGGGCCTAAATGGGAAAGGTAAAT
GTAGAAAGTTAATTTTTTTAATGTAGGAGAATATTCTTGAAACCTAGGACTTTCAAAAGCACAGAAATTA
AGGAAAATGCTTATTAAATTTCTCTCCTCAAAATTAAGGATGCTTATTCAATGTGAGACACAGTATATGA
ATATTAAAATCAAGTACAGGTGCCAAGACAATTCAATGAAAAAGAACAGTCTGTTCAACAAATAGCAAA
TAGTGCTAAGAAAACTGGATGTGCACATGAAAAGAATGAAGTTGGACCCCCTACTTTACATCATATACA
AAAATTAACTTATAGTGGGTAAAAGGCCTAAATGTAACAGCTAAAACTATAAACAACTAGATGAAATCAT
AGATATAAATCTTCATGACCTTGAAATAGGCAATGGTTTCTTAGATATGACATCAAAAGCACAAGGAACA
ACAAAAAATAAATGAATGAATTGGAACTCATCAAAATGAAAAACTTTTGTGTATCAGTGGATACCATCGA
GAAAGTGAAGACACCAACATGGGTGAACGTATTTGTAAATCATATATCTGATGAGACTTGTAGCTAGAAT
ACATAAATAACTCTTACAATTCAACACTTTAGAAAGACAAATAACCCAATTAAACAATGGGCCAAAGTAT
CTGAATAGACATTTTTCAAAAGAAGACATATAAATGCCCAATAGGCACATGAAAAGATGGTCAATGTCAT
AAGTCATTAGGGAAACGGAAATCAAAACAACAATGAGATATTGCTTAGCCACCAGATTGGCTACAGTAAA
AAAGACAGATAATAAAAGGGTTGCCAAGGGAGTGGAGAAATTGGAACCCTCATACATTGTTGGTGGGAAT
GTAAAATGGTGCAATTTATTTGGCAAACAGTCTGGCAGTTTCCCAAGGGTTTAAACATAGAGTTATTATA
TGACTCAGCATTCCACTCCTAGATATACAACCAAGAGAAATTAAAACTTATGCCTACACATAAGCTTGTA
CATAAATGTTCAAAACAACATTATTAATAATAGCCAAAAGTAGAAACAATCCAAAATAGCCATTAATGAA
TAAATAAGATGTGATGTATTCATCCAATGGCACATTATGTAGCCATGAAAAGAAATGAATAACTGGTTCA
TGCACCAACATGGATGACCCTTCAACATGTTATGCTAAGTAAAGTTCGTTTCAAAAGACCACGTATTGTG
TGAGTACACTGACAGAAATGTTCAAAATATGTACATCTACAGAAAGTAGATTAGTGATTGCCTAGGGCT
GAGGAGTTTGGGAAAAATTGGAAGTGACTGTTAATGGGTATCAGGTATCTTTTTGAGATTATGTAAATGT
CCTAAAAATTGATTGCAGTGATAGTTGCACAACTCTCTGGATATAATAAAATTCATTTAACTGTGCTCTT
TAAATGGGTAAACTGTATCCATTATATCTCAATAAAGTTTCTATAAGAAATATCAAAAAATAGCTCTCCC
TCTCCCTCTCCCTCTCCCTCTCCCTCTCTCCCTCTCTTCCCTCCCCCTCTCCCCCTCCCTCTCCCCTCC
CCCTCTCCCCCTCTCCCTCTCCCCTTTGCACGGTCTCCCTCCCATGCCGAGCTGATACGAGGCTGGACTG
TACTGCCGCCATCTCTGCTCACTGCAACTTCCCTGCCTGATTCTCCTGCCTCAGCCTGCCGAGTGCCTGG
GATTGCAGGCGTGCGCCGCCACGCCTGACTGGTTTTTGTATTTTTTGGTGGAGACGGGGTTTCCCCCTGT
TGGCCCCCCTGGTCTCCAGCTCCTGACCACGAGTGATCTGCCAGCCTCGGCCTCCCGAGGTGCTGGGATT
GCAGACGGAGTCTCGCTCACTCAGTGCTCAATGTTGCCCAGGCTGGAGTGCAGTGGCGTGATCTTGGCTC
GCTACAACCTCCACCTCCCAGCCACCTGCCTTGGCCTCCCAAAGTGCCGAGATTGCAGCCTCTGCCTGGC
CGCCACCCCATCTAGGAAGTGAGGAGCGTCTCTGCCTGGCCGCCCATTGTCTGGGATGTGAGGAGCCTCT
CTGCCCGGCTGCCCAGTCTAGGAAGTGAGGAGCGCCTCTTCCCTGCCGTCATCCCGTCTAGGAAGTGAGG
AGTGTCTCTGCCGGGCCGCCCATCATCTGGGGTGTGGGGAGCGCCTCTGCCCCGCCGCCCCGTCTGGGAT
GTGAGGAGCGCCTCTGCCCGGCTGCGACCCCGTCTGGGAACTGAGGAGTGTCTCTGCCCCGCTGCCACCC
TGTCTGGGAGGTGAGGAGCGTCTCTGACCCGCCATCCCGTCTGAGAAGTGAGGAGCCCCTCCGCCCGGCA
GCCGCCCCATCTGGGAAGTGAGGAGCCTCTCCGCCCGGCAGCCGCCCTGTCTGGGAAGTGAGGAGCATCT
CCGCCCGGCAGCCACCCCGTCCGGGAGGTGGGGGCAGCCCCGCCCGGCAGCCACCCTGTCCGGGAGG
TGGGGGGGCGCCTCTGCCCCGCCGCCCCGTCTGGGAAGTGAGGAGCCCCTCTGCCCGGCCGCCACCCCG
TCTGGGAGGTGTACCCAACAGCTCATTGAGAACGGGCCATGATGACGATGGCGGTTTTGTTGAATAGAAA
GGGGGGAAGTGTGGGGAAAAGAAAGAGAGATCGGGTTGTTACTGTGTCTGTGTGGAAAGAAGTAGACATA
GGAGACTCCATTTTGTTCTGTACTAAGAAAAATTCTTCTGCCTTGGGATGCTGTTAATCTATAACCTTGC
CCCCAACCCCCTGCTCTCTGAAACATGTGCTGTGTCCACTAAGGGTTAAATGGATTAAGGGCAGTGCAAG
ATGTGCTTTGTGAAACAGATGCTTGAAGGCAGCATGCTCGTTAAGAGTCATCACCACTCCCTAATCTCAA
GTACCCAGGGACACAAACACTGCGGAAGGCGGCAGGGCCCTCTGCCTAGGAAAAACCAGAGACCTTTGTTC
ACATGTTTATCTGCTGACCTTCCCTCCACTATTGTCCTATGACCCTGCCAAATCCCCTCTCGGAGAAAC
ACCCAAGAATGATCAATAAATACTAAAAAAAAATAAAATAAAAATAAATAAATTAAAAAAATTTAATAA
AAAACAATCAATACATCAAAAAAAGAAATATCAAAAAATACCAAATAGTAGGTATTGCTGTGTCTCAAAT
GCATAAGGTATTAATATTCGTGGTATATAATCCAAGTGAACAAGGAAAATATAGCACCCATAACAGAAGA
AAAGGGCATAAATATACAGTTTACAGAATAGGCTGTAAAGTATTTTGAAGAAATGCTCAAACTTATTAAA
```

FIGURE 491 cont'd

```
AATCAGAGAAATTTGATTAAAACAGTGAAATACCAGTATGTGTTTAATGGAGTGGCAAGACATAGGATGA
TGGTTCATGGCAAATGATGGTATGGAAATGGGTGGTTATACAACAAACTGTATTCAGTGCTCATGAGAAT
GTGGAATGGTTTAACCATTCAGGAGAGCAATATAGCTATTAATATTATTTGTAAATGTGTAAGTATATGA
CTCTGCTATGAACCAACAACTACACTTATGGATATGTGTCCTAAATAAATTGTCACACATTTCTATGAAG
ATGTATAGTGATGTTCCTAGCATTGTTATTGCCAATGGCAATCCAGGTTTCTGTCATGGAATAGTAAAAT
ATTTTGGGTGTAAACAATTAGTTCTATAAAATAGGTTAATGTATGCTAGAAACATGGATGAATCTTTAAA
ACATACTGCTGAGTTTTGAAAGTCTTAACATTTATTTTTATGACATAATACCACTTATATAAACTAAAAG
TGTGCACACACAACCACATCACATGCACTTTGCACAAAACACACACAAAGAGAAACACAACAAACAAAT
ATGGGCTGGGGGAGGAAATGAAAGTGTTCCATAGGGAAAAGAAAGGAATAAATAAATAATAAAATTATT
TTGACCAAGTTGCTAGATATAAGCTTCAGTACAATTTGATTAGAAGTGGTGATATTCAGCATTTTCTTCC
CATTCTCATTCTCAGAGATAAATTTTCAACATTTTGTTAATTGTTGTGTATGTTCATTTTAGTTTTAAGT
GGGAATTTATATTTCTTAAATGTATCATCATAATGTTCCTCATAATATTCTCAATATATTTAGTGATGTT
CCCTTTTACTTCTGAAACTGGTAATATGTCATTTCTGTCTTTTTGTTTACTGTCACTGGACTTTGTCAG
TTTTATTGTTCTATTTATAGAATGATCATTTTACTTTTTAAGATCCACTCCATTTCGTTTTCTATTTCAT
GTATTTCCTATTATCTTGATCATTTCTTTCCATCTACCCACTGTGGTTTTGGTATTTGTTTATTGAATTC
CTGAGATAAATGTTTTTATTTTTTGTTCAGCTTTTCTCCTGTTTTAGGACAGATGCTCCTCAACTTACA
GTGGGCTCACATTCTGATGAACTTACCTACCGTAAGTTGAAAGTATCCTAAGTCGAAATGCATTTAATA
CACCCAATCTACCAAACATCATAGCTTAGGCTAGCCTGCCTTAAAGGTGCTCATGACGTTTATATTAGCC
CCCAGTTGGGCAAGGTTTTTTGTTTTGTTTGTTTTGAGAGGGAGTCTCGCTCTCTCGCCCAGGCTGGAG
TGCAATGGCTCGATCTTGGCTCACTGCAACCGCCGCCTCGCAGGTTCAGGTGATTCTCTTGCCTCAGCCT
CCAGAGTAGCTGGGACTACAGGTGCGCACCACCACGCCCGACTAATTTTCATAGTTTTAGTAGAGACAGG
GTTTTGCCATATTCTCCAGGGTGGTCTCAAACTCCTGACCTCAGGTGATCCAAGGGCAACGTTATCTAGC
AAAAAGAAGCTTATTTCATAATAAAGTGTTGAATATCATATAATTTATTGAATAGGTATTGAAAGGGAAA
AACAGAAGGGTTGTATAGGTACTGTACTGAATGTGTGTTGCTTTCACACCATCATGAAGTCGAAAAATCT
TAAGTGAACCATTGTTAACTCCAGGACCTGTATATGATTTCAAGGCTTTCTATGTTTCCTTCTAATCATG
TATTAAAAGCTCTCTGTTTATCAGTGTTTTCTCCTTATGAGTCTGTCAATCAATTTTCTTTATAAAG
TTTGCTTTACATTATGTAAGGCTGTTATAGTGATAGAAAATTTTCATTACTATGAAGTGTTTCTTTGTA
TATCTTAAAATGTTCTTTTCTTCAAGGACTATTGTACTTTGTCCAATATTAATATATTTTAAAATTAGAG
AAAGAATATGAGGCCTAGGACGATAGTCTCTTTCTCCATTAGAATATTTTTGTTTATGTCAGGTACCTGC
AAACACTAACAGAAAAGGTTTACTTTAATCTATTTTCAGGTACGAATGTGATTTCAAGTTTTGCTTCAGT
CCCCTAGTGAAGATGATCTATTTGCCCTTTATCTTTACTCCTGTAGTGCAGCTCTTTGGGTTTTACTAGG
TACCCTTCTCCCGATCCCCAACTTCTTCCCCAAGGCCCTTGAACAACAGAATCGGTAGGTACCACCAAGA
CAGACACTTCCACTCTAAAATTGCAAATCTTGGCTAAGATTTGCTCTGGCTTTCTAGGATACCCGGAAGC
TCAGGTTACTCGGAAGTATTTCCGCTCCAAGGAGCGGAACTATGGCCGGTTTCCCCTGGGGCATTCTGGG
AAGTGTAGTCAGGGGCCCGCGTAGCCTGGGGCACTTCCGCTTTTGGATGGCGGAGCTAGGGAATTGTGGG
AAGTGATCCGGGGTTTCTCTTTAGTTGCTGGGAAGTTTTTTCGCTCTAGGAGGGCGAAAACAAGTGTTTG
GATCCGCTGGGACCCTCCAAGTTTTCTCAGCCTCGTCAGGGAGCAAGCGGGGCCCTGGCCCTCGTCTGGA
GGAAGGCTAGAGAAGCTGTGGCCAGCTGGGAGGCTGGAGTTGGGAGCAGTTTGTGTTCTTTCCTCTCGGC
TGAGCCTCACGTTTGGAGCAGTTCTTGCGTCCCCGGGTTGGGAGCGTCCTGGATCGGTTGTCGCTTGGTT
AGAGGGTCTCCTGGCGTTCCGCAGCCAGCCTCTCCCACCTACTTGCCAGCTCTGCCACTTACTAGTGTTA
TAACGTTTTGTGAGTTAATCTTAATCTTTCTCTATCCCATTCTCCTCATTCCTGAAGTAGAGTCATTAGT
AGGAGGTCCTTGTACTTTTATACGAATTATTCATTAAATGTCCAAAATACCGTTATGTGGTAGGTACCAC
TTATGTTCTAACAGAGAGACGAAGATAATAGACCTCTCCACACAATGTAGAAAAGAAAGCTGTCTTATTA
CTGAATAAGGACAACCACTGTATAGTATTGTAGGCAATCTAAAGAAAAATATTATTAAAAAATTCCGCCC
TATGTGTACAGTCAAGCAGTTTTAAACTTTTTATACAATTCTACTTTTGACCACTATGTACATCAGTTCT
CAAGATTAATGATTTTTCAATAAGAGGACTTGGTCTCATCATTTACTGCAAATTCTTTTATAAATTTATT
CTAAATTTACTTGAGAATCCAGTGTTAGTTAACTAACTTTATCGAAAGTAATAAAACTTCTCTTACCTCA
TCTGCTAGCCGATTTACAGTTTAAAGAGAGGCACCTTGGTTAAACTCTTGCAGTGATAGGGACAGTGGGT
TGTTATTTTCTCAGATGTTTATATTCAAAAGGGACAAATCTCAGAACTTTCACAAATACTTCTAGGTTGT
AAACCTGGCTAGAGGCTTACATAGCCGCTAATGAAATTTACATGCGTATCAAAAGGTTAGAGAAAGGATT
CAGAAGCACTAGGTTTCTTATGGAAATGCTCTAAGAAAAAGAAGAGGGAAGACGAACCCTAAAACGTACA
GTTAGTAAGAGGCAGAACGTCCATATGAACCCAAGAAGTTGGAGCCTCAAGTCTGTGTTCATATTCTCCA
CGCTGTACATTTTTCTTAGAACCATATGAAATAATCGTGTATATGGTTTGTGGAAGTCTTTTTCTATCAG
GTTTGGAAGGTGATCTGGGCTTTAGAGTCTATATTCTCCTTATAGAAATAATGCATGACCATTATAGAG
AGATTAGAAAATACAGAAATGTATAAAAGGAAATGAAAGTTACCCATATTCACTGCTGTATATTTAAACA
ATTAGCTGGGTGTGGTGGCACATACCGATAGTCCCAGCTACTTGGGAGGCTGAGGTGGGAGGATCGCTTG
AGCTCAGGAGTTTGAAGCTGCAGTGAGCTATGACCACGGCACTGCACTCCAGCTTGGATGACAGCGAGAC
CCCGTTCCTTTAACCCATAATCTCAGGATTTAGAGATAACCACTGCTAACATTTTAAATGCATTTATGCA
TTGGTGCCATACCACCCACATGGTATTTCTCTAATTTTTCTTGTAGAAATTCCCAAACATGCACATACAG
AAAATAGTGTTAATGACCCCCACCCCGCCATCATTTGTCTTTAACTCTTGTAAACATTTTGTCTATCTTA
TTGCATCTATTACTCTTCTCCCACATATGTTTTTGGTGGGAAGAGGAGGAATTTGACTATTTAAAATCAA
```

FIGURE 491 cont'd

```
AACCAAATCCTAGTCAGTCGGTAGAAATTAAAAGTAATTAACATAAAGTAATTATGAATGAAGAGCAAAG
GAAAGCAAATAACTTCAGGGTTTTCTTTCCTGGCAACTAGGAGGAAGGTAGTTATGTGAAAAACCTAAAG
GAGAGGGAATCATTGAGATTTGGAAAGGAATAGTTATGAATTTGGCTTCTTTATTTGGAATGTTTTACTC
AGGGTCTTTTATTTATTTATTTATTTATTCATTTTTATTTATTTATTTTTGAGACGGAGTCTCGCTCTGT
CGCCCAGGCTGGAGTGCAGTGGCGCGATCTCGGCTCACTGCAAGCTCCACCTCCCGGGTTCACGCCATTC
TCCTGCCTCAGCCTCCTGAGTAGCTGGGACTACAGGCGCCCATCACCACACCCGGCTAATTTTTTGTATT
TTTAGTAGAGACGGGGTTTCACCGTGTTAGCCAGGATGGTTTCGATTTCCTGACCTCGTGATCTGCCCAC
CTCGGCCTCCCAAAGTGCTGGGATTACAGGCGTGAGCCACAGAGTCCGGCCTACTCAGGGTCTTTTAGAT
CTGATCTGTTTCTCCCTTAGGCTGCATGTTACTTTGTTGCAGGAACTATGTCCCATTCTTTACCATGTGC
TTAGCACCCAGCACAAGACTGGTAAGGAGGGGTTTAGTGTTTGTGGTTTGTGGAGCTGCCCAGTATCTTG
AAATGGAAACCTGCAGATCATTTAGATTGTATTCAGAATTCCCAAAATGGATTTAGGAAAAAATAAAAGG
AAATAATGTCAATATTAGTGACTCTTTATCTCACTTTTGGTGGGATGCATTTGCATAGTCTTCAGTTTT
TTTCCCAGTAATCAAAAGTTGATGCATGGTTATTGATAATATTTTAGTGATCAAAGCAAATTTTTGTAGA
AACCTTCCATCCATAATTTATGTGTCCTGTGTTTATCCCTGAGGTTAACATTTGCTAACTTTTTATAGG
GTAGTCATGAATCAGGCAGAATTTCCAGTGTTTTACATGTATTTATTCATTTGTACTTGATATCAACCCT
ATTATAGTCTCCATTTTACAAATGAAGAAAAGGGGACAGAAGAAATGGAAGCACTAGTATTTTAATCTA
GATAGCTTTATACTAAGGCTGTAATATTAGCTACTACACACTACTTTTATTAGTCTACAAGGCAAGAACC
CACAGTAAGTCTTATTAGAGCAGGGAATATTTAAGCTATGGATGAAGACCGTCACCCAGGAGGGAAAAGA
GTAGCAGGTTATGACAGAAGGAACACCAAATACAAAGAATTAGAGGCTTTTGTAGGAGTACAAGTAATC
CACTATGGCTGGACATGTAGAGTGGAAAGTGGATTCCAAGAGAGAAACAGCATCTGGAAAATTCCTGTTT
GTGCGACTTGTTAAAGCATTTGAACCTTCTCTTAAGGGCACTGGATAGACATGCAGGTGAAAATAATCAA
ATTTCCATCTTAGGAGATATACTTAACCTCTCTCTGCCTCTGGATCCCAAAGAGTAAACTAGAGGACATT
ATTTGTTTTAAAAAAGTTGTGAAAATGGGCTAAGTGTGGTGGCTCATGCCTGTAATCCTAGCACTTTGGG
AGGCCGGGGCGGGTGGATCACCTGAGGTCAGGAATTCAAGACTAGCCTGGCCAAGATGGCAAAACCCCGT
CTCTACTAAAAATACAAAAATTAGCTGGGCGTGGTGGGAGGGGGTGCCTATAACCCCAGCGACTTGGG
AGGCTGAGGCAGGAGACTTGCTTGAACCTTGTGTGAGGGCGGAGGTTGCAATGAGCCGAGGTCATGCCAC
TTCACTCCAGCCTGGGCAAAAGAGCCAAACTCTGTCTAACAACAACAACAACAACAACAACAACAAAACA
GAACAAAAAAAAAAGAAAAAAAGTTGTGAAAATGTAGTGAGGGTCCCATAGTCTGAATAGTTTGAACTAG
TTCCTGGCACATACTTGGTTCTTTATAAGAGATAGTTGTATATAACAGAATAAAGAATATATATTTAGTA
AATGAGAACTGCAAACATGTACTGTAGTAGATATGTGGATATTTTTAGGTATTGCTCTCTTCTTTCAACC
CTCAATTCTTGGAAACATCAATTCCATTATACATTTAAGCAAATAAAGATCAAGGTTTAAACACTGAAGT
AATAAATTTGTTCATCTTTCAAATTCAGAAACTCCTTGAGGAATGATTACAGAGGCCCTAGTTGCTTTGT
GGAGTTGATCTACCATATGCCAAAGCTTGTGTTTTCTATGTCTAGCTATCCTCAGTAAGCAAGTTGTTCT
GAATTATATGACTGTGCTATTAAGAAAAGTGGAAATCCATAATATATTCTGCCTTCGTTGCATTTTTGA
TTGCTCTTTCATTCTTTTAGTATCTAAAGAGTAGTTTTTCTATTAGTCGATCCTGTTAAATGTAAAAACT
TAAAGGGTTTCCTCTGCCCTTTTTTTTTTTTTTTGGAAGTGGTGGGTATAATTCTATTAGTACAGGAT
CACGTGATCTGTTTCTTATAATAGTTTTTTTTTCTTTTTTTTTTTTTGAGACAGAGTCTCACTCTGTC
GCCCAGGCTGGAGTGCAGTGGCACGATCTTGGCTCACTGCACCCTCCAGGGTTCAAGCGATTCTTATGCC
TCAGCCTCCCAAGTAGCTGGGACTACAGGCGCGCGCCACCACGCCCGGCTAATTTTTATATTTTTAGTAG
AGACGGGGCTTCATCATATTGGCCAAGCTGGTCTGGAACTCCTGACCTCGTGATCCGCCCGCCTCGGCCT
CCCAAAGTGCTGGGAGTCTTTTTTTATTTTAGGGCTCCAATTCTTCACATATTTGCTGTTACTTTTTGTT
AATAAGAAAAACCTAAATTCCACTGACATCAGAGAACTGCTTCAGCCTGGCTAAACAGCAATAAGCCGTG
AAGAGGATTCTGGATGTTGTAGTCCGGGAGCTCCGAGAATTTTGTCACACTCTCCGTAACCCTCTCTCAC
TCGCTCGCTCCGTTTTTTTTTTTGTTTTTTTTTTTTCAAGCGCGAAGAGGGCGGCACCTGGATGGTTTT
TCCTTCTGGAAGTTCTGGGAAACGTATTCCAGAACTCTGTCCGGAAACAATTGGGCCGCAGGAGCGCGGG
CCTTCTGGGAAGGGTAGTTCAGGAGCTCTGGGCAGGCAGAGCCACTTCCGCCCCGGAAAGCGAGGCCGCC
ACCATCTTTTGGGTCCGGGAGGTGAGTCAGCCCTGCACCCCCACGACCCCTCTTGAACCTTTTCAGCCTG
TGCTTGGGAATAGGCGCTCCCCAGCCATCAGTCTTGGGATGGAGAGGTCGCGGCCGCGGCGGAGGCCGAG
AGGCCGAGGCGGGAAGTTTGCTCTCCTCCCGCACTTGGCAAGCAGCGCCGCTAGTTCTGTGGGTATAAT
AAACAGCGAGTTACCTATGATCCGCGCTCCTGTTTCCTCATCTTTAAAATAGCAATAAAGATAGTCGTTA
CTGTGTAGGGTTGTAATTAGAATTAAACAAGATAATACGGGTCAAACCTTAGAACAGTGGTGGCACCTGA
TACTGGGTTGGCTCCTGCTATTGATACAGTGATTCCCTCACAAGCGCCCTTTTTACTGGAAGCTCCAGTG
AAGAGAGAAGAAAAGTCAGGGCTTTATGCCATGGCCTTTCTGTCGTATCCTTCAGGAGACCGAGCTCTTC
CCGAACTTTTACAGATCTTTTTTTTTTTAAGAAGGATTGAGTCATCGGGCTCCAATGCGTGGGATGTT
TACCGCCGTTTATCCGGGATAGAGACTCCATCGTGCTGACAGCATCCTTTTATTCACCGCCTCCGAATTT
GCAAAGAGGAGGAAGGAGGGACTTCTTGGCTTCTCCCAGCATAGCCCCAGGTACCTGCTCTTGAACGCAC
TTTGTTGTTCCATTTTCTGTCCTTTCAGTTAATCAAGTTTCCGTCACTCAGTAAGTTACTACTGAAAAAT
GATGAAATATTTGTTGAATAAATGTGAGAGTGGGTAGGAAAACTACTTGGAAATGAGTATTACCAATAAC
ATCTTACCACTTTGATTTTAAGGCATTCGTCTGTGGACCATAGCTATTGATGAAGTAGGTCTTGTTATTT
TGTTATGAGGAAATTAGGCAGAGTTTATGTTATTAAATACTTTCCCGAAGTTATTCAACTGATAGTAAGA
GGTGGATTTGGGATTGAACCCAAGCATTCCTTTTCAGACTGTGTGATCTTTTTTGTTTGTTTTTGTTTCT
```

FIGURE 491 cont'd

TTGGTTTTTGTTGTTGTTTATTTTCTATTCCTTTTTCTGAGTCTGTGGTCTTAATCTCAATGATACAGTC
GTCTTCAGTTATCTTAAATAGTAATCCATATGGCTACCGGTGAGTCGTTGGAAATCAGCCTTGGGAATGT
AGGTATGGATTTTACTGTGGAAGACCTCAAAAACTGCACTGATGAATTTTGAATTTTTTAGAAAAATCCT
GCAACATCTCACTTACTTAATTTCATTCCATGTCAAAATATGTCATATTCTAGTTATAGAAGTAATGAAT
GCTCATTATAGAGATGCACTATCCAATCCAGTAGCTATAAGCCATGTGTGCCCTAGGAGCACTTGAAATG
TGTCTAGTCCAAATTGAGATGTGCTGTAAGTGTTAAATACACACTGGATTTCAAAAACTTTGTACAAAAA
ATGTAAGATGGCTCATTGATAATTTTTTGTATTATATGTCAAAATGGTAATATTTTGGATACATTGGCTT
AAATTATGTTGTTGAAATTAACTTCACCTATTTTTGTTTTTGTTTTTTTGCCTTTTTTATATGTTACTGC
TAGAAAATTTAAAATTATTTATGTGTCTCAGTATATTTCTATTGGACAGTGATGTTATATTCAGAAAACT
TAAATTACTTATAATAAAACTGCTAACACTTTAATGTGTTTCCCTTTAGTATATGCTATGGATGTTTCTC
AAAATAGGTTTGGTATTCTGTGTAGTAGTTTTTTTCTTATTATGAAAATTTTCTTTTTTCTTTTTTTTTC
TTTTTTTTTGTGAGATGGAGATTCACTCTTGTTGCCCAGGCTGGAGTGCAGTGGCGTGATCTCAGCTCAC
TGCAACCTCCACCTCCCAGGTTCAAGTGATTCTCCTGCATCAAGCTCCCGAGTAACTGGGTTACAGGTGT
GCGCCATCACTCCCAGCTAATTTTGTATTTTAGTAGAGACGGGGTTTCACCGTGTTACCCAGGCTAAT
CTTGAACTCTTGACCTCAGGTAATCCGCCCACCTCGGCCTCCCAAAGTGCTGGGATTACCGGCGTGAGCC
ACTGCGCCCAGCCGAAAAATTTCAAGCATATTCAACTGTCAAAAGAGTGGTGCAGTGAATTCCACGTAAC
CAACACTCAGGTTCAACATTTGCTGCAGACCATCTCCTCCTCCTTCCACCCCACTTTTTTTTTTTTTTT
AAATTAGAGTGTCTTAAAGCAGGAGTCCCAACTTCTGGGCAGCGGACCTGGTACTAGTCTGTGGCCTGTT
AGGAACCTGACAGCACAGAAGGAGGTGATTGGAGGGGTACCGCCTGAGCTCTGCCTCCTGCCAGATCAGC
AGGGGCATTAGATTCTCATAGGAGGGACTGCACATGTGAAGGATCTAGGTTGTGCGCTCCTTATGAGAAT
GTAACTAATGCCTCATGATTTGAGGTGGAACCTATCATCCCCAAACCATCTCCCCGCCCCATCCGGGG
AAAAATTATCTTCCGTGAAACTGGTCCCTGGTGCCAAAAAGGCTGCAGATGGTTGTCTTAAAGCATACGC
CAGACATCAGGTCAGTTTTTTTTTTTTTGAAACGGAGTCTCGCCTGTCGCCCAGACCGGAGTGCAGT
GGCGCCATCTCGGTTCACTGCAGCCTCTGCCTCCCGGGTTCAAGCGATTCTCCTGCCTCAGCCTCCCGAG
TAGCTGAGGTCAGTTTTTTTTTATTTTCTACCATGACCTCTGAAACTGAAGCTGTAATTTGCCATTTGC
TCAGTACAGTATATCTTTTTTTGTTCTTTTTCTTTCAAACTTTTTGTCATTATGTTTCGTAGTGTCT
TTTAGAATATATATGTATAATTTTTTTTTTTAGTGCAGTCTGGGATAATTTGCTTTTACTATCTGTGT
GTATATTTTGTTCTCCTTTCTTGTCTTTTTTGTTCAGTTTATTCCCTTTTATTTGTGCTCAACTGGTCT
GGAGTTTATATGGTTTTGTGTCATTCTTCTAACTTTAAAAATATTCTCTTTCTTAGCAAATACTAAACTT
AATCAGCATGTGTTCTTATTCTGAAGAATATTGAGACTAAAAAAAATCTGAAAGAAGATGGGGCCAGGTG
CGGTGGCTCATGCCTGTAATCCCAGCACTTGGGGAGGCCTAGGCGGGTGGATCACCTGAAGTCAGGAGTT
TGAGACCAGCCTGGCCAGCATGATGAAACCCGTCTGTACTAAAAACACAAAAATTAGCCAGACGTGGTG
GTGCGTACCTGTAATCCCAGCTACTCAGGAGGCTGAGGTGGGAGAATCGCTTGAACCTGGGAGGCAGAGG
TTGCAGTGAGCTGAGATTGTGCCATTGCACTCCAGCCTGGGTGACAAGAGCGAAACTCTCTCTCTAAAAA
AAAAAAAAAAAAAAAGATGTACCTTTAAAAAAAAAAAAAAAAAGCTATGTTTTATAGGTCTACTTTT
TATTATAACCACCCTCAAAATTTGTCATTATAGTTCTTTGGCTTTTTTTAAACAAAGATTATTATATTAC
CAATATAGTCACAAATGTTTTCTTACCATTGCTTTTTGCAGTCCATCTTTTAGGGTTCACATGGTTATAA
ATTCTCTTCATTTTTTTTTTCAGCTAAAATATTGTTTCTTTCTCATGTAAATAATCATCTAGTTGAACAT
AGAATTCAGGTTGACAGTTTCTTTATTTTGGAGGTAATATTCATTTGTTTTAAATCTCCATTCTGTTACC
CTATTTCTGTCAATCTAATTGTTATTTCTTTTAGGTCAACTATATTTTCTTTCTAGGAGCTTTAAGGTTG
TTGTTTCCAGTTCTTTATGTTCGTTTAGTCTTTTGCATTTCTGAGTTTTATTGTGATTTGTTTAGGGTAT
GTTTATTTTTATTTATACTGTTTAGAATTTCTATATGCGAACTTGTATCTTTTACCAATTGTGTGAAATT
CTCAGCAATTGCATCTTGAAATTAAAACCTCTCAGTCATTCCCTCCATCCTGCCTTCTCTTCTCCCATTC
CTGTTAGACAAATACGGAAGCCTCTCAATTTATCTTTCATGTTTCTTGATTTTTCGTTTGTGCTTTATCT
TTCTCTTTGCTGTGTGTTTTTCTCTGTGCACATAAAATAAAAGAGATGTACCAATGATCGTTTCCAGGCT
TCATGAAGTAAATTGACCCAGAATGATACGTTTAGAAAACTGATAACAGTGTCAGTAAAATATTACTAG
CTGGGCAACAAATTACTAAAAAGAAACCTTAAGTCAGATTTCGGCTTTTCAGAAATTAAAGGTGACTTTC
ATAGGAGAGCAATATTTGCAAGGCAAGTGTGTGATGCAAAGTATCATCTGCTTGTTTTTTTTTTTTTTT
TTTTTTGAGACAGAGTCTCACTGTGTCATCCAGGTTGGAGTTCATTGGCGTGATCTTGGCTCACTATAAC
CTCCACCTTCCAGGTTCTAGCAATTCTCATGCCTCAGCCTCCCAAGTAGCTGGGATTACAGACCCGCACC
ACCACGCCTGGCTGATTTTTTTATTTTGGTAGAGATGAGGTTTTGCCGTGTTGGCCAGGCTGGTCTCA
AACTTCTGACCTTATGTGATCCTCCCTCCTTGGCCTCCTAAAGTGCTGGGATTACAAGCATGAGCCACTG
TGCCAGGCCTGGCTAAACAGCAAGAAGCCATGAAGAAGCTTTTTGTAACTATAAGAGAAAGGGACTCCT
GGTTCTTAGAACTCTCCATCTACTTATTTAATCCTTGGAAAAACCCTATGAGGGAGGTACGATTTATGAT
TCTTACCATATCCTCATTGTACACATAACAGAAGTGAGGCACAGAGAGGGTTTTAATATCCCCAAGGTT
ACACAGCTGGTAAGTATCATTTCTAGGAATTAAACCCAGATACTTGACTTGAGAGCCCTCATATGTTGTT
ACATTGCCTCTCGTTTCCTGCTGTCTCTGCCATCAGAAATCCTTGTAGCAAGGATGCTGCACTTGTGCAG
ACTGTTCACTGCCCAATGGCACTGAACTATCATGCCATTTAGTAGCTGGAATACAGTCCATGTTCTGCTT
ACCAAGCTGTATGTGGCTATACCTGTCTGAATGTAGGGCTATTTCTCTAATTTCCTCATATGTACACATG
GGCTAACAGCAGGCTTGTGTCTCATGGCGTCTTTGGTCTCCCCCAGTTATGCCATCTCAGAACTATGACC
TTCCCCAGAAGAAGCAGGAGAAAATGACCAAGTTTCAGGTACGTAAAGGATTCCTTGCTGTCTTTTAAAA

FIGURE 491 cont'd

```
TGTGATTTATTTCTCAAAGATAACAGATTTATTTTTTCTCTTTCTTGGAAAGGTTAGTGGGAAACAGATA
TTCAGGACATGTGGTATGCTGACATGTATGTGTTTTTTGTTTTAGTTTATCACCTTTACTATTTTACAA
AACAGTGTTTGAAAAAATAATAGAAGCTTTAATCAGAAATAATCTATGCTACTACCCTGCTTATGAACTA
GCTTTTTTCATTTTCCCATGTTCCTTTTTCATACACATTTTGCAATACTTGAGTAGATGAAATTTTCAAT
TGTGCATTCTCCACTTAATTGCATCACCTGCATTGTAAGTGAGTACATCATATGCCATTGAATTGCAGTG
CCCTTAAAAGACAACAAAAACTATTTCTTATTTAGCCTTTCAGAAATTCAGAAATTTTAAGAATTTTACT
ACTTTAAAGTAAATCCAGTGACTTTTTTCCCTACATATAAAAACAATTCCTTCAAAAGAAATTCTGGTGG
AATTCAATATTATTTGTCCTTAAAGTTTTAGGAACTCTGCATTGAAGAGGTTTATGTCTCAGTTTCATGT
CAGTTCCCTCAGGTGTTTTGTAAACAGAACATCTAAAGAATGACATGGTGTAATTTTATTAGATGCTTTC
AGAGAAGAAGAGCTATATATTTTTCCCGTTTATGTTTTTATCACTCATTTATTTCTTGTATGAATTTATT
TCATCAAAGTAACTACATGTACGTAAGGTCTAGTAGTACTTAGATGTCTTGCTAGCCCTTTCCATCTGTC
ATTGCATTTTTCAGATGTGAGGATGGAGATGATTTATTTGCATTTTAAATATGAAGAAACAGGTTATGGG
AACATTTTATAACTGCCCCAAATTTCCCAGGTAGCTGACTCATTGGACACTGAAGCTTCCAACTATTAGG
AATATCTGGCATTCTATTTTCATGTAAAGGCAGACAGAACAAAAGAGTTTTCCATTCACAGAGATGAGCA
CATATGATAGAAGTACCTGATGTTACCTTTTTATTCTTTTGAGACAGAGTTTAATTCTTGTCACCCAGGC
CGGAGTGCAATGGCATGTTCTTAGCTCACTGCAACCTCTGCCTCCCAGGTTCAAGCGATTCTCCTGCCTC
AGCCTCCCAAGTAGCTGGGATTACAGGCATGTACCAGCACGCCTGGCTAATTTTGTATTTTATTAGAGA
CGGGGTTTCACCACGTTGGCCAGGCTGGTCTTCAACTCCTGACCTCAGATGATCCACCCACTTCGGCCTC
CCAAAGTGCTGGGATTATAGGCGTGAACCAGTGCACCTGGCCCTGATATTACCTTTTGGAGGATAGACCC
CAACAATGCCCCTCATCCAGTTTCCATCTCAATTACTGTCTCTTCTCTAGTTTTGTCTCTTAGTCATTCC
ATGAACGTAGATGCTCAAGCACAGTTTTTATGTAAGTGTTTTAAATTTCCCTACAGCAAAAGCTATCAGG
TATGATGGTAAGAGACAGCAGCAAACCGGTGGCATATACTTAAACATTAGGTAAAGGTCTAATAGCTTAA
ATTCCTGTTAAGATTAGTAATATAGAGAAAATTCCAACTGGAATATGAGCAAAAGAAATGAATAGGAGTG
TCATAAAGAAAAGAAATTTATGAAAAAAACTTCACTAATAATTTAAATGTGTGAAAATGTTAATAAAATA
GCTTTCTATTTATATATTGGTTTTACTTATATTGTCAATGACTTTTTTAGAAAAAGGAACTGAGTCCTAT
TTAGCCGGGGTCTAGAGATTCAGGAATGCTTGTACTGTTGCATGAAGAGTGAACTGGGAAATCTTTGA
GAGGAAAATCTGCCATTACGCTTTCAAAACTTTTTTTTTGGATGTTGATTTTCTTTTATTTATTTATT
ATTTATTTATTTATTATTATTATACTTTAAGTTTTAGGGTACATGTGCACAATGTGCAGGTTTGTTACAT
ATGTATACATGTGCCATGTTGGTGTGCTGCACCCATTAACTCGTCATTTAGCATTAGGTATATCTCCTAA
TGCTATCCCTCCCCACTCCCCCCACCCCACAACAGTCCCTGGAGTGTGATGTTCCCCTTCCTGTGTCCAT
GTGTTCTCATTGTTCAATTCCCACCTATGAGTGAGAACATGCAGCGTTTGGTTTTTTGTCCTTGCGATAG
TTTGCTGAGAATGATGGTTTCCAGTTTCATCCATGTCCCTACAAAGGACATGAACTCATCCTTTTTATG
GCTGCATAGTATTCCATGGTGTATATGTGCCACATTTTCTTAATCCATCTATCGTTGTTGGACATTTGGG
TTGGTTCCAAGTCTTTGCTATTGTGAATAGTGCCAGAATTAACATATGTGTGCATGTGTCTTTATAGCAG
CATGATTTATAATCCTTTGGGTATATACCCAGTAATGGGATGGCTGGGTCAAATGGTATTTCTAGTTCTA
GATCCCTGAGGAATTGCCACACTGACTTCCACAATGGTTGAACTAGTTTACAGTCCCACCAACAGTGTAA
AAGTGTTGCTATTTCTCCACATCCTCTCCAGCACCTGTTGTTTCCTTTTTTTTTTAACTTTAAAAAAAT
GTTAATAGAAAAAAAATGCCCAGATAAAGATACCGATCACAGTATCCACATCTATACAATGATTGATCCA
GCTGTGGCCCTCCCCTCTCACCCAGCCCCATGTGGCTTCCTTTGAAACTGCAGACTGGAGATGACAGTGG
TGAATTCTAGTCCTACTCACTGGATATCAGCATTTCTTTTTTTAAAATTTTATTATTATTAAACTAAGT
TTTAGGGTACATGTGCACAATGTGCAGGTTAGTTACATATGTATACATGTGCCATGCTGGTGTGCTGCAC
CCATTAACTCGTCATTTAGCATTAGGTATATCTGCTAATGCTATCCCTCCCGCCTCCCCAACCCCACAA
CAGTCCCCAGAGTGTGATGTTCCCCTTCCTGTGTCCATGTGTTCTCATTGTTCAGTTCCCACCTATGAGT
GAGAACATGTGGTGTTTGGTTTTTCGTCCTTGCGATAGTACTGAGAATGATGATTTCCAATTTCATCCAT
ATACCTACAAAGGACATAAAATCATCCTTTTTATGGCTGCATAGTATTCCATGGTGTATATGTGCCACA
TTTTCTTAATCCAGTCTATCATTGTTGGACATTTGGGTTGGTTCCAAGTCTTTGCTATTGTAATAGTGC
TGCAATAAACATACGTGTGCATGTGTCTTTATAGCAGCATGATTTATAATCCGTTGGGTATACACCCAGT
AGCCATAAAAATGATGAGTTCATGTCCTTTGTAGGGACATGAACATACATGTGCATGTGTCTTCATAGC
AGCATGATTTATAGTCCTTTGGGTATATACCCAGTAATGGGATGGCTGGGTCAAATGGTATTTCTAGTTC
TAGATCCCTGAGGAATCGCCACACTGACTTCCACAATGGTTGAACTAGTTTACAGTCGCACCAGCAGTGT
AAAAGTGTTCCTGTTTCTCCACATCCTCTCCAGCACCTGTTGTTTCCTGACTTTTTAATGGTTGCCATTC
TAACTGGTGTGAGATGGTATCTCATTGTGGTTTTGATTTGCATTTCCCTGATGGCCAGTGATGGTGAGCA
TTTTTTCATGTGGTTTTTGGCTGCATAAATGTTTTCTTTTGAGAAGTGTCTGTTCATGTCCTTCGCCCAC
TTTTTGATGGGGTTGTTTGCTTTTTTTCTTGTAAATTTGTTTGAGTTCATTGTAGATTCTGGATATTAGCC
CTTTGTCAGATGAGTAGGTTGCAAAAATTTTCTCCCATTTTGTAGGTTGCCTGTCCACTCTGATGGTAGT
TTCTTTTGCTGTGCAGAAGCTCTTTAGTTTAATTAGATCCCATTTGTCAATTTTGGCTTTTGTTGCCATT
GCTTTTAGTGTTTTAGACATGAAGTCCTTGCCCATGCCTATGTCCTGAATGGTAATGCCTAGGTTTTCTT
CTAGGGTTTTTATGGTTTTAGGTCTAATGTTTAAGTCTTTAATCCATCTTGAATTAATTTTTGTATAAAG
TGTAAGGAAGGGATCCAGTTTCAGCTTTCTACATATGGCTAACCAGTTTTCCCAGCATCATTTATTAAAT
AGGGAATCCTTTCCCCATTGCTTGTTTTTCTCAGGTTTGTCAAAGATCAGATAGTTGTAGATCTGTGGCG
TTATTTCTGAGGGCTCTGTTCTGTTCCATTGATCTATATCTCTGTTTTGGTACCAGTACCATGCTGTTTT
```

FIGURE 491 cont'd

```
GGTTACTGTAGCCTTGTAGTATAGTTTGAAGTCAGGTAGCATGATGCCTCCAGCTTTGTTCTTTTGGCCT
AGGATTGACTTGGCGATGTGGGCTCTTTTTTGGTTCCATATGAACTTTACAGTAGTTTTTTCCTATTCTG
TGAAGAAAGTCATTGGTAGCTTGATGGGGATGGCATTGAATCTATAAATTACCTTGGGCAGTATGGACAT
TTTCACGATATTGATTCTTCCTACCCATGAGCATGGAATGTTCTTCCATTTGTTTGTATCCTCTTTTATT
TCATCGAGCAGTGGTTTGTAGTTCTCCTTGAAGAGGTCCTTCACATCCCTTGTAAGTTGGATTCCTAGGT
ATTTTATTCTCTTTGAAGCAATTGTGAATGGGAGTTCACTCATGATTTGGCTCTCTGTTTGTCTGTTATT
GGTGTATAAGAATGCTTGTGATTTTTGTACATTGACTTTGTATCCTGAGACTTTGCTGAAGTTGCTTATC
AGCTTAAGGAGATTTTGGGCTGAGACAATGGGGTTTTCTAGATATACAATCATGTCATCTGCAAACAGGG
ACAATTTGACTTCCTCTTTTCCTAATTGAATACCCTTTATTTCCTTCTCCTGCCTGATTGCCCTGGCCAG
AACTTCCAACACTATGTTGAATAGGAGTGGTGGTGAGAGAGGGCACCCCTGTCTTGTGCCAGTTTTCAAAGGG
AATGCTTCCAGTTTTTGCCCATTCAGTATGATATTGGCTGTGGGTTTGTCATAGATAGCTCTTATTATTT
TGAGATATGTCCCATCAATACCTAATTTATTGAGAGTTTTTAGCATGAAGGGTTGTTGAATTTTGTCAAA
GGCCTTTTCTGCATCTATTGAGATAATCATGTGGTTTTTGTCTTTGGGTTTCTTTATATGCTGTATTACA
TTTATTGATTTGCGTATGTTGAACCAGCCTTGCATCCAGGGATGAAGCCCACTTGATCATGGTGGATAA
GCTTTTTGATGTGCTGCTGGATTTGGTTTGCCAGTATTTTATTGAGGATTTTTACATCAATGTTCATCAA
GGATATTGGTCTAAAATTCTCTTTTTTGGTTGTGTCTCTGCCTGGCTTTGGTATCAGGATGATGCTAGCC
TCATAAAATGAGTTAGGGAGGATTCCCTCTTTTTCTATTGATTGGAATAGTTTCAGAAGGAATGGTACCA
GCTCCTCCTTGTACCTCTGGTAGAATTCTGCTGTGAATCCATCTGGTCCTGGACTCTTTTTGGTTGGTAA
GCTATTGATTATTGCCACAATTTCAGAGCCTGTTATTGGTCTATTCAGAGATTCAACTTCTTCCTGGTTT
AGTCTTGGGAGGGTGTATGTGTTGAGGAATTTATCCATTTCTTCTAGATTTTCTAATTTATTTGCGTAGA
GGTGTTTGTAGTATTCTCTGATGGTAGTTTGTATTTCTGTGGGATCAGTGGTGATATCCCATTTATCATT
TTTTATTGGGTCTATTTGATTCTTCTCTCTTTTTTTCTTTATTAGTCTTGCTAGCGGTCTATCAATTTTG
TTGATCTTTTCAAAAAACCAGCTCCTGGATTCATTAATTTTTTGAAGGGTTTTTTGTGTCTCTATTTCCT
TCAGTTCTGCTCTGATTTTAGTTATTTCTTGCCTTCTGCTAGCTTTTGAATGTGTTAGCTCTTGCTTTTC
TAGTTCTTTTAATTGTGATGTTAGGGTGTCAGTTTTGGATCTTTCCTGCTTTCTCTTGTGGGCATTTAGT
GCTATAAATTTCCCTCTACACACTGCTTTGAATGCGTCCCAGAGATTCTGGTATGTTGTTCTTTGAAACC
AATGAGAACAAAGACACATCTTTATTTCTGCCTTCATTTTGTTATATACCCAGTAGTCATTCAGGAGCAG
GTTGTTCAGTTTCCATGTAGTTGAGCAGTTTTGAGTGAGTTTCTTAATCCTGAGTTCTAGTTTGATTACA
CTGTGGTCTGAGAGACAGACAGTTTGTTATAATTTCTGTTCTTTTACATTTGCTGAGGAGAGCTTTACTT
CCAACTATGTGGTCAATTTTGGAATAGTTGTGGTGTGGTGCTGAAAAAAATGTATATTCTGTTGATTTGG
GGTGGAGAGTTCTGTAGATGTCTATTAGGTCCACTTGGTGCAGAGCTGAGTTCAATTCCTGGGTATCCTT
GTTAACTTTCTGTCTCGTTGATCTGTCTGATGCTGACAGTGGGGTGTTAAAGTCCCCCATTATTATTGTG
TGGGTGTCTAAGTCTCTTTGTAGGTCACTCAGGACTTGCTTTATCAATCTGGGTGCTCCTGTATTAGGTG
CATATATATTTAGGATAGTTAGCTCTTGTTGAATTGATCCCTTTACCATTATGTAATGGCCTTCTTTGTC
TCTTTTGATCTTTGTTGGTTTAAAGTCTGTTTTATCAGAGACAAGGATTGCAACCCCTGCCTTTTTTTG
TTTTCCATTTGCTTGGTAGATCTTCCTCCATCCTTTTATTTTGAGCCTATGTGTGTCTCTGCACGTGAGA
TGGGTTTCCTGAATACAGCACACTGATGGGTCTTGACTCTTTATCCAATTTGCCAGTCTATGTCTTTTAA
TTGGTGCATTTAGCCCATTTACATTTAAAGTTAATATTGTTATGTGTGAATTTTGTCCTGTCATTTTGAT
GTTAGCTGGTTATTTTGCTCGTTAGTTGATGCAGTTTCTTCCTAGCCTTGATGGTCTTTACATTTTGGCA
TGATTTTGCAGTGGCTGGTACTGGTTGTTCCTTTCCATGTTTAGTGCTTCCTTCAGGAGGTCTTTTAGGG
CAGGCCTGGTGGTGACAAAATCTCTCAGCATTTGCTTGTCTGTAAAGTATTTTATTTCTCCTTCACTTAT
GAAGCTTAGTTTGGCTGGATATGAAATTCTGGGTTGAAAATTCTTTTCTTTAAGAATGTTGAATATTGGC
CCCCACTCTCTTCTGGCTTGTAGAGTTTCTGCCGAGAGATCCGCTGTTAGTCTGATGGCTTCCCTTTGT
GGGTAACCTGACCTTTCTCTCTGGCTGCCCTTAACATTTTTTCCTTCATTTCAACTTTGGTGAATCTGAC
AATTATGTGTCTTGGAGTTGCTCTTCTCGAGGAGTATCTTTGTGGCGTTCTGTATTTCCTGAATCTGA
ATGTTGGCCTGCCTTGCTAGATTGGGGAAGTTCTCTTGGATAATATCCTGCAGAGTGTTTCCAACTTGGT
TCCATTCTCCCCGTCACTTTCAGGTACACCAATCAGACGTAGATCTGGTCTTTTCACATAGTCCCATATT
TCTTGGAGGCTTTGTTCGTTTCTTTTTATTCTTTTTCTCTGAACTTCCGTTCTCGCTTCATTTCATTCA
TTTCATCTTCCATCACTGATACCCTTTCTTCCAGTTGATCGCATCGGCTCCTGAGGCTTCTGCATTCTTC
ATGTAGTTCTCGAGCCTTGCTTTCAGCTCCATCAGCTCCTTTAAGCACTTCTCTGTATTGGTTATTCTA
GTTATACATTTGTCTAAATTTTTTCAAAGTTTTAACTTCTTTGCCATTTGTTTGAATTTCCTCCTGAA
GCTCGGAGTAGTTTGATCGTCTGAAGCCTTCTCTCAACTCGTCAAAGTCATTCTCCATCCAGCTTTGTTC
CATTGCTGGTGAGGAGCTGCATTCCTTTGGAGGAGGAGAGGCGCTCTGCTTTTAGAGTTTCCAGTTTTT
CTGCTCTGTTTTTCCCCATCTTTATGGTTTTATCTAGTTTTGGTCTTTGATGCTGGTGATGTACAGATG
GGTTTTTGGTGTGGATGTCCTTTCTGTTTGTTAGTGTTCCTTCTAACAGACAGGACCCTCAGCTGCAGGT
CTGTTGGAGTTTGCTAGAGGTCCACTCCAGACCCTTTTGCCTGGGTATCAGCAGCGGTGGCTGCAGAAC
AGCGGTGGCTGTAGAACAGCAGATATTGGTGATCTGCAAATGCTGCTGCCTGATTGTTCCTCTGGAAGTT
TTGTCTCAGAGGAGTACTCAGCTGTGTGAGGTGTCAGTCTGCCCCTACTGGGGGGGTGTCTCCCAGTTAG
GCTGCTTGGAGGTCAAGGACCCACTTCAGGAGGCAGTCTGCCGGATCTCAGATCTCCAGCTGCATGCTGG
GAGAACCACTACTCTGTTCAAAGCTGTCAGACAGGGACATTTAAGTCTGCAGAGGTTATTGCTGTCTTTT
TGTTTGTGCCCTGCCCCTAGAGGTGGAGCCTACAGAGGCAGGCAGGCCTCCTTGAGCTGTGGTGGGCTCC
```

FIGURE 491 cont'd

```
ACCCAGTTCGAGCTTCCAGGCTGCTTTGTTTACCTAATCAAGCCTGGGCAATGGCAGGCGCCCTCCCCCA
GCCTCGCTGCCTCCTTGCAGTTTGATCTCAGACTGCTGTGCTAGCAATCAGCGAGACTCTGTGGGCGTAG
GACCCTCCGAGCCATGTGCAGGATATAATCTCCTGGTGTGCCGTTTTTTAAGTCCATTGGAAAAGCGCAG
TATTAGGGTGGGAGTGACCTGATTTTCCAGGTGCCGTCTGTCACCCCTTTCTTTGACTAGGAAAGGGAAC
TCCTTGACCCCTTGTGCTTCCCAAGTGAGGCAATGCCTCACCCTGCTTTGGCTCACACCCAGTGTGCTGC
ACCCACTGCCCTGCGCCCACTGTCTGGCACTCCCTAGTGAGATGAACCCAGTACCTCAGATGGAAATGCA
GAAATCACCCGTCTTCTGCATTGCTCATGCTGGGAGCTGTAGACCGGAGCTGTTCCTATTCAGCCATCTT
GGCTCCACCCCTCAAAACTTTTAAAGTAAATATTCTATGACTTTGCAGTTGCTACTTCTTGGCCATGAGC
TCTGTAAAGGATCTTTGTAGTATTGGTTATAAGTAAAAATCTGTAATTAATTGTACATTATTTGGATTG
GTTAGAGATAAATCTTCAGTTCCAAGGAATCCTGTTGTATGTAGTCACAAAATAGGACAAAAGAGATGAT
AAAGATATGCGTTGTTCGAGTTTATTGAGCATGTATGGTGTGCTAGGCACTTCTAAGTGCTTGACATATA
TTCATTCATCTGATCCTTTCAAACACTTTATGATCTATTTATTTTAATTCTAAAAATTTATTTATTTTAA
GACAGTGTCTCACCCCTGTCACCCAGGCTGGAGTGCAGTGGCGCCATCTTGGCTCACTGCAACCTCCGCT
TCCCAGGTTCAAGTGATTCTCCTGCCTCAGCCTCCTGAGTAGCTGGGATTACAGACGCACATCACCACGC
CTGGCTAATTTTTTTGTATTTTTAGTAGAGACGGGGTTTCAGCATCTTAGCCAGGCTGGTCTCAAACTCC
TGGCCTCAAGTGATTTGCCCGCCTCGGCCTCCCAAAGTGCTGGCATTACAGGTGTGAGCCCTGTGCCTA
GCCTGAAAATTTATTTTAAAAATTGAGACAGGGTCTCACTCTGTTGCCCAGGCTGAAGTGCAGTGGCAC
AATCATGGCTCACTGCACCGTCAAACTCCTGGGCTGAAGTGATCCTTCTGTGTCAGGCTCATACACCTTA
TAATTTAGATACAATGATAAAGAAGAGGAAATTCAGTTAGTGAGAGATTAAGGAATTTGCCCAAGGTCCT
ATAACTAGTAAAAGGCAAAACCTTGAAATTTGAACCTGGCCAGACTCCAGAGCCAGTGCTTTAAATTAAG
CAGCTGTGCATCCTGTAGTAGGTGGATGTGACATGTGCCTTGAAAGCACAGGAAGAGCTATATACCTGTC
CAGGGGGTTGCTGAAGGCCTGTGAACTTTGCAAACGTTAAAAACAATGATAGGGCCAGGCTCAGTGGCTC
ACACCTATAATCACAGCACTTTGGGAGGCCAAGGCGGGCAGATCATTGGAGGTCAGGAGTTTGAGACCAG
CCTGGCCAACATGGTGAAACCCCGTCTCTACTAAATAAATACAAAAATTAGCCGGGCATGGTAGTAGACG
CCTGTAATCCCACCTACTTGGGAGGCTAAGGCAGGAGAATCTCTTGAACCCGGGAGGCGGAGGTTGCAGT
GAGCAGAGATTGCGCCACTGCTCCAGCACGGGTGACAGAGTGAGACTCCATCTCAAAAAAGAAAAAAACA
AAAACAGTGATAAACTACAGGCTTTATGGGGATGAGCGTAGGAGATAGTGAGACAGGGAAAACTGTAAC
AGCTGAAAATTGACTGAGATCTCTTGGAATCTATAACAACTTTTTTGTGGTGCTCTTTTCCTTCTTGATG
CCACCCTTCTTCTAGTGAAGGTTGGTTGTAAGATTGAGGTTACATGTGTTTGATATTGTAGGAGGCTGTG
ACATTCAAGGATGTGGCTGTGGTCTTCTCCAGGGAGGAACTGCGACTGCTCGATCTTACCCAGAGGAAGC
TGTACCGAGATGTCATGGTGGAGAACTTCAAGAACCTGGTTGCAGTGGGTGAGGACAGGCACTCTCTGAC
CCTGAACTTCAGTTCCCTTGAGAATCTCTTTGCTCTCAGGTGTTTAAGGGTTTGGACCTTTTAAAATGGT
TCTTTGCTCTTGAAGACAAAAGGTTTTCTAATCCCTGGGAAAACAGGATAGGTTTTTCTGGTCTTTCTGC
TCAGGCAAAATTCTGTCCTTTTAAATTGCTGGTTCTCAACCATGGGTGATTTCGCCCCAGAAGATATTT
GGCAATGTCTGGAAATGGTTGTCACACCTGACAGAGGGGTGCTATTGGCATTTTGTGGGTAGTATCCAGG
AATTCTGCAAAATCTCCTACAGTGCACAGGACAGTGCCCCCAACAGAGAATTGGCCAGTCCAAAATAGTA
GTGCTGCAGTTGCAAAACCCTGTTTTAAATGAACCGTAAATGGACACATTAGCTTCTATGCTTTATCTTT
CAAATACGTTGTCTTTCAAATGAAACCCATCAATGCATTAACTTAGTGCACTGTACTGGCTTTTTTTTCA
ATGAAATAAAACAGATAAGGATAGAAAATATCAGAGCTTCTTATCAGGAACTGCTCACATTGCAACAAAA
ACTGACAATTTTCAGTGAATGGTGTGAGATACAGCATTGCAAATGTGATGAAAACAGACATTAGCCAAGT
ATAACTTGAGAGAGAGATATATTATATATATATGAACTAGGCTACAACCTAAATTTCTTATTATAGTTCA
TGATCTTAAAACATCTTAAAATAAATCACTCTAGAGGCCGGGCATGGTGGCTTACGCCTTTAATTGCAGC
AATACGGGAGGCCAGGGTGGTGGATCACTTGAGGTCACGAGTTCAAGACCATCCTGGCCAACATGGTGA
AACCCCATCTCTACTAAAAATGCAAAAATTAGCCGGGTGTGGTGGCAGGTGCCTGTAATCCCAACTACTC
GGGAGGCTGAGGCAGGAGACTTGCTTGAACCCTGGAGGCAGAGGTTGCAGTGAGCCGAGATTGTGCCATT
GCACTTCAGCCTGGGCGATAGAGTGAGACTCTGTCTCAAAATAAATAAATAAAATAATAAAATATCACTA
TAGAGGTTGTGAGGCTTATAGGGTTCAGACAAAAATGTGTTTTAGTTGTGTGTTCATCTTAAATACATAA
AAATCTACATTTTCATAGGGCATCTTCCCTTCCAACCAGATATGGTATCCCAATTGGAAGCAGAAGAAAA
GCTTTGGATGATGGAAACAGAAACCCAAAGAAGTAGGTATTCTGGTGAGAACCCTGTGTCTGTTCTTTCA
GGTACTGGTTAGTCTGCATCTTACCATGTCCATGACCTCCCTGGTCTGAGTGTTAAAATCTTTCACCTGG
ATTATAACAATAGCTTCCATGCTGGTCTCCCCACCTCCTCCCTTGTGCTCCTATAATCTGCTTTCTAAAT
GGTAGCCGGAGTGGTTCTTTTTTTAATCTTTATTTTTTTGAGACAGGGTCTCACCCTGTCACCCAGGCTG
GAGTGCAGCAGCATGATTGTAGCTCACTGCAGCCTCAACCTCCTGATTTCAAGTGGTCCTCCCACCTCAG
CCTCCTAAGTAGCTAGGACTATAGGTATATATCATGATACCTGGCTAATTTTTATTTTTTGTAGAGATG
AGGTCTTGCTGTGTTGCCCAGGCTGGTCTCAAACTCCTGGACTCAAGCAGTCTTCCCACCTCGGCCTCCC
AAAGTGCTGGGATTACAGATGTGAGTTGCCGCACCCGGCCCAGAATGGTTCTTTAAAGAACACATGAGAT
GATGTTATTCCTCTGCTCAGAAGCCTTCACAACCTTCCCATTTCACTCAAAGTCCTTGTACTGAACTGCA
AGACCCTACCTGGTCTCATCTCACCAAGTTTCTCTTTGATCTCCCATTCCTTTCCCTTTGCTTAGATCAT
TTCAGCCATGCTGGCCGCCGTTGGAGTATTTGTTAAGCATACCAAGTTCCCTTCTCTTCCATGGCTTCTA
ATTAGCTCTCCTCATTGCCTTGGTGGAGAGGCTCCCCAGCACCTTACTTACTGCACTCAGGTCATTCCTC
AAATGTTATATCATTAGAGAGGCCTTCTATGTTTAAATTTACCATTTTAATTTAAAATACCATCTTCCTT
```

FIGURE 491 cont'd

CCATTTTCCATCCCCTTACCTTTCCTTTCTCTCCTTCTTTGCTTTCTCTTGAATTTGCATATTCCTCAGG
TCTATTGACTTAAAAATTAAAAGTAAGCTGGGTATGGTGGTACATACCTGTAATCCTGGCTACATGGGAG
GCTGAAGTGAGAGGATCACTTGAGCTGAAGAGTTCCAGACCAACCTGGGCAACATAGTGAGACTCCATCT
CTACAAAAAAAAAAAAAAAAAAATATATATATATATATATATATATATATCTTAGCCAGGCATGTTAGCA
TACATCTGTAGTCCCAGCTACTTGGGAGGAGCATCAAGTGAGCCCAGGAATTTGAGACCAACCTGGACAA
CATAGTGAGACCTTGTCTCCCACACACACAAAATTAAAAGTAAAAATTAGATATTCCTAGATGATGTGAA
TTTTTTTTTTTTTTGAGACCGAGTCTTGCTTGCTCTGTCACCTAGGCTGGAAAGCAGTGGTGCCATCTTG
GCTCACTGCAACCTCTGCCTCCCGGGTTCAAGTGATTGTCCTGCCTCAGCCTCCGAAGTTACTGGGATTA
CAGGTGACCACCACCATGCCCAACTAATTTTTGTATTTTTAATAGAGATGGGGTTTCACCATGTTGGCCA
GGCTGGTATTGAAGTTCTGATCTTACCCACTTTGGCCTCCCAAAAGTGTCACCCAGGCTGGAGTGCAGTG
GCATGATCTTGGCTCACTGCAACCTTCGCCTCCTGGGTTCAAGCAATTCTGCTTTAGCCTCCCGAGTAGC
TGGGATTACAGGCGCCTGCCACCACACCCGGCTAATTTTTGTATTTTTAGTAGAGATGGGGTTTCACCAT
GTTGGCCAGGCTGGTCTCGAACTCCTGAGATCGTGGTCCACCTGTCTCAGCCTCCCAAAATGCTGGGATT
ACAGGCATGAACCACCATGCTCAGCCAAAGGGTTTGTTTTTATAAGAATTCTTAACAAAAAACTTACAGA
GAATGGAGACAAGTAGATATCACATCCCTTTTACTCAGAGTTAGCTCATAGATTGAGAGCACACCAGTGT
GATTAATTATTTGGGAACACTGTCTTCTAGTGAATGTCTAACATAATTAGTAATTTCTAAGACATTTTTG
GACATGTAAATATTCAAACCTACTAACCTTAGAAGATAAAAGCTATTCACAGTTGTTGGAATGTAGAACT
TCACTATCAAAAATTATCAGTGGCAATATGGCAGGTATTATAGTTCATCAGTTTCCCTGTATCAATTTCA
AGTTGGCTTTACTCATTGGTGAAAACTGCCTTATCCATACAGCTGACTTCCCACTTTCCCATTTCCCCTT
CCCTCTAATACCAAAACAGTTATATAACCTACATACAGTAGTTCTTTAGCAGTTTTGAATTGGACATTTC
CAGAAGTCCAGAGGCACTGACATACCTGTGGAGTTGAGGTGAGTCCTGATTAGGCAAAGAAAATTCCAGA
ATTTCTAAATTGGGTTTCCAGTGTAATTTGCATCCACATGTATTAATCTTAGCTTCTAGCACCAGCAATG
TGAGAAGCACTTTACATGTTGCAGTGACTTCTGACACCAAACACCTGAAGTTAGGCCGGACTTTCAGAGT
AAGGGCATAGTTTTCCACAAGACTGCTCTCTATATCGCTCTAAGTTTATATATCGCTCTAAGTTTAGGGA
TTCCCAGATAATTTTGCTCACCTCTGACCAAGTAGCTACAAATTTGGGAGTTCCCGTGATAATTTGTTAG
AATGACTGACAGAACTCGGGAAGGTGCTGGACTTACAGTTTTATTATAGCAAAAAGATACATGTTGGAA
GCAGCAAAGGGAGAGATATATAGGGTGAAATCTGGGTGGCTTCCCTCTTTCTTCCCTTTTGTAAGGACT
TGTGATTACTTTAGGCTCATTGGATAATCTAGGATAATCTCCTTAAGAGCTTTCATTTAATCATATCTAT
AAATTGCTTGTTTTTTGTTTTTTTTTTGTAGACGGAGTCATGCTCCGTCGTCCAGGCTAAAGTGCAG
TGGTGCAATCTTGGCTCACTGCAACCTCTGCCTTCTGGGATCAAGCGATTCTCATATCTCAGCTTCCCTA
GTAGCTTACAGGTGCCTGCCACCATGCCAGGCTAATTGTTTTTTTAGTTTTTTAGCGGAGACGGGGTTTC
ACCATGTTGTGGGCCAGGCTGGTCTCGAACTCCTGACCTCAAGTGATCCACCTGCCTCGGCCTCACAAAG
TGCTGGGATTACAGGTGTGAGCCACTGTGCCTGGCCTGTAAATTCCTTTTTGCCATGTACATTAACTATT
CACAGGTTTGAGAGTTCAGGCTGTGGACATCTCTTGGGGTGGGGTGTCATTACTCAGCCTGCCATATCC
AGAAATGTGTAGACACCTGTTGCTATTTTTTTTCAGTTTGTATTATTAGAATGTAACATTTCATTTAGG
CAAATTATTTGATTAGGACTTGGTAAACCACCCCCTAAACATTTTAAGCCAAGGTCTTTCATACGTTTCT
AACCATGACCCTCAACATAAGTATAATTTTACATCTTGACTAAGCATAAATATGTTTATATTTATGTGTA
TATTTACCAACTAAAACAAGTATTTCCTATAGTAGTACTCTTATTGCTTTTAATACACTAAGCATGTCTT
ATTCTGTTTTTTGTTTTTTTGTCAGTCACAAGTTACATACTTGGTTTCATGGTGCACTAATGCATTGCAA
CAATTTGAAAACCCTTGTTAACAGTGGGGATAAAGCAATGAAGAAAACAAAATGCGTGTTTTTTCATGA
CCGTTACATTCTACTGGGTCTAAAGAGACAAAGGAAAGTATATAGTAAATCAAATAATAAGTACTGTGGG
GAAAAGTCAAGCAGGGTAATTGAACTGGAAAGAGTCGAAGGTGTATGGCAGGCCGGGCGTGGTGGTTCAG
CCTGTAATCCCAGCACTCTGGGAGGCCGAGGTGGGCAGATTACTTGAGGTCGGGAGTTCGAGACCAGCCT
GGCCAACATGGCAAAACCCCATCTCTACTAAAAATACAAAAATTGGCTGAGTGTAGTGGCATGCGCCAGT
AATCCCCGCTACCCGGGAGGCTGAGGAGGAGAATCTCTTGAACCCAGGAGGTGGAGGTTGCAGTGAGCTG
AAATCACACCACTGCACTCCAGCCTGGGCGACAGAGCGAGACGCTGTTTTTAAAAAAAAAATGGCGTAT
GGTGGTACCGTTGATTTATTTTACATCGTGTGTTATGGAAGGCATCACAGATAAAGTAACATGTAACAT
GTGAGCAGAGACCTGAAGGGAGCGAGAGAACAAGCAAGGCTCCTGCTTTCTGGGAGGAAGTTTCCAAGC
TGAACATACCTCTCCCTCTCTTCGTCTTCTGTGTTGGCTTTGAGAGTTTGCACTATGCTCTATTTCCTCT
CCGAAGTTCTCTCCTAGTTATACAAGATTAGCTTTCCCTTTTCCACTTGTCCAGAGACCTGGATTTCTAC
CAGGTTTTAGAACAATCATATTATTCCAACTGCCTTCCCAAATCTGTTGGAGAATAATTTCTATCAGGAT
CTAAAATAGTATTTCATGCCTACAGTCTGAACTTTTCTTAACCTAACTAGTTATTAGAATCCCGCTTGTC
ATAAGCCTACTGAGGAAGAGGTGAGTAGGCTGTTCATTGATGTTATTGTAGGTTGGAATATGGATTTTCT
TTTTGTTGCCCTGCAGCTACCTGATTTTAGCTTTTAGCTCTCATATTAAACTGTTAGACTTACGGTTCTA
CATGGATCATGTTTATACTTAGTGAATGGGAGCCTGTTGACCCCACTCTTCGTTTACACCTGTATGAAAA
ACATGTCAAAAGAATACACGATGCTGTAAGGACAAGGTCACCTTTCGCCTGGTTTATCAAGGCTTTCTCC
CATGGCCTAAGTGTGAAATTCTGATATTTCTGAAGAAAGCATTTACTGCCCTCATCTCTAAATATTGCCT
TTTTTCTTTTTTAATAGGCAGCAAGCATCAAAATAAGATGGAAACACTCCAAAAATTTGCATTAAAATAC
CTTTCAAATCAAGAGCTGTCCTGCTGGCAAATCTGGAAACAGGTTGCAAGTGAATTAACCAGGTGTCTTC
AGGGGAAGAGTTCCCAGTTATTACAAGGTGACTCTATTCAGGTTTCTGAAAATGAGAACAATATAATGAA
CCCTAAAGGAGATAGCTCTATTTATATTGAAAATCAAGAGTTTCCATTTTGGAGAACCCAGCATTCTTGC

FIGURE 491 cont'd

GGGAATACATATCTGAGTGAGTCACAGATTCAGAGTAGAGGTAAGCAAATTGATGTGAAAAATAACCTGC
AAATACATGAAGACTTCATGAAGAAATCACCATTTCATGAGCATATTAAAACTGACACAGAACCAAACC
CTGCAAAGGTAATGAATATGGCAAATCATTAGTGATGGCTCCAATCAGAAATTACCCTTAGGAGAGAAA
CCCCATCCATGTGGTGAGTGTGGAAGGGGCTTCAGTTATAGCCCAAGGCTTCCCCTTCATCCGAATGTTC
ATACAGGAGAAAAATGCTTCAGTCAAAGCTCACATCTGCGAACTCATCAGAGAATTCACCCAGGAGAGAA
ACTCAATAGATGTCATGAATCTGGTGATTGCTTCAATAAGAGCTCTTTTCATTCTTATCAATCTAATCAT
ACAGGAGAGAAGTCTTATAGATGCGACAGTTGCGGCAAGGGATTCAGTAGCAGCACGGGTCTTATCATTC
ATTACAGAACTCATACTGGAGAGAAACCCTATAAATGCGAGGAATGTGGTAAATGCTTTAGTCAAAGTTC
AAATTTTCAGTGCCATCAGAGAGTCCACACTGAAGAAAAACCATACAAATGCGAAGAGTGTGGTAAGGGC
TTCGGTTGGAGTGTTAATCTCCGTGTTCACCAGAGGGTCCACAGGGGTGAGAAGCCCTATAAATGTGAGG
AATGTGGTAAGGGCTTCACTCAGGCTGCACATTTTCACATCCATCAGAGAGTCCACACTGGAGAGAAACC
CTACAAGTGTGATGTGTGTGGTAAGGGCTTCAGCCACAATTCACCATTAATATGCCATCGGAGAGTCCAC
ACAGGAGAGAAGCCATACAAGTGTGAGGCGTGTGGGAAAGGCTTTACCCGTAATACAGATCTGCATATTC
ATTTCAGAGTTCACACGGGAGAGAAACCCTATAAATGTAAGGAGTGTGGTAAGGGCTTCAGTCAGGCTTC
AAATCTTCAAGTCCATCAGAATGTCCACACTGGGGAGAAACGATTCAAGTGTGAAACGTGTGGGAAGGGC
TTCAGTCAGTCCTCAAAGCTTCAAACCCATCAGCGAGTCCACACTGGAGAGAAACCATATAGATGTGATG
TGTGTGGTAAGGACTTCAGTTATAGTTCAAATCTTAAACTACACCAAGTAATTCACACTGGAGAAAAACC
ATATAAATGTGAGGAATGTGGGAAGGGCTTCAGTTGGAGATCAAATCTTCATGCACATCAAAGAGTTCAC
TCAGGAGAAAAACCCTATAAATGTGAGCAGTGTGATAAGAGCTTCAGTCAGGCCATAGATTTTCGGGTAC
ATCAGAGAGTCCATACTGGAGAGAAGCCATACAAATGTGGTGTCTGTGGTAAGGGCTTCAGTCAGTCCTC
TGGTCTTCAATCCCATCAGAGAGTCCACACGGGGGAAAAGCCATACAAATGTGATGTGTGTGGAAAGGGC
TTTAGATACAGTTCGCAGTTTATATACCATCAGAGAGGCCACACTGGAGAAAAACCTTACAAATGTGAAG
AGTGTGGGAAAGGCTTTGGTAGGAGCTTGAATCTTCGCCATCATCAGAGGGTCCACACGGGAGAGAAACC
CCATATATGTGAGGAGTGTGGTAAGGCCTTCAGTCTCCCCTCAAATCTTCGAGTCCACCTGGGTGTTCAC
ACCAGGGAAAAACTCTTTAAATGTGAAGAGTGTGGTAAAGGCTTCAGTCAGAGTGCACGTCTTGAAGCCC
ATCAGAGAGTCCACACTGGAGAAAAACCATACAAATGTGACATATGTGATAAGGACTTCCGTCACCGTTC
ACGTCTTACATATCATCAGAAAGTCCATACTGGTAAAAAGCTTTAGAAATGAGAAATGTGTTACCAACTT
TTGTCTGAATGCACATCTTCAAGTTTTTGGCTAGTCCATGCTGGTGGTAAACCCTGTAAAACTACTGAGA
GTGGAAGGGGGTTTGTTCACACTTGGAATCTTTCTAACAAATCCATCAAGATGATAACACAGAACCATGA
ACAGGAATAGAACTCGTATTTAGGGGAGAAATAGGGCTGGTGGCTCTCTTGGTAAGATCTAGTTAATATA
AATGATCACCTTTCATTGTGAATATATGCCTGAAGATAATGTGTGGAAGGATATTTGCCATATGCTAACT
GGTTTTTTGGCCAGGGAGAGTTTTGGGTTATTATCCCTTTCTTTAATTTTCATTTTATACTTACAGTGA
TCATTATTTTCATAAAAGCTGTAAAGCTATGAAAAATGAATAAAATTACTAAAAATTTTCTGTAGCTAAG
GACTCATGATTCTTTTATATGGTATATAGGTGTAAAATTAAGGAATATATCCCCAGAGATGAATCTTTGA
TCTTCAGAAGTAAATTTATATCTGCTGTAGAGGTGTATTAAAGGATAGTAGTATGGCCGGGCACGGTGGC
TCACGCCTGTAATCCCAGCACTTTGGGAGGCCAAGGTGGGCGGATCACAAGGTCAGAAGATTGAGAACAT
CCTGGCTAATATGGTGAAACCCCATCTCTACTAAAAATACAAAAAATTGGCCAGGCATGGTGGCACGTGC
CTGTAGTCCTAGCTACTCGGGAGGCGGAGGCAGGAGAATCGCTTGAACCCAGGAGGTGGAGTTCGCAGTG
AGCCAAGATTGCGCCACTGCACTCCAGCCTGGTGACAGAGCGAGACTCCATCTCAAATAAATAAAGAAGA
AAGAGAGAGAGAGCAAGAGAAAGAGAAAGAGGATAGTCGGTGCATCATTGTTTTAGTAGCAAACATA
GAAATACTTGGATTGCCAAAGTATTTTGTGCTTTACCAATCCAGTGGCACACTATGCAGACATCAAATGG
GAAAAGGTAAATTTTTAGCTGTGGATATTGGAAGATGTTCAGAATATATTAACTTGAAAAACAAAATGTG
AGATTTTTATGTGATCCTATTTTGTAAAAACGCATAGATGAATGGGTATTATAGTTCTCTCTAAATAATG
GGATTTTACTTTATGTATATTTTTATATTTCTTTAAACTTATTTTGAAATAATTTGAAACTTTCAGAAAA
ATTACAGAAATTATATAAAAGCTCCCATATACTCTTTACCCAGATTCACCAGTTGTTAAGATGTTTGAAT
TATTCTCTCAATAAGTATGAGCGTGTATATACTGATACTTATACATACTAAACGCATTTATATATAAAGT
TTTGCCATATGAATATGTTACAGACATCCTTCTCCCTACACTAAATACTTAAGTGTGCTTTCCTAAGAAC
AAGGATATCTACTTAGTTACAGTACAACATTCCAGTGATTTATTTATTTAGAGACAGGGTCTCATTCTGT
TGCCCAGGCTGAGTGCAGGGTGGTGATTATAGCTCACCGCAGCCTTGAACTCCTGGGCTCAAGCAATCCT
CCCCACTCAGCCTTTCAAGTAGCTGGGACTGCAGGCGTGGACCACCATGCCCACCTAATTTTTAAGATTT
TTGTAGAGATGGGCTCTCGCTATGTTGTCTAAGCTGGTATCGAACTCTTGGGCTTAAGTGATCGTTCCAC
CTCAGCCTTCCAAAATGCAAGGTTTACAGGCATGAGCCACTGCACCCAGAAAGAAATTTATTATTGATA
CATAACACTATGTAACCTACAGACCTTATTTAAATCTTAAAATTATCCCAATAATATATTTATTGTTTTT
CTGCTCTAGAGTCCAAAGATTACACATTGCATTTAGACTCCTTTAATCTGAGTTGCTACCTCTGTTTTTA
ATGACCTTGATATTTTGAGATTATTTTGTAGAATGTCTCTTAATTTGGATTTGCCTGAGGTTTCCTTAC
AATTGGATTTAAATTACACATTTTTTTCCCATGAGGACTCTGTAAGTGGTGTGCAGCACGTGAGGAAACG
AGGTATGTTTGTACCTTTATAGGTGATGTTAACTTGGAACACTTGATTGGGGAGGGCGGTGCTGGGTTTT
TCCACTGCGAAATTACTATTTTTTTCTTTGTAATTAATAATTACAAAGGCAACTCCTGGGGAGACACTTT
CTGACTCTAAATAGCTTGTTTTTCAGTAAATTTTCCTCCACTAGTTTAAGCATTCTGTAAGTCTGGTCTA
AATCAGTAATTGCTCTGATGGTGCGAAAGTGTGATATATTCAACTTTCATCATTCCTCCAACACTTGTTA
GATTGTTGTTCTACTCTAAGGAAGTTTCCCTTCTGTCCTGTTTGCCCATCATGTATTTTTAAATAAATTG

FIGURE 491 cont'd

```
GAGCACATCTTTACTCTGACACAATACAGTGTTCCAAGCTCATCTTGTACCCTTCCTGCACCATCCATGG
AATTTGCTGTTTCTTTGAGAACTCAGATTCTTCTGATTGGGGATGGTAGTTAAACATCAAGATCTGGGT
AATAGCTGTGCCTTTTTTTTTTCCCTCTAGGAAGGAGGGGAAAGAGTTATACAGATAGGAAGAGAAGTA
GAAAGGTAGAAAGAATTAATGATGAGTTCCTGCTTTTATCTCTAGTTCTTAAATTAATATCATAGTGTTT
TTTTTCTAGCCTTACCCCCATTCTATGTTGCATCTTCATTCTTCAAGAATCAGAAATTTGTCTCCCAGTA
TCATTCATATATTTACTGGGGAATGTGGACATGCATCCAACTAGAACTTGGGGGTTCTGTCTTTCAGAGA
GAACGGGAGTATTGGATGACTGATGCCAGAGATGATTTTTGAATGGCATAGTCTCCCAAACATTATAATT
TTTCCTATTCTCAGGGTATTGACCCTTTAAACCAAATAAAATGTTCCCGTAGGGCCATGAAGAAAGTAT
CTGATAGAAATATCCAAAGATAGATATATTCAGATGAGAGCCTTCCAGTCAATGTTTCCTTGCAGATAGT
GTTAAGGAATGGTTTCTGGTGAAGTGTTGCGGAGCTCTCCTAGCCTGTGAGTGTCACGGATGCCATTGAT
TAGCATTGCTTTACTTTATTTACCTCTCATTCTCTGAACCTTCTCAGAGGTAGTTTGACAAAGTTCTCAA
AGCACATCCCTCTACTGCTTCTTGAGAGGACCAAGGCATTTTAGGAGAAACTAGTGTTAACGAGACCAAG
TCAGAATATTGGTAATAAAGTAGTACAGTATAATAGAAAGCAGACTGTCAGCCAGGCACAGTGGCTCACA
CCTATAGTCTCAACTACTCAGGAGGCTGAGGTGGAGGATCACTTGAGCCCAGGAGTTTGAAGCTGCAGT
GAGCTGTGATTGGACCACTGCATTCCAGCCTGGGTGACAGTGAGACCCCATCTTGAAAAAGCCAACTGGG
TGCAGTGGCTCCCGCCTTTAATCCCAGCACTTTGGCTGGCCGAAGTGGGTGGATCACCTGAGGTTAGGAG
TTCCAGACCAGTCTAGTCAACATGGTGAAGCCCTGTCTCTACTAAAAATACAAAAAGTTAGCCAGGCGTG
GTGGTTAGCCCCTGTAATCCTAGCTATTCGGCTGAGGCAGGAGAATCAATTGAACCCAGCAGGTGGATGT
TGTAGTGAGCTCAGATCGTGCCATTGCACTCCAGCCTGGGCAACGAGTGAAACTCCATCTCAAAAAAAAA
AAAAAAAAAGAAAAGAAGAAAAGAAAAAGCCAACCCTGGAACCCTGGAATTAGACTTTCTTGCTCAGTG
TAACCATTTGCTAGTTGCGTAACTGCAGGCAAAATGCTTAACCTCTCTATTCCTCAATTTGCTTGTGTCT
TCAATGTTTGAGGATAATATCTTTTAGTTCTGTGGTAAGGGTTAAAACTATATGCCTGGCATATAGTAAG
ACCTGTATAGTGTTAACTATTATTTTCAACATAGATGTCACTATTACTAGATTTCTGCTAATTTATATTT
GAAATTTCTAAGGAAGGGATCAGTAAACTATAGCCTGCTGGCCAAATCTAGCCTGTGTCCTCTCTTTGTA
CAACACGAGAGCTGAGATTTTAAATGTTTAAAGAGTTGTAAGAAAAAAAAAATGCTACAGAGACCATCTG
TGGCCCGCAAGACTTAAAACATTACTGTCTGGCCCTTTTTAGGAAGTTTGCCGTTCTCTGATCTAAGCAA
ATTTTAGTTTCTCAGAAGCCTTGCTTCTGAGATACATACATACTACAGATATGTATTATCTCAATTCAGT
ACTTCTCAAATCTTTTAGGTTTAAAAAAAATGCTCGAATTGACATAAGAAAACACAAGCATATTTTTTAC
AGAAAATTGGGACCATATATGAAGCAATGTGCTGTGTGTCCAATGTGTAGTTAATCTGCAATTCTATGAA
TAAATGTTATTGGTTTTTTTTTTTTTTTGGTAAGTAAACTTAGGTTTTACAGGTTTAAGTACCTTCCC
TAAGTCAGTCAGTAGTGAATGTCACAACCACAGTTTGAACTCAGGTCTATCTTGCTGACTTCAAAACTAC
TCTTAAATGCTATGTGCATAAATTACATTGCAAGGCCAGAACTCCTAAGTTTACATTCTGTAGAGCATGC
ATCCCATTTCACACAAGTAAAGTGCAAATATAAGAATGGAATATCCTTCAAAAAGAACGAAATTTGCCTA
GGAAGTCTTTTGCTCCATTTCGACTCAGGCTTTTCCTATACTAAGTCAATAATCTAGGCAAGCTTGTCCA
ACTTGCAGCCCAGGACAGCTTTGAAAGTGGCCCAACACAAATTCATAAACTTTCTAAAACATGAGATTGT
TTTTGCAAATTTTTAAAGCTCATCAGCTATTTTATGGGTGACCCAAGACAATTATTCTTCTAGTGTGGCC
CAGGGAAGCTAAAGATTGGACACCTCGATCTAGGAGATATGTTTTGTATTTCCTATGTCCTTGATTACA
TTTCTGACCTCGTTGATGCCATTAATTTTTAAATATTTCTTCTTGTTTGATGATTAAAAATCCAATACTG
AAAAATTAACTCAAATGTTGAAAAAGAACAGCCATGTTTGAAGCTTTAACCTAGCAGTTGTAACCTAACT
GAATGTACCTCTTCCAACTGTAATTTTGCAGTCCACTTGAGGAAGGAATCCTTTTTAGGACTTACCTGAA
ACTATTTACTTGGCAGTTCCTCCACAAAATCAGGTTTATTTAAAAATATGCAGCTTTTTCCAGGCATGGT
GGCTCATGCCTGTAATCTCAGCACTTTCAGAGGCTGAGGCAGGAGAATGGCTTGAACCCCGGAGTTCAAG
ACCAGCATGGGCAACATAGTGAGACCCCATCTCTACAAAAAAATCAAAAAATTAGCCGGGCATTGTGTCA
CGTGCCTATAGTCCCAGCTACAGGCTCAGTGGCTGAAGTGGGAGGATTGCTAGAGCCCAGGAGGTTGAGG
CTGCAGTTGTGATGTTGCACTGCTCTCCAGCCTGGGCCCTGACTCAGAAATAATAATCTTAAAAATGCA
GGTTTTAGGATAGCCATTCACTTGAAAATTCTAAGTTGGAGAGCCTTTTGACAATGTATACCCATATTTC
TCTTCTCTTTTTCCCTCCCCCTTTTAAGTTGTGAGGTATAATTAACATACAATAAGCTGTACATATTTAA
AGTGTTCGATTTTTAAAGTTTTAATATGTGTATCTTTGAAACCATCACCACAATCAAGATAGCAAAAATA
TCCATCATTCTTCAAAGTCACCTCATATCTCCCTTTTAATCTCCATTCTGCTCCTCCCCAATCCCCAAGC
AACCACTGATCTGCTTTCTGACACTGTATAGTTTGCATTTTCTACAATTCTAACAAATGGAAACTGTACA
GTATATACTTTTTTTCCTAACTTCTTGCAGAAAGAGATTCATCCTTGTTGTTTGTATAGAATTAATTCTT
TATTACTGAGCATTACTGTAAGTGTGTAGATATACCATAATTTTTAAAAAAATCCATCTGTTGATGGG
GATTTGAGTTCTCAAACTTTTGGCTATTATAAATGCTATGACATGCTATGAACACTTGTTTGTGTACAAG
TGTTTGCATGGAGATATGTATAGTCTAGAAATATATATATATACCATATATAACTCGACTATATATTT
TATCTTGGATAAATAGCTAGGAATTGAATACTGGATCATATGGTAAATATATGTATAACTTTTATTGTA
TTTTTAATTTGGTATTTTTATTTATCAGAGTTATAGAAATTTGGAGGAGTACATGTGGTATTTCAATACA
TGTGTACAATGTGTAATGATCAAATCGGTGTAGTTGGGATGCCCATCACCCCAAACATTGTGTTTAACTT
TTTTTTGTGTGTTTTGAGACGGAGTCTTGCTCTGTTGCCCAGGCTGGAGTGCAGTGGCATGATCTTGGCT
CACTGCAACATCGGCCTGCGGGGTTCAAGCAATTCTCCTGCCTCAGCCTCCTGAGTAGCTGGGACTACAG
GCATGTGGCACCATGCCTTGCTAATTTTTTATATTTTTAGTAGAGATGGGGTTTCACCGTGCTGGCCAGG
TTGGTCACGAACTCCAGATCTTGTGATCCACCTGCCTCAGCCTCCCAAAGTGCTGGGATTACAGGCGTGA
```

FIGURE 491 cont'd

```
GCCACTGTGCCTGCCCGTGTTTAACTTTTTAAGGAATTTCCACTCTTTTCCAAAGTGGGTGTGCTGTTTT
ACGTTTTCACCAGCAGTGTGCATCTTTTCTTCACATTTTCATCAAAATATGTAACGGTCGGTCTCTTTTA
ATTTTAGCCATTCTACCCTAGTAGTATCTCACTGTGTTTTAATTTGCATTTTTCTAAACATGTTTTTCA
TGTGCTGTTTTCCATTATCATATCTTTGGTAAAGTCTACTTAAATACTTTGCCCATTTTTTTATTGGGTT
ACTTGTTTTCTTATTGAGTTTTGTGGGTTCTTTGTATATTATTGATACAAGTGCTTTATCAGGCATGTGA
TTTCCAAAATTTTTTCACTCAGTCTGTGGTTAAGCAGAAGTTTAAAATTTTTATGAAGTCTAGTTTATCA
TAATTTTCTTTGATGTATCATGCTTTTGGTGTCATATCTAAGAAACCTTTGCCTAATCCAAGGTCTCAAA
GACTTTCTCCTATGTTTTCTGCTAACTTTATAAGTTTAGGTGTTTTTTTTTTTTTTTTTTTGAGACGG
AGTCTCGCTCTGTCGCCCAGGCTGTAGTGCAGTGGCACGATCTCGGCTCACGGCAAGCTCCGCCTCCCGC
GTTCACGCCATTCTCCTGCCTCAGCCTCCCGAGTAGCTGGGACTACAGGTGCCCACCACCACGCCCACCT
AATTTTTTGTATTTTTAGTAGAGACGGGGTTTCACCATTTTAGCCAGGATGGTCTGGATCTCCTGACCTC
GTGATCCACCCACCTCGGCCTCCCAAAGTGCTGGGATTACAGGCGTGAGCCACCATGCCTGGCCAAGTTT
AGGTTTTACATACAGATGTATGATCCATTTTTAGATAATACTTATATATAATACAAAACACGTTTATTCA
TCTTAAAACTATGGATGTCCAGTTATGCCAACACCATTTGTTGAAAAAATGATCTTTTCTCCATTGAATT
GACTTTGTGTCTTTGTCAAAAATCAATTGACCGTATATGAGTGGGCCTATTTCTGAACTCTCCATTCTAG
CTCGTTGATCTTTTTGTCTCTTCACCATACACAGCCAGTTGTTCTTGATTACTAACATAGCTTTATAGTA
ATTCTCTCTAAATCAGGTAGCACGAGTCTTCCAACTTTGCTTTTTCAAAATTGTTTTAGCTATTCTAGTT
CTTTTGCTTTTTCATGTAAGTTGTAGAATCATCTTGTTGATTCTTTTAAAGAATATTTGCAGGGCTTTTA
ATGGGAAGTGTGTTGGAAGATTTGACTTCTTTAGTCTTCCAATCAGTGAAAATGGCATGTCTCTTCACTT
ATTTAGGTCTTTTATTTCATCAGTGATTTGTATTTTTCAGTACACAGATATTGCCTGTTTTCTTAGACTT
GTACTTAAAAAATTCCTGAAAATTTTGTTCTGTTGTAAGTTTCTATTTGTTCATAATAGTATATAGAAAT
GCAACTTATTTATATTAACATTGTATATTAACATTGCATCCCAGGACCTTTTGAAACTGATTTATTAGTT
CTGGTAACTTTTTCATTCTTTATACATAATCATGTTGTATGCAAATGGAGACAGTTATTTCTTGTTTTCC
AATATGTTTTCTGTTTCTTTGCTTGTTTCCCTAAGAGCTTTTTCTGCATCTACTAAGATGATTGAAGAGT
TTTTGTTCTTTAGTCTATTAATATAGTGACTTAACATTCATTTTAAAATGTTCGAACAACATTGCATTCC
TGAGATAAACCTACTTAATCATGATGTAGTATTATTTTCATATATTCGACTTGCTGGTATTTGTGAAGA
ATTTTGTGTCTATGTTTATGAGGAATATTGATCTGTTGTCTTCATGCATTTTTCTAATTTTGGTAACAAG
ATAATGCTAGCCTTATAAAATGAGTTGGGAAGTGTTTTTCTCCTCTTTATTTTCTTCTTTTTCCTCAAAA
TGTTTGTGTAGAATTGGTAGTTTCTTTTCCCTTAAATGTTTGGTACATATAAGAGGCTTAGGCCTGGTGG
TGGTGTTTCTGGAGGTGTTTTAACTTGAATTCAATCTCATTAATAGGTATAGGAATATTCAGGATGTCTG
TTTATTCTTGAATAAATTTTGGTAGTTTTTCTTTTTTAAATACATTGTCTATTTCATCTAGGTTGTCACA
TATGGCATAAAGTTGTTCATAATATTTCCTTATTATCATTTTAATGTCATTAGGATCTGGCGTGTGTGTG
TGTGTGTGTGTGTGTGTGTGTCTCCCAGGCTGGAGTGCAGTGGCACAATCTTGCATTCACAG
CACCCTTTGCCTCCGGGCAGGTTTAAGTGATTCTCCTGCCTCAGCCTCCTGGGTAGCTGGTATTTTTAG
TAGAGAGGGGGTTTTGCCATGTTGGCCAGGCTGGTCTCAAACTCCTGACCCCTGAAGTGATCCACCTGCC
TCAGCCTCCCAAAGTGCAGGGATTACAGGCGTGAGCCACTGCACCTGGCCTGTCATTAGGATCTGTAATC
ATATCCTTCTTTCAGTCCTACAATTGGTAATTTCTGTTTTGTTTTCTTGTTCTTTTCAAAGTTTATTGCT
TTTTCTTCACTATTGTTATCCTTTTCGTTTGGTTGATTTCTGCTTTCATTTTTGTTGTTTTCTTCTTTCT
TGCTTAGGGGTTTTTCTTTTTTCATAGACAGGGTCTCACTCTGTTACCCAGGCTAGTCTCAAACTCCTGG
GCTCAAGCAGTTCTCCTGCCTTGGCCTCCCCAAATCCTGGGATTACAGGTGTGAACCATTGCACCCAGC
TTTTTTTTTTAAAGTTTATTAAGCTTAAAAAAGCTTAGATAATTGATGTAAGTTCCTTTTCTTCCAATAT
AAGCATTTCATGCTCTAAATTTTTCTCTAAATGCTGCCTTAGTGGCATTCTACAAGTTCTGATATGTTAT
CTTTTTATTTTTATTTCTTATTTTCCCTTTTCTCTTCTAACTCATGGGGTTTTTTTGACCCATGGGTTA
TTTAATTTCTAAGGGTAGTGGGGATTTTCCTGAGATTGTTTTGTTATTGATTCTCATTTAATTTGTTG
TGATATGAGAATATACTTTGTGTGGTTTCAATTCTTTTAAATTGGTGCAGTGAATTACATGGCCCAGAGT
ATGATCCATCTTGGTGTATGTTTAATGATGTTGATTAATAATGTTGTTGAGGTCTTCTATATCCTTACT
GGTTTTCTTTTCTTTTTTCCATCACGGCAAGAGTTCATCATGACTTACTGGTTTTCTATTTGTTTATTG
ATTAATGAGAATGAAGTCTCCAGCTGTTAATTGTGGGTTGTTTAGTCTTTGTCTTTATCAGTTTTGGCTT
TGTATATTTTGAAGCTCTGTTGTTTGTGCATACACATTTAATTTTATGTCTTTTTGGTGAAATTACCTC
TTTATTATTATTTAATGTCCCTCTTATTTCTGGTAATAATCCTTGTTTTGATGCCTACTTTGTTTGCTTT
TAATATCACCACTATAGCCTTTTTTTTTTTTTTTTTTTTTTTTTTTTTTTGAGAGGGAGTCT
TGCTCTGTCGCCCAGGCTGGAGTGCAATGGCACGATCTCGGTTCACTGCAAGCTCTGCCTCCCAGGTTCA
TGCCATTCTCCTGCCTCAGCCTCCCAAGTAGCTGGGACTACAGGCGCCCGCCACCATGCCCAGCTAATTT
TTTTCTATTTTTAGTAGAGATGGGGTTTCACCATGTTAGCTAGGATGGTCTCAATCTCTTAACCTCGTGA
TCCGCCTGCCTTGGCCTCCCAAAGTGCTGGGATTACAGGCTTGAGCCACCGCGCCCGGCCCACTGTAGCC
TTTTATTAGTGTTTGCCTAATAGTAGTATAGCCACTCCAGCTTTAATTTGATTATTGTTGCTTTATTCTC
CAATCTGATGATTTGTTATAATTGGTATGTTTATGTCATTTATATATCATTTAGTAATTGATATGGTCAG
ATATAAATCTATTTTTGGTTACCTTCTTTGTTTCTTTTCCTTTTGTTACACATTTTTTGCTAATTTTTAA
ATATGATTTCATATCGTATCCACAATTAGCTTATTTTTACAGGCTGAATATCCCTTACCCAAAATGTTTG
GGATTAGGAGTGTTCAGATTTCGGATTTTTTCAGATTGTGGAATATTTGTATTGTAGTTATCAGTTGAGT
ATTTGCAGTCTGAACATCTGAAATCCAAAACACTCCCATCAGCATTTCCTTTGAGTTGTCATGTAAGCAC
```

FIGURE 491 cont'd

```
TCAAAAAAATTCAGATTTTACAGCATTTGGATGTTCAGGTTGGGGTACTCAACCTGTACCTCTTTTCATT
ATTGTTTTAGCGTTTACTGTAGAATTTACAATATTCATCTATAGTTAATGACAGCCTCTCTTTAAATAAT
ATATACTATTTTATTTATTTTATTTCACTAGGTTTTTGGGAAACAGGTGGTGTTTGGTTAATGAGATTTT
GAATATATACTCTTTACTTATACAACTGTACACTCCCAATTCCTTCCTTCAAACTTTTGTCCAATTGTCA
AGCATTTGTCGTTGGCATATGCTATAAAGCCACAGTACATTGCTATTATTTTTGCTTTAGGAGTCAAGTG
TCTTTCAGAGCAATTAAAAGTTAAATTCTTAACTGCTTCTGGAAATCGTCATTACTTTGCAAGTTTACCA
AATTTTATATAGCATCCTTTCTGTTTGAAGAACTTTCTTTAATGTTTCTTGTACTGCTGGTTGGCTGCTA
CTGAATTTTTTCAGTTTTTGTCTTAAAAAGTTTTCATTATATCTTCATTTTCGAGGGATGTATTTGCTGG
GTATGGAATTATGTGTTGTTGTTTTTTCTTTCTATACTCTTTGTATTCTGGTTTGCATAGTTTCTAATG
AGACATGTCCTGTAATTCTCATCTTTGATTCTTTGTATGTATTGTGTCTCCTCACCCATCCCCTGCCTTT
GGCCGCCTTCAAATTTTCTCTTTATTTGAATTTACTGCAGTTTCAATATGATGTGTCTAGGTGTGATT
GTTTTTATTTTTATTTTAAAAATACAGATACTACCATTGAAAATCCACAGAAATATATTCATTCACCTAG
AAACTCTTGTTTCTTACTACATTCTTCATGTAATAAACCAAAGGATGGAAGGGTGTATATTTTAGTACAT
TAGAAAAAGCTCATTTGCATATACTTCTTGAATTTTTCATGTGCACAAAGACCCACTGAAAGTATACACG
AAAAACTAACACTGGTCGGGCGTGATGACTTATGCTTGTAATCCCAACACTTTGAGAGGACGAGGCAGAC
AGATCACTTGAGGTCAGGAGTTCGAGACCAGCCTGGGCAACATGGTGAAACTCCATCTCTACTAAAAATA
CAAAAATCAGCCAGGCGTGGCGGTACACATATGTAATCCCAGCTACTTGGGAGGCTGAGGCAGGAGAATC
GCTTGAACCCAAGAGGCAGAGGTTGCAATGAGCCAGGATTGTGCCATTGCACTCCAGCGTGGGTGACAGA
GCAAGACTCCATCTCAAAAAAAAACAAACCAACAAAAAAAAAACACAAAGATTACATGTGGTACATGGGC
TTTTGGTATAGGCAAACAACCTTGGGTCAGAATGGGATGAGTTTTCAAGGTATATTGTTTATATTATTTT
AATTTTGTACCATGTAAATATATTACCTAGTATAGAAAAAAATTTAAAGCAAATTTCCCCAAATGCATTA
ATGGGCCTTATTTTTTCCTTTGCCTAGTTTAATTATTTGATTAGAGTCTCAGTATTCTCTCATTTATAAT
ACATATAGACAGTTACACATCCATATCTTCATATTTACACAATTTTAGAAAGTATTACATTTCCCTACAG
CCTCACTCCATGGGAAGAGTATTGTTAACTGGCCATTGTGTTTTAACTCACCACTGGAAAAGAAAAATTA
AACACACGTTTAACAACGCAGTTTTAAAACCTAACAAAGACCCAGTCCACAGACCCCATATATGTTACTG
GCTGCTGCTCAGGATGGTATTTTCATCCCTGAGAGATTGGAATGCTTTTTTATTTTTGTTGTCAATGGG
TTTTCTCTTGCCTCATTCCAATCTTACTATTTTTCTGCAAAGCTTGTTTCCCTAGTCCTGCTTTCATCCA
GAATAAAAGTTCTTAAAAGCCTATTTCTATCATTAACTAACTCCAGGCTTCACAATGAGAACAGTGAAAA
TATAGTTTCTTTTTCCTGAATCCCATAATTAGAACTACCTTGCAGTTCATATTGTGGACTTCTGTTCATT
TTCTTCTCTCCAGCTCCAGCATTAGCTCATTTATCCAATCCTATGTTATCCCCAGTTGTCTCCACCTCCC
CTCCACCCCCTAGAGTTACAGAGACCTCATATTACCAGGTGTTTGAACTACAGGAGTTATTGCTACATTT
TGCTCCCCATTCCAGTCCAATTGTACCTGACAATATTCCAATTTCAAATCCATTAAGTATAAACTGTTTT
AAGAATGGCAAAGTATAGGCTCAAAATAAAGAGATGGAGAAATTATTTACCAAGCAAATGGAAAGAAAAT
AAAGCAGGGGTTTCAATCCTAGTCTCTGATAAAACAGACTTTAACAATGATAAAAAAAATACAAAGAAGG
GCATTACATAATGGTAAAGAGATCAATGCAACAAGAAGAGCTAACTATCCTAAATATATATGCACCCAAT
ACAGGAGCACCTAGATTCATAAGGTAAGTTCTTAGAGACCTACAAGGAGACTTAAGACTCCCACACAATA
ACAGTGGGATACTTTATCACCCAACTGCCAATATTAGACAGATCAACAAGACAGAAAATTAACAAGGATA
TTCAGGACTTAAACTCAGCTCTGGACCAAGTGGACCTAATAGACATCTACAGAACTCTCCATCCCAAATC
AACAGAATATACATTCTTCTCAGTGACACATAGCATGTATTCTAGAATTGACCACATAATTGGAAGTAAA
ACACTCCTCAGCAAATGCAAAAGAACAGAAATCATAACAGTCTCTCAGGCCACAGTGCAATCAAATTAGA
ACTCAGGATTAAGAAACTCACTGAAAACTGCACAACTACATGGAAACCGAACAACCTGCTCCTGAATGAC
TACTGGGTAAATAATGAAATTTGGGCAGAAATAAATAAGTTATTTTAAATCATTGAGAACAAAGACACAA
CGTACCAGAATCTGTGGGTCACAGCGAAAGCAGTGTTTAGAGGGAAATTTATAGCACTAAATGCCAACAG
GAGATAGCAGGAAAGATCTAAAATCGACACTCTAACATCACAATTAAAAGAAGTAGAGAAGCAAGAGCAA
ACAAATTCAAAAGCTAGCAGAAGACAAGAAATAACTAACATCAGAGCACACCTGAAGGAGATAGAGACAC
AAAAAACCCTTCAAAAAAATCAGTGAATGCAGGAGCTGGCTTTTTGGAAAGACTAACAAAACAGAGAGAC
CACTAGTCAGACTAATAAAGAAGAGAAAAGAGAAGAATCAAATAGACACAATAAAAAATGATAAAGGGGA
TATCACCACTGATCCCACAGAAATACAGACTACCATCAGAGAGTACTATAAACACCTCTATGCAAATAAA
CTAGAAAATTTAGAAGAAATGGATACATTCCTGGACACATACACCATCCCAAGACTAAACCAGGAATAAG
TTGTATCCCTGAATAGACCAATAAGAAATTCTGAAATTGAGGCAGTAATTAATAGCCTACCAACCAAAAA
AAAAGCCCAGGACCAGATGGATTCACAGCCAAATTCTACCAAAGGTACAAAGAGGAGCTGGTACCATTCC
TTCTGAAACTATTCCAAACAATAGAAAAGAGGGACTCCTCCATAACTCATTTCATGATGCTAGCATCAT
CCTGATAAGAAAACCTGGCAGAGACAAAACAAAAAAAGAAAATTTCAGGCCAATATCTTTGATGAACATC
AATGTGAAAATCCTCAATAAAATACTGGCAAACCGAATCCAGCAGCACATCAAAAAACTTAACCACCAT
GATCAAGTTGGCTTCATCCCTGGGATGTAAGGCTGGTTCAACATATGCAAATCAATAAACATAATCCATT
ACATAAACAGAACCGATGACAAAAACCACATGATTACCTCAATAAATGCAGAAAAAGGCCTTCAATAAAA
TTCAATACCCCTTCTTGCTAAAAACTCTCAATAAGCTAGGTACTGATGGAATGTATCTCAAAATAATAAG
AGCTATTTATGACCAACCCATAGCCAATATCATACTGAATGGGCAAAAGCTGGAAGCATTCCCTTTGAAC
ACTGGCATAAGACAAGGAAGACCTCTCTTACCACTCCTATTCAACATAGTATTAGAAGTTCTAGCCAGGG
CAATCAGGCAAGAGAAAGAAATAAAGTGTATTCAAATAGGAAGAGAGGAAGTCAAATTGTTTCTGTTTGC
AGATGACATGACTGTGTATTTAGAAAAGCCCATCATCTCAGCCTGAAATCTCCTTAAGCTGATAAGCAAC
```

FIGURE 491 cont'd

TTCAGCAAAGTCTCAGGATACAAAATCAGTGTGCAAAAATCACAAGCATTCCTATAGACCAATAATAGAC
AAACAGCCAAATCATGAGTGAACTCCCATTCACAATTACTACAAAGAGAATAAAGTACCTAGGAATAAAA
CTTACAAGGGATGTGAAGGACCTCTTCAAGGAGAACTACAAACCACTGCTCAAGGAAATAAGAGAGGACA
CAAACAAATGGAAAAACATTCCATGCCCATGGATAGGAAGAATCGATATCGTGAAAATGGCCACCATACC
TCCCAAAGTAATGTATAGATTCAAGGCTATTCCCATCAAACTGCCATTGACTTTCTTCACAGAATTAGAA
AAAACTACTTTAAATTTCATATGGAACCAAAAAAGAGCCCTATAGTCAAGACAATCCTAAGCAAAAAGAA
CAAAGCTGGAGGCATCACGCTACCCGACTTCAAACTATACTACAAGGCTACAGTAGCCAAAACAGCATGG
TACTCATACCAAAACAGATATACAGACAAATTGAACAGAAGAGAAGCTTCAGAAATAACACCACACATCT
AAAACCATCTGATCTTTGACAAACCTGACAAAAACAAGCAATAGGGAAGGGATTCCCTATTTAATAAATG
GTGTTGGGAAAACTGGCTAGCCATATGCAGAAAACTGAAACTGGACCTCTTCCTTATACCTTATACAAAA
ATTAACTCAAGATGGATTAAAGACTTAAACATAAGACCTAAAACCATACAAACCTTAGAAGAAAACCTAG
GCAATACCATTCAGGACATAGGCATGGGCAAAGACTTCATGACTAAAACACGAAAAGCAATGACAACAAA
AGCAAAAACTGATGAATGGGATCTAATTAAAGTGCTTCTGCACAGCAAAAGAAACTATCATCAGAGTCAA
CAGGCAACCTACAGAATGGAGAAAAATTTTGGAATCTATCCATCTGACAAAGGGCTAATATCCAGATTC
TACAAGGAACTTAAACAAATTTACTAGGAAAAAAAAAAAACTAACCCCATCAAAAGTGGGCAAAGGAT
ATGAGCAGACACTTCTCAAAGGAAGACATTTATGCAGCCAACAAACATATGAGAAAAGCTCATCGTCAC
TGGTCATTAGAGAAATGCAAATCAAAACCACAATAAGATACCATCTCATGCCAGTTAGAATGGTGATCAT
TAAAAAGTCAGGAAACAACAGATACTGGAGAGAATGTGGAGAAATAGGAATGCTTTTACACTGTTGGTGG
GAGTGTAAATTAGTTCCACCATTGTGGAAGACCGTGTGGCAATTCCTCAAGGATCTAGAACCAGAAATAC
CATTTGACCCAGCAATCCCATTACTGGGTATATACCCAAAGGATTATAAATCATCCTACTGTAAAGAGAC
ATGCATACGTATGTTTATTGCAGCACTATTCACAATAGAGAAGACTTGGAAGCAACCCAAATGCCCATCA
ATGATAGACTGAATAAAGAACATATGGCACATATACACCATGGAATACTATGCAGCCATAAAAAGGATTA
ATTCATGTCCTTTGCAGGGACATGGATGAAGCTGGAAACCATCATTCTTAGCAAACTAACTCTGGAACAG
AAAACCAAACACCACATGTTCACACTCATAAGTGGGAGTTGAAGAATGAGAACACATGGACACGGGGAGG
GGAACATCACACACTGGGGCCTTTTGAGGGTTGAGGTGCTAGGGGAGGGATAGCATTAGAAGAAATACCT
AATGTAGATGACGGGTTGATGGGTGCAGCACACCACCATGGCATGTGTATACCTACGTAACCTGCACATT
CTGCACATGTATCCCAGAACTTACAGTATTAAAAAAAAAAAAAGAGTGGCAAAGTAATGTCAGAGAAA
TGATGGAGTAGGTAGCTTCAACGGCCCATCCTTCCACAGAAACAAAACAACAAAAATGATTTTAAAAAA
CTGTCAGAATCAATGTCATCAGAACTCTGAAAAGTAGTCCAAGGTTTACAGCAACCCAGGGAATGTAGAA
TAGAGAAAACAGCAACTTAAAAATAGTAGGGGAGCTTTGTGGTGCTTTCACTTGCCCTTGATTTACTTTT
CTCTGCAGCTGGGTGATGGTCTTGAAGGTGACAGCCTATATTACCAGTGTAGGACACTGATCTCTTGCTC
CAGAGGCAGTGGAGCAGAACTTGTTCTCAATTGTGTTTGTCTGTTTTGAACTGTCTGAGGGCTACCTGAA
AGACTGTTGCAAGTTACTTGGTTTTATCTTATCTAACTTGGAATTCTATCATGGTGGAAAAGTGGCTAAT
TGAAGAGTACATTCCTCTAAATCATTGAAAGGCAAATGAACAACCCACTGTCACTTGAGGTAAGAGATTA
CTGTTGAAGCAAACAATATACAGAATGACAACTTGGGAGGAAAAATCTGGGGAGAGATTCTGTGAGGAA
GTAGGGTATTGAAAAGCTCCCCACATACACCAGGAAATTTAGAAAGGCATGCACATACTCAGAGGAGAAC
ATATGTTCAGAAATGACCTGAAAAAACTGCAAGCTTTCACCTCTGACTGATCTTTGACTTAGTGCAAGCA
GTAAGGGAAGGCTTTGGCAGAGTTGTAAATGACCTGGCTAAGCACCGAAAGAGGGCTCCAACAAAGAGTC
ATTGCGCAAAGAGTGGGCAAATATTTTTCCTTTTTTGTTTGTTTTTCATCCAGACATTCAAGGAAATCCC
TGTTAACACACTGGGTAAAATAAATGAAAGAATAGAGGCCTTAGATACCACACAATACAGGGAATACC
AGTTTTACAAAAAAGTAGTTTAGAAAACTCACTATTCATTTCCCAGAGCTGCTCTTACCACATGGCACA
AAATTGGGTGGCTTGAACAACAAAAATTCATTCTCTCCCAGTTTTCTCCAGGTTAGACCTCCAAAATCAA
AGTGTCAGAAGGGCCATGCTCTCTTTCATTACCACTTAGTAGCTTCTGCTGGTATCCATTGATCTTTGAT
ATTCCTTGGCTTTTAGCTGTATCACTTCAAGCTCTGTCTCTGTGGTCACATGGCATTCTCCCCATGTGTT
TCAGTCTTAATATGGTATGTTACTCTTCTAATAAGGACACTGTCGTATCGAATGAGGGTACACCCTAATG
CCCTCATCTTGATTGCATCTTCAAAAACCCTATTTCAAAGTAAGGTCATGTTCACAGGTTAGGACTTCAA
CATATCTTTTTGGGAGACAAAATTAAACCTGTAACAGTCACTAAACAAACCATTACGATCCACAATAAGA
TAAGAACAAACTGAGCAGGAGGAAGAATCTGACTTTAAGAGATACCACATTATAAAACAAACAAAAAAA
AGTACACAGCATGCAAATAAAAAATTATGGTCCATTCCCAGAATAAATGAACAGAAACTGTCCCCAAGGA
AACACAGACACTGGACTTACCAGACAAAGACTTTAAATAAACTGTCTTAAATATTCTCAAAGAACTAGAG
GAAACCATGAACAAAAATAATAAACCAGGAGAATCATGTCTGAAAAAAGATATCAAATAGGTAGAAATT
ATTTAAAAACCATGAATTTTGGACCTGAAGAGTATAATAACTGAAATGAAATTCACTAGAGGATTTCAA
CAGTATATTTAAGCAAGCAGAAAATCAGTGAACTAAAGGATAAGTAAATTGAAGTTATTCCATCTGAGG
AGCAGAAGAAAAGTAAGTAGAACTCAGATACCTGTGGGATGCCATCAAGCATATCAGCATATGCACAAT
GGGAGTCACAATAAGAGGAGAGAGAAAGGAGTATAAGGAATATTTGAAGAAATAATGTTCAAAAACTTCT
CAAACTTATAAGACATGAATCTACACATAGAAGAGCTCAAGGAACTAACTCCAAGAAGAATAAATGCAT
AGAGATCCACACCAAGACACATTATAATCAAACCATAAAAGACAGAGACTCAAATCAACAAGAGAAAG
TGACACCTCATGTTCAAAGCCTCTATAATAAGATTAATAACCCATTTCTCATCAGAAACCATGATCTCCA
GAAGCCAGTATGATGACATATTTAAAGTAATGAAATAAAAAAAACCTGTTAGCCAAGAATCCTATATCTG
GCAAAACCATCCTTCAAAAATGAAGGAGAAATTAAGACATTCCTAGATAAACAAACACTGAGGGAGTTCA
TTGCTAGTTGGCCTGCCCTACAAGAAATACAAAATACTTCAGGCAGAAGTGAAAAAACACTAAATCTTGA

FIGURE 491 cont'd

```
AGCCATATAAATTAATAAAGAACACTGGTAAAGTAATTACATAGGTAAACACAAAAGCCAATATTATTGT
ATTATTGGCTCATAACTCCTATATGATTTAAAGAAAAATGAGTAAAATAGTTACAAATCTATGTTAATGG
GGCACACAATGTATAAAGATGTAATTTTTCAAATCCTAAAGGGAGGAGGACAGAGATACGGGAGCAGGAT
TTTTTATATTTTGGAAGCTAGGTTAGTATTAATTCAAGCTATATTAACTTCTTTAATGTATTACAATATA
GTTTGAATTAATACTATTCAACACTTTTGCATCTTTAAATTTTTTCATAATAAAATTTGGAAAAATAGGC
CAGCTGTGGTAGCTCACATCTGTTATCCCAGCACTTTGGGAGGGTGAGGCAGGAGGATTGCTTGAGGCCA
GGAGTTTGAGAACAGCCTGGGCAACATAGTGAGACCCTGTCTCTACAATTTTTTTTTAATTAGCTGGGT
GTGATGGCACATTTTTGTAGTCCTAACTATGCAGGAGTCTGAGGCTGGAGGACCACTTGAGCCCAGGAAT
TTGAGGCTGCAGTGAGCCAAGATCACACCCATTGCACTCCAGCCGGGGTGACAGAGTAAGACCTTGTTTC
AAAAAAGAAAAAAGACGTTAACTGTATACCACAGGGTAATCACTAAGAAAATATACAGAAAGGGAATA
AGAAGAAAATTAAATGGTACACTACAGGTCGGGCATGGTGACTCACGCTTGTAATCCCAGCATTTTGGG
AGGCCAAGGTGGGTGGATCACTTTAGGTCAGGAGTTCAAGACCAGGCTGCCCAACATGGTGAAACTCTGT
CTTTACTAAAATACAAAAATTCGCTGGGCATTGTGGTGCATGCCTGTAGTCCCAGCTACTTGGGAGGCT
GAGGCATGAGAATCACTTGAACCCAGGAGGCAGAGGTTGCAGTGAGCTGAGATCACACCACTGCACTCCA
GCCTGGGTGACAGAGTGAGACCCTGTCTCAAAATGGAAAAAAAAGAAAAGGTACGCTGCAAAACATC
AAACAGAAAGAAGGCATTAATCAAGAGACCTAGGAAAGAAGGCATTAATCAAGAGACCTAGGAACAAA
AAGATAAGCCATGTAGAAAACAGATCACAAAGTGAAAGAAGCAAGGCCGTTTTAAAATCAGGAATTAATT
TAAATGCAAATAGATTAAGCTCTCCAGTTAAAAGGCAAAATGGACAGAATGGATAAAACAGCATGATCC
AACTATATGCTGTCTATAAGAGACTTATTTGCAATCCAAAGACAAAAAATGTTGAGTGAAAAATGGAAG
AAAATTATTCCATGCAGGATGTAAAAAAAGAGAACTGAAGTAATTGTATTAATATTAGACAAAATCGACT
TAGGTAAAAAACTTGACAAGAGACAAACAATGACATTATATATTGACAAAAGAGTCAATCCATCAAGAAG
ATATAACAATACAGACATTACACAGCTAGTCCCCAAATATATGGTGTGAAAATTGATGGAACTGAAGGGA
GACATAAATATTTCTACAATGTTTTCAGACTTCAGTATCTCACTTTCAATAATGGATACAACAACCAGAC
AAAAGATCAATAAAGAATTAGAGGATTTGGAAACATAAACCAAACTCCTAGCAGATATATACAAAGCACC
CCACCTAAAACCAGCAGAATACATATTTTTCTTAAGTGGTCATGAAACATTTTCTGGGATAGATCATACA
TTAGGCCACAAAACAGGTCTCAATAAAAATAAAAAATCTCACGTATCAACAGAAAGATAAAGTCACATGA
AATGTATTCTCAGGCCACAAAAAATGAAACTCAAATCAGTAATGAGGAAACTGGAAAATTCACAAATG
TGTGGAAATTAAACAGCACACTCATAAAAACCGATGGGGATAGAAGTTACAGGGAAATTAGAAAATACTT
TGAGATGAAAACAAAACATGATTCAGGATTCCTTTGGTGCTAAAATAATAAAATTCTGCTGACTGAGCTA
AAAAAATTTGTGATAGAAAATATCAAAGGCAGTTCCCCACTCTATACACAATACCCACCCCCATAACTTA
AATAAAACAACTTTCTCCTTTCTAGAGAAAATCACATTGGAAACAAAGCCTCTGCAAGAAGTCCTGATAT
ATGTGCTTTTACAAGGCTGCTAAATATTACTTCATTTTTGATACCACATTGACTTGATCTATTGATGATC
ATTCTATTGCATTTATCATCTCAAGAGCAAGCTGAGTGGATACAAAAAAAAATTTAAATTGAAATAAGGG
AAGAAGCATTTTCAAGATATAATTTAGATGTTGTTTTTTCCAAATTACAATACAGTTGGCTCTTGAACA
ACACAGGTTTAAACTGCATGGGTCCACTTATATGTGAATTTTTTTCAACAAATATATTGCAATTTTTT
TGGAAATTTGCAACAATTTGAAAAAGCTCACAGATAAGCCGTGTAGTCTAGAAATATCAAACAATTAAGA
AAAATTTAGGTATATCATGAATGCATAAAATATATGTAGATATTAGTCTATTTTATCATTTACTACCATA
AAATATACATGAATCTATTAAAAAAAGGTAAAACTTATAAAAACTTACACACACAAACACAGACTGTACG
TTCACAGTCAAGAGAAATGTAAAACAAAGATGCAATATTAAATCAAGCCTGCATAAAGTTAACTGTAGTA
CATGCTGTGCTACTGTAATAATTTAATAGCTATCTCCTGTCACTGTTGTGGTGAGCTCATGTGTGTAAAT
ATCTGCTTAAAATTCCAAGTAATGCTAATCATCTCAAAGTGAGCAGTTCATCTCTCTAGTAAATTGCGTA
TTACAGTAAAAGTGATCTAAAGGTTTCTTATTTTTATTGTGTTTAGTGCAATACTATAAAACTTGAAT
ACTACCATGGGACCTATGTGAACTGCCACTAGTGATGTTGCAAGTGCTCCCAAGATGCATAGAAAGTCA
TGACATTATAAGAAAAGTTGAATTGCTTGATATGTACTGTAGAATGAGGTCTGAAGCTGCAGCTGCCTG
CCATTTCAGAAAGATGGTTTATTTTGTAAACAGATGGTGTAAACTTACAGTATCAATACCGTACAGAACT
GTAAATATTTCTCTTCTTCTTGATTTTCTTTTTTTCTTTTTCTTTTTTTTGGAGCTGGAGTCTCACT
GTCGCCTAGGCTGGAGTGCAGTGGCACGATATTGGCTCACTGCAACCTCTGCCTCCTGGGTTCAAGCAAT
TCTCCTGCCTCAGCCTCTGGAGTAGCTGGGATTACAGGCATGTGCCACCACGCCCAGCTAATTTTTGTAT
TTTTAGTAGAGACGGGGTTTCACCATGTTGGCCAGGCTGGTCTCAAACTGCTGACCTAGTGATCCACCCC
CCCTTGGCCTCCCAAAGTGCTGGGATTACAGGCGTGAGCCACTGCACCTGGCCCCTCTTGGTCCCTCTTG
GCTGGGCAGGGCGGTAGCCTGTTTCCGCTCGGGCATTCTGGGAAGTGTAGTGCAGAAGCCGTTGCAACCT
TGTGTACTTCCGCTGCAGGAGGGCGAAGCAGCCGTCATCTATCCCCTCTGGGAGGTGAGTCAGCGCGGAA
CCTCTGCATCTACGGCGAGCTTTCCTGGCCTGGGCGTTGGACTCGCAGGTGCCTGCCCTCGCTCTCAGTG
AAGGGAAGTCGCAGAGGGCGGGGACGACGGTTTGCTTGCCCTTTGTTTTAGGGCGGTGCATGGGTCTCC
AAGTTGGGAATGGCTCCTGGTCGCACGTTTGGTTTGAAGGTCTCCCGGGCGCTCAAGTTCCCTCGCCTTC
CCCACCTTCCACACGCTCTGCTGTCTTCTGGCAATATAATCTTGGTAGTTTCTTAATTTCTCCGTTTCTC
CTCTGTAAAGTGAGTTTCATAGTAGTACCTAACTGGTAGGGGTTTCGTGAGATTTACTTAAGATAAATAG
ATGTAAAAATGCGTAGGACCGATCCTGACACACACTGAAAAGGTGGCTGGTTGTTGCCAATCTGTTATTT
CTTCCTGGAGAGGAGAGGCATTCAGTCTCTGAAAGCTTCTGTGAGCCCGCAGTGGGTTCGAGCTCCAGG
TGCAGCGCTACTCGCCCTTCTCTGATCTCTGCACCTCGCGAGGCTGTTCCTGGATTCCTAACGTGGGGGG
ACGGGGGTGTCAATTTTCTCTCCATCTTTTTATTTTTCCTTCCCTTTTAAGGCATGAGTGTGTCTCACC
```

FIGURE 491 cont'd

```
TCCATGTGGTGCCTGGGGATGTCCACTGTCATTCATCCTGGACCAGAAACAGAGTTTAGATATCTTCCAA
CCTCCTTTCCTTCCTCAGCCTTGACTAACCGGAGGGCTGCAGAGAGGAGGGTGTTGACCCCCTGGCTCTT
GGTAACATTGTCCCAACGTGAGAGGACTTAATATATGCTATTGCTATTTCTGCTTAGTTGGAGAACAGAT
TTCCCACACTCATTAGCAATATTATTTTTCCTGCTGGGCAAATGCTCAAATATTTATGGAATAAATGAGA
GGTTGGATTAGGCATGTGTTCGTGAATGAGTAATAATAAATTTGTTAATACGTTGAGTGCCAGGGTCTC
TTCTATAGGCTTTATATGCATTAATTAGCTTAATCTTCAGAACAAAGATAATATTGTAATTCCTGTTTTA
CAGATGACAACACTGATGGGTAAAACATTTATCTTCCCAAAGTAAAACAACAGGAAAGAGCCTGAACTGG
GAGTTTGAGCTCAGGCTGAGCTCAGGCAGAGTGGGTTCTTGACCTTTGTGCCACTCTCCTTCAGCCCTGA
GAAATGTCAGTCCCATGGGGGTGCAGTGACTCACGCCTGTAATCCCACACTTTGGAAGGCTGAGGCGGGA
GGATGGCTTGAGCCCAGGAGTTCAACAGCAGCCTGGGCAACATAGTGAGACTCCATCTCTACAAAAAAAT
TAAAAATTAGCCACACACCTGTGGTCCCAGCTACTTGGGAGGCTGAGGCAGGAGGATCGCTTGAGCCCAG
GAGGCAGAGGTTGCAGTGAGCTGAGATCATCCCACTGCACTCCAGCCTGGGCAAGAGAGTGAGAGTCTGT
CTCAAAAAATTAAAAGAGGAAAAGAAATGGTTTCACAGTTTAGGCAATGACTGGGGATGCTCAAGAG
TCATAATAAAAAAATTTTTTAAGGATTTGCAGGGAAGAACTCTGAGGAGATGACATTTGAGTAAATAC
CTGACACTGCTATTAAATAAATAAATAGATAGGGTTTACATTATCCACAGTCTATGGATTGACCCTTTT
ATGAATGATTTCACTTTTTTTTTTTTTTTTTTTGAGACTGAGTCTCCCTCTGTCTCCCAGGCTGGAGT
GCAGTGGCACGATCTCAGCTCACTGCAACCTCCCACTCCCAGGTTCAAGTGATTCTCGTGCCTCAGCCTC
CCGAGTAGCTGGGATTACAGATGCCCGCCACCATGCCTGGCTAATTTTGTATTTTAGGAGAGATGAGG
TTTCATCATGTTGGCCAGGCTGGTCTCGAACTCGTGACCTCAAGTGATCTGCCTGCCTTGACCTCCTAAA
GTGCTGGGATTACAGGCGTGAGCACTGCGCCTGGCCTAATGATTTCACTTTTAAGGATGACCTTGATGTT
GCTTGAGCAAAGCAAATGAAATTAAAAACGCAGAAGAAATTGACATATAAAGTTCATCCTCTCCTCCTCC
CAATTAATTTAATAGCCTGAGAATTTTGTAGCTTAAAGGAATCTTGGAGATCAATTAGTACAATCCTTGT
CTGACTGTGTGTCATTCTTTGATTCTGTGTGCATCAAATACTCACTATATTCTAGGTGCTTGGGGTAAAA
AGATGAGTAATGTTCATTATCTCACAGGCAAAACAGATGCTTGATTTACTAATTATACCCCAAATGCCCC
AGCTACGCTGAAGGCTTCCAAGAGGAGGGATTACAAGAGAAGGACAGGGAAGCTGGTCCTCTCTGGAGGC
AGAGTGGCAGGAGCAAAGGCACGAGAGGACTTGACAACCTAGGAATGAACAAAGTCTGGAAATTCAGGCC
TCGAAAAGTGGCCCTGGTACATGTAGTGAGCAGAGCTGAGCCAGGCACCCCAAACCCCATTTGTTTTTT
CTACTAAATGTCGTGAAATGTCAAGTCTTGCAAAATCCTGTTACTGAGCAGAGCAGGAGGGTGCAGGTAA
ATATAGGACCAGAACAAAGGGAATTGGATATTAAAAATTGATCTCTCTCCCTAGCTTTCAGAAGAGAATA
CATTGCTCTCGTCCCTACTAGAGTGTTTCTGCCTGAAGTAGGAGGACCCACGAACAGGAGTAGCTATCTG
TATTGAATGCTATCTTGTATATACTCACTGAAACCTCTTAATAACCCTACGAGGTAGATACTGTTATTGT
CCTCACTTTATGGGTGAGGAAATAGGCACAAAGAGCTAGTAAGTCAGAAGAGTCAATTAGGATATTAGGT
TCCTCATCATCTGGCTCCAGTATCCCTCAGCAGATCATTTTCAGCAGTTCATACCCTCCAACTTCCCCTT
CTCTGATCTCTAAGACATGATTCCTTCCATGTCTTCATATTTCTGATTAGAGAAGGAGACACGATTAAGA
GACAGGCTCTGGACTCAGCTGGATTCAGATGCAGTCTCACCTCACCAGCTCTGTGACCTTGGGCAACTTA
ATCTCAGTAATCCTCAGCTTCCTCATCCATTAAATGGGAACGACAGTCATCATATCATCACTTATTGAGA
GCTTATATAATGTGCCACAGACAGAACCAAGGCTTTTACCCCATTTAAAAAATTGAGTCATAATTCATAT
ACCATATAATTCACCCTTTTAAAGTGTGCAATTCGGTGGTATTTAGTGTATCCACAATGTTAGGTTGTAC
AACCATCACTATTTTCTAATTGAAGAACATTTGTATCACCCCCAAAAGAAACCTCATATGCCCTAGCCAT
CACTCTTTACTATCTCTTCTCTCAGCCCCTGGCAACTATTACTTTTTGTCTCTATGGTTTAGCCTAGCCA
AGACTATTCGATTTGCTCATTAATCCCCAAAGCAACTGTAAATTAGAATCTGTTATTAGTACTACAGTAT
TTTTCATTTAAGTGAGACAGATACTGTCAAACTTTTGTTTAAAAAAAGCTAGCAGAGACACATTTTAAA
TTAGTATTTCCTTACGACAGTGAGCACGGGAAAGGGAGATACACCATTGAGACTCTCCTGGCTACATGAA
GAAAATTCATAAGTATTTATACCTTTTACAAAACTGAATGCTGATATCAATTAAATATTATAGGACAACA
AAGTAGTAAGTAATATAGCCAATCAGAATTATAGACTTTTCAGAGGTAAAGGTGAATTTCATAAGATAAA
GCATTGTACAGTCTTTGAAATCTGGATGTTATAAAAGACTCTCTTATTGGAAATGATGGCAAAAGACATT
TGCAACAACAATTTTATGATGCATAATATCATCTGCTTTTCTGCAGCTTGCAGGGAAATCAGTTATACGA
GTTTCCATCTGTTCACACATTTAACCCTTACAATAATCTTGCAAGAAAGCACTATTTTTCTCATTTGCAG
GTGACAAATTTGAGGAATGGGGAGGTTAATTAGCTTAAACAGAGTTAGTAGCCATGCCAGGATTTGACCC
CAGACCTTGTGACCCCAGAATCCACTTTTGTAGCCAGTACATTCTGCTGCAAGTAGCTGGGATTACAGGT
GTGTGCCACCACACCCAGCTAATTATTGTATTTTTTGTAGAGATGGGGTTTCGTCATGTTGCGGGCTAG
TCTCGAACTCCTGACCTCAAGCAATCTGCCTGCCTCGGCCTCCCAAAGTGCTGGGATTACAGGCATGAGC
CACCATGCCCGGCCACCTTTTAAAAATTCAGCCAGCACAGCCATGTGGGCTAGGGCCTGTTTCTCATGGC
TTCTTTCTCTTTTCCCAGTTCTGCCTTCCCAGGACCCTGCCCTTCCCCAGAAGGAGCAGGAGAAAATGAC
CAAGTTTCAGGTGAGTTGAGTTTTGATTTTTATCTCTTAAAATGACATCTCTTTTCCTCAAAGATTAGAC
ACTTTTTTTTCTCTTCCTTGGGAAAGATAAAGGAGGAAAACAGGTATTTGGAATCTGCTAGTTACTTGAT
TTTCGATTGGTTCAATTTTTTGTTTATGTCTTTAGCTTTTGTTTTGGTAGTTTTATTTTATCATCTTTAT
TTCACAAGTAGTAGTGCAAAAATTCGTAGATATCAAAAAATGGGAGAAAACCTCCACATTACTACATTGC
ATACAAATAATCTATTTCCCCCATACTATTTTATATGTATTTACATATTGTATGTCTTATATCTATACTT
GTCAGTGTATTTTAAAGAACTACAATCACATTCTATATACAATTTTCTTTTTTCAGTTAATGTTGTTACT
AGAGTTTTATATGATTTAGTGTTCCTTTATGTATTTGTCTCAGAAGGGTTTTCATTTTTTGTCTAATTTT
```

FIGURE 491 cont'd

```
TCAGAGGCTACAAAACAAACACACAATGCTGTCTCTAAATAGTATTTCAATTTGCAAGACTTTTTCATGG
GGCTTTAAAAATGCAATATTTACTTACAAAAATTATATATATCTTAAGTGGTCAGGTCAATAACAGTTTT
ATATCCCACTTCGACAGTTGTATAATTGCATTAGCCCACCATTCAGAACAAGATATAGAACATTTATATT
ACCCCAAAAAGGTCCCTCCTGTCTCTTTTCAAGTCAGTTCCTTACTCCCCAGAGGCATCCTCTGTTATCCC
TTACCCCCTTCTCACCCTTTCCCCCTGAGGCCCTAAAGTCCATTGTGTCATTCTTAGACCTTTGGATCCT
CATAGCTTAGCTCCTACTTATGAGAGAGAACATACGATGTTTGGTTTTCCATTCCTGAGTTACTTCACAG
AGAATAATAGTCTCCAATATCATCCAGCTTGCTGCAAATGCCATTAATTCGTTCCTTTTTATGGCTGAGT
AGTATTCCATCATATATATATACACACACACACACACACACACACACACACACACACACACACCACGG
TTTCTTTTCTTTTGTTTTTTTTGAGACGGAGTCTTGCACTGTTGCCCAGGCTGGAGTGCAATGGCGCGA
TCCTGGCTCACTGCAACCTCCGCCTCCCAGGTTCAAGCAATTCTCCTGCCTCAGCCTCCCGAGTAGCTGG
GATTATAGGCACCTGCCAACATACCCAGCTAATTTTTTGTGTTTTTAGTAGAGACGGTGTTTCACCATGT
TGGTCAGGCTGGTCTTGAACTCCTGACCTCGTGGTTCACCCACCTCGGCCTCCCAAAGTGCTGGGATTAC
AGGCGTGAGCCACTGCGGCCGGCCACACAGTTTCTTTATGTACTCATTGATTGATGGGCATTTGGGTTGG
TTCCACATTTTTGCAATTGCAAATTGTGCTACTATAAACGTGCATGTACAAACACCTTTTTCAGCGTTGG
GACTAAATTGACCCAACATTTCTAGGACAATTTGGTAGTATCAGTCAAGTTATAAAATACGTATTCCGTG
TGATTCAAGATTTACAGTGCTGGGGCATTTACTGTTGGAATACTTACAAATGTCACCAAATTAAATACAC
AGGGGTTATTTTTTAGTAGCACACACTTTTGATGTGACTGTGGAAAAGTAGTCTATGAGATTGGCATGTG
GGATGGAGAAAACGAGGAAGCTACTTAAAGTTCATTCGAGGCCCTCACAATCCAGAACGTCTTCCTGCCT
GTTCTTTCTACCTGCTCAGTGCTGCCTCTCTCCCAGCAGTTATTGGCCATAAGATTGAGATTACATCTGC
TTGATGTTGTAGGAGATGGTGACATTCAAGGATGTGGCTGTGGTCTTCACCAGGGAGGAGCTGGGGTTGC
TGGACCTTGCCCAGAGAAAGCTGTACCAAGATGTGATGCTGGAGAACTTCAGGAACCTGCTGTCAGTGGG
TGAGCACAGGCACCTTCTGTAACTGAATATCAGCCCTCTGGACTGTCCTGCTTTCAATTATTTAAGACTT
TGGGACGCTTAAAATGCTTCCCTGAACTTGGGGATGTGAATTTTCTAATTCCTCAGGGACATCTTGTCTA
TACCTTGTCTATTTTTCTCAAATTGCAGTTGTGAAATCTTGGTGGGTTTTGAAATCAGTTGGTGAGTTAC
ATTATTATTGTGTTTAATGAAATGAAGTAGAAATATTATAGCTCCTTGTCAGGAACTGCATTCAGTGCAA
CGAAAATTGTAAGTAAAAACAGGAAAGAAGATGTGATAAAAGTAGATAATGGTTAGGATCAAATTATCTG
ATCACTTGATTTCAGTGATTTACATTTATGTATTTGTGTACCGGATCACAAATTAAAAGGTATTCAGACA
ATAGCTCATGATCACAATTTTGAAAAATACTACTTAGAGCGCATGAAAATGGTGGTGTTGGAATTAAAAT
TTTTGACTATAATGCATTCACTTTATATATATGCCATTTCTTTTTCACAGGCTATCAACCCTTCAAACTA
GATGTGATATTACAGTTGGGAAAAGAAGACAAGCTTCGGATGATGGAGACAGAAATCCAAGGAGATGGGT
GTTCAGGTGAGAACCATGGAGCTCTGAGTCTTTGCGGGGTACAGCCTAGTCCTCTCCTCCTCACCACCTC
CTCAGCCACCAGCCTGGCCCAAGACCCCAGAATTCATCGCCCTGGTTTACTGCAGCAGCTTGCACATGAC
CTTCCTCCTTCTACCTCCCTCCAGTCCATTCTCCACATAGCCAGATCATGTAAGTCAGATCATGTCGCTC
CTTGGCTCAAAAGCCTTCTGTGACTTCCCATCTCACTCATTAATTCCAAAATCTCTACGAGCCTTCAGGG
TCCTATGTGACCTGGTCACCCACTCCCTGTGAATTGATTTCCTATCCTTTGCTTTTCACTCAGTTCTTTC
CAGCCACACAAGACTGCTGTGTGTTTCTTATACATGCCAAGGGTGCTTTTTTTTTTTTTTTCTTTAAG
ACAGGTCTCACTCTGTGACCTAGGCTGAAGTGGTGGTGCAATCATGGTACACTGCAGCCTCGACCTCCCA
GGCTCAATCGATCTTCTCACCTCAGCCTCCTGAGTAGCTGGGATGGGACTACAGGCACTTGCCACTATGC
TGGACTAATTTTAAAACTATGTATATACATGTTTTTTTTTTTTGGTAGAGATGAGGTCTCACCATAT
TACCCAGGTTGGTCTCAAACTCCTGAGCTCAAGCAATCCTCCCACTTCAGCCTCCCAAAGTGTTAGGATT
ACAGGCATGAGCCACTGTGCCCGGCATACATGTATTTCTTTCTACCTGAAGCCTTTTGCTCTTCTGTCTG
CCTGGGATGTTCTTACCTCATACATCCTCTTGGCTCCCAGCCTACTTCCTTTATGTCTGGTCAGATGTCA
TCTCATCACAGAAACCTGCTTTTTTTTTTCTTTAGACGGAGTCTTGCTCTGTCGCCAGGCTGGAGTGCT
ATGGCGCGATCTTGGCTCACTGCAACCTCTGACTCCCTGGAAAACTGCTTTGACTACCCTGTTTAAAATA
CCTATCCTTGGCTGGGCGTGATGGCTCATCCCTGTAATCTCAGCACTTTGAGAGGCCAAGGTGGCAGGAT
CACTCGAGGCCAGGAGTTTAAGACCAGCCTGGACAACACAGTGAGACCGCACCTCTATAAAAAAATTTAA
AAAATTAGCTCACAGCTATAACTGTGCCACTGCACTGTAGCCTGGGCGACAGAGCAAGACCCTGTCTCAA
AAATACATACATACATACATACAATACATACATACATACATTTAATTAAATTAAATACCCATCTCTTTATT
CTGCCTTTGTGATTAATCATCAATCATCAGCTGACATATTCATGTATTACATTTTGTTTACTTTTCTATG
GTCTCTTTCCCCATTAGAGTACAACTTCATGAACGTAAGAATTTTACCTGTTTTCTTTTTCATTTTTCTTT
TTCTTTTCTTAGAGATGGGGGTCTGGCTTTTTCACCTAGGCTGGAGTGCAGTGATACAATCATAGCTTGC
TGCAGCTCAAACTCCTGGGCTGGGACTACAGGAGTGCACTACTGTGCCCAACACTAATATTACCTGTTTT
AAAATTGCTGATCCTTATTGCCTTTAATAGGCTTGGCACGTAATACCTGTTCATTTAATATTTGTCGAAT
GAGTGACTGAATGAGTGAATGAATGGGTTAATGGACCGATGTCAGTAACGTCAGTTAATGGACTAATGGA
TAGGTGTTTTCATTTGAATAGTACTGTAATGGCTCCCTCACAGATCTCCCAACCTGTGGTATCTGCGAGA
CTTTTGGTGAGAGTTGCCTCATCCATACACCCAGTGACAACCTCCCTGTTCTGCTTTCACCCCTCTCCTT
CTATTCTTTCTCTTCCTTATTTCATTCCCCCTTTTCTTCACTTCTTCCTTCATTTATCTTTAATTTGAAT
ATACATCATAAATACCTAAAATACACTAATTAAAGTCATTCCTACTTGATAGAAGCACCAAAACGCAAAA
ACTAAATTAAACAAACAAAAAAGCAAACCAAAAGCCCAGGAGAATCTCTCTGCTTATCTGAGAGAGACA
GGCCCTGGATTTTGTAAGTAGCTGGAGTAGTAAAATCTTTCCAATCTTCTTATCTTTTATTTTCTTGTAT
CTCCATGCTCCATGAACGTTGACTGCATTGCAATCAGGAATGTTGGATGCTGACTTCTTTGACTGACTGC
```

FIGURE 491 cont'd

```
CTCATTTTTAAAAATTTTCTTTTTTTTGTTTTTGACTGCCTCATTTTTGTGTATAAACCTAAAACTTGGGA
ATTATGATCCCAGTTATTGCCATTGTCCTTTTTTTTTTCTTAACAGGTAGCTTCTTCCCAACTTCTTCT
TTGCCTCCTTAGCAAATCTTGACTGTTTTTGTTTTTTTTTCTTTTTTTGAGATGGAGTCTCGCTCTGTT
GCCAGGCTAGAGTGCAGTGGCGCAATCTTGGCTGGCTGCAACCTCTGCCTCTCAGGTTCAAGCGATTCTC
CTGCCTCAGCCTCCCGAGTAGCAGGGACTATAGGCGCATGCCACCACACCCAGCTAATTTTTGTATTTTT
AGTAGAGATGGGGTTTCACCATGTTGGCCAGGATGGTCTCTATCTCTTGACCTTGTGATCTGCCCACGTT
GGCCTCCCAAAGTGCTGGGATTACAGGCATGAGCCACTGCTCCCGGCCACAAATCTTTACTTTTTTTTTA
ATTTTTGGCCAATTTTTTATTGAAATATATACAGAAAACTGTACAAATTGTAAATGTATAGCTCCCTAAA
TTTTCAGGAAGTAAAATGGCTTGTTTTACAGCTCTTTTTTATTGAGGTAAAATTTACATGTGCACACCTT
AAGTGTGCAATTTGATGAGTTTTGACAAAAGGATATAACTATGTAACTCACAGCCCTTGGAAAACTGAAC
AAATCTGACAGCGTATTCTACCCTCACCTCTCTTTATTTTTTGGCAAACATCAGAATTTTTTAGGGTTTC
ACATTCTGCTTATCCACCTACGTACCCAGCTCCACCTATACAAAATATTCCTGAGGTCTATTTTCACTGG
ACAGAAGTACAAATTAAAGGGCATCTTCTCCCTCAAGGATCAATGAAACAAAATCTCACAGAGTATGGTG
CTAAGTGGATCTCACTGTCTTCACTTCTCATTGAGAGAGTTCACAGGCAGAGAATAAAGAGGTGTCACTA
AAGGACTATTTCAGAACATAGTTACTCTTCTGATGTTATGTTCAGCCTACTTATAATTTTTATGACACCT
GTGTTAGTTATCAATTATTTTATAACAAATTACTGTGAAACTTAGCACCTTGGCCAGTTGTGGTGGCTCA
CGCCTGTAATCCCAGCACTTTGGGAGGCTGAGGCAGGCAGATCACCTGAGGTCAGGAGTTTGAGACCAGC
CTGGCCAACATGGTGAAACCCCATCTATACTAAAAAAAAAAAAAAAAAAAAAAAATTAGCCAGGTGTGG
TGGCAGGCAACTGTAATCCCAACTACTGGGAGGCTGAGGCAGGAGAATCACTTGAACCCCGGAGGCAGA
GGTTGCAATGAGCTGATATCATACCATTGCACTCCAGCCTGGGGAACAAGAGCGGAACTTCGTCTCAAAA
CAAAACAAAAACCTTAGCACCTTAAAACAATGAACATTGGTTTATAGTTTCTATGGGTTAGGTATATGGG
AGCAGCTTAGCTTAACCCTAAGTGAGGGTTCTCACTCCGGATCTCAAAAGCTGTTAAAGAGTGACGGAG
CTGCCGTCCCCGAAGGCTGGACTGGGACTGAAGGACCTGCTTCCAAGGGGGCTCGTTCACATGGCTGT
GGCAGGAGGCCTCGCTTCCTTGCTAAGTGAACCATTCCCTACGGCTGCTGAAGTGTCCTCAAAACATGGC
AGCTAGTTTCTCCCAGACCCAGTGATTCAGGAGAGTGGAAGATAGAAGCCACAGTGTTTTTATGACCTAG
CATCAGAAGTGACAGATCATCACTTCTGCCATATTCTATTGGTTTCACAGACCAAACTTGATACAGTGTG
GGAGGGGCTTCAAAAGGGAATGGATTCCAATGGGAGTGATCACTGGGACCATCTTGTATTAGCCATT
TAGGTTTATCAGAAAATTCAGTCAAACCAAGTGGCAACAATTATCAATGCCTTTACTCCTATAGGGTGTG
TCAGCTATGGGAATAAGTTTTCTAATTCTTTTTCATTTATCATGTTCACTAATTGAATATTATATACTTA
GAACCTCATTGAAAAGAAGGAGAATTCTCTCAAATCTAGCTCATCAAATGTATGTTTAAGGACTAAATTA
AGGAAATAATGGTACTATCTTATGGGTTCATTCTCAAGACAGAGAAGATATTTTTCTATATTCTCTTCAC
TTTTGCCAAGGATGTCCCCTCTTTCTTTCTTTGAGAATTCTTGGCATCACTAAATAATCCACTTGTGAAT
GCTGAAGGAGAGATTCAGGCTTTTGTAACCATTTTTGGGCTTTATCATATACAGATGCAGGTTGTACAAT
GTAACCATGATTCTGAGGCTCACATATAGCCAGGATTTTGTAGATTTTATACATCTGCCACGGAAAAGAG
GAGAGGATTTTTTTTTTTTTGAGACGGAGTCTCACTCTGTAGCCCAGGCTTGAGTGCAGTGGCACGAT
CTCCGCTCACTGCAAGCTCTGCCTCCTGGGTTCACACCATTCTCCTGCCTTGGCCTCCCGAGTAGCCGGG
ACTACAGGCGCCTGCCCCCATGCCTGGCTAATTTTCTGTATTTTTAGTAGAGACGGGGTTTCACCATGT
TAGCCAGGATGGTCTCGATCTCCTGACCTCGTGATCCACCTGCCTCGGCCTTCCAAAGTGCTAGGATTAC
AGGTGAGAGCCACCGCACCCAGCCAAAGAGGAGGGATTTTAAGTGATTATTCTTATGGACAAGGAGGTA
AAGTTTCTCCTCTACAACGTCTTTCTAGGGCATCTTTTTGTTGCTCTGTAGCCTGTGTATTTGACCACAT
ACATAAGTCTTGGTATTGGCCAGGCATGGTGGCTCACACCTGTAATCCCAGCACTTTGGGAGGCCAAGGC
AGGCAGATGACTTGAGGTCAGGAGTTCAAGACCAGCCTGGCCAACATGGTGAAACCTAGTCTCTACTAAA
AATACAAAAAAATTAATGAGGTGTGAGTGGAATGCACTTGTAGTCCCAGCTCCTCCAGAGGCTGAGGCA
GGAGAATCACTTGAACCCCAGAGGTGGAGGTTTCAGTAAGCCAAGATCGTGCCACCACACTCCAGCCTGG
GTAAGAGAGTGAGACTCCATCTCAAAAAAAAAAAAAAAAATCCTCTCCTCTTTTCCATGGCAGATGTATA
AAATCTACAAAATCCTGGCTAATATGTGAGCCTCAGAATCATGGTTACATTGTACAACCTGCAGTCTCAA
AAAAAAAAAAAAAAAAAAGTCTTGGTATAGCTCTAAATGGGTCTCATTAACATTTTAGTATATAAAAGC
CAACCTTTTTTGTTCGCCATAGGTTGAAAAAAACCAATGATAGTCTGGGTGCGGTGGCTCACACCTGTAA
TCCCAGCACTTTGGGAGGCCGAGGCGGGCGGTTCACGAGGTCAGGAGATCGAGACCATCCTGGCTAACAT
GGTGAAACCCGTCTGTACTAAAAATACAAAAAATGAGCTGGGCATGGTGCAGGCGCCTGTAGTCCCA
GCTACTCGGGAGGCCGAGGCAGGAGAATGGAATGAACCCGGGAGGTGGAGCTTGCAGTGAGCCAAGAGCA
CACCACTGCACTCCAGCCTGGGTGACAGAGCGAGACTCCGTCTCAAAAAACAAAAAAGAGAAAAAAAAA
CAATGATAAAGTCAAGCTGAACTCTCCACTGGTTTATTAAGGTTTCCCAATGTGGTCAACCTGTGAAATG
TTTTTTTATTTCTGAACAAATGTTCAGTTGTCTTCATTTTCATTTCTGAGTTCTCTTTATCATTCTAGGA
CACAAGAATCAAAATGAGATAGATACCCTTCAAGAAGTAAGATTAAGATTCCTTTCATATGAAGACCTTA
TATGCTGGCAAATATGGGAACAATTTACAAGTAAATTAACCAGTAATCAAGACCTAATAATAAATCTTCA
AGGCAAGAGGTCCAAGTTGCTAAAACAAGGTGATTCCCCTGTCAGGTGTGGACAGGAGAATCTAGTCAG
GTCTCTGAAGATGAGAACTATGTAATAAAGCTACAAGGGGAGAGTTCAAATAGCATAAAAAATCAAGAGC
TTCCATTGAGGACCACCTGGGATTTCTGGAGGAAATGTATCTGAGAGAACCACAGAATTATCAGAGTAG
GTGTCAGCAAATTGATGTAAAAAATAAGCTCTGTAAATGTGATCATTGTGTTAGGCAAAGAATTGCTCAT
CAACATGATGATCATGGAGTACACAAAAGAGAGAAAGCTTTTAGCCACAATAATTGTGGAAAAGACTGTG
```

FIGURE 491 cont'd

```
TGAAGGAATCATCCCAGCATAGCATAATCCAATCAGGAGAGCAAACCTCTGATGAAAATGGAAAAGGCTT
AAGTGTTGGCTCTAATCTTGAACTTCACCAGCAACTACACTTAAGAGACAAGCCTCATGTAAATGTTGAG
TACGGGAAGGGCATAGGTTACAGCTCAGGGCTTCCCAGGCATCAGTGTTTCCACATAGGAGAGAAATGCT
ATAGGAATGGTGACAGTGGTGAGGGCTTCAGTCAGGGCTCACATCTGCAACCTCATCAGAGAGTCAGCAC
AGGAGAGAACCTCTACAGATGTCAGGTATATGCCCGGAGCTCCAACCAGAACTCCTGTCTTCCCTCTCAT
GAGCTTACTCACCCAGGAGAGAAGTTGTGTACATGTGGCAGGTGTGGGAAGGGCTTCCATCATAGCTTAG
ATTTTGACATTCACTGTGTAGACAGTGCTGGAGAGAGAGCCTGTAAATGTGATGTATATGATAAAGGCTT
CAGTCAGACATCACAACTTCAAGCCCATCAGAGAGGTCACTCTAGAGACAAGACATACAAATGGGAAGTA
AGTGACAGGATATTTAATAGGAATTCTGGTCTTCACCAGAGAGTTCACACTGGAGAGAAACCATATAAAT
GTGAGGTATGTGATAAGGGCTTCAGTAAGGCCTCAAATCTTCAAGCCCATCAGAGAATCCACACTGGAGA
GAAACCCTACAAATGTGATGTGTGTGATAAGAACTTCAGCCGTAATTCCCACCTTCAGGCCCATCAGAGA
GTCCATACAGGAGAGAAACCCTACAAATGTGACACATGTGGGAAGGACTTCAGTCAGATCTCTCATCTTC
AGGCCCATCAGAGAGTTCACAAAGGAGAGAAGCCATACAAATGTGAGACATGTGGGAAGGGCTTTAGTCA
GAGTTCGCATCTCCAAGACCATCAGCAAGTCCATACTGGAGAGAATCCCTACAAATGTGATGTGTGTGGG
AAAGGCTTCAGTTGGAGTTCACATCTTCAAGCCCATCAGAGAGTCCACACAGGAGAGAAACCATACAAAT
GTGAAGAATGTAGGAAAGGCTTCATCTGGAACTCATATCTTCATGTTCATCAGAGGATCCACACGGGAGA
GAAACCCTATAAATGTGGCATGTGTGGTAAGAGCTTCAGTCAGACTTCACATCTTCAAGCCCATCAGAGA
GTCCATACTGGAGAGAAACCATACAAATGTTTGTGTGTGGTAAGGGCTTTAGTAAGAGTTCGTTGTCTT
CAGATTCATCAGAGAGTCCATGATGGTGATGAATCTATTAATCATGATGAGTGTGATAGGGGTGCTCTTC
AAGACTTAGACTTCCCATTTTCCTCAGAAAATCCACACAGCACAGAATATTTATAAAATGTCATGTTTTA
AGAATTCATGAGCTGAGTTTTTATAGTTATCTGAATTCCATTGAAGAAAACCTATTTTTGTATGAATATG
ACCAGTTTCAAGCAGAGCCCAAAATGTCACAGTTGTCAAGAGAACACACAACAGAGAAACCCTATAAAGA
ATGATACAATATGTTTCAATCAGAACCTTCACATCCAATAAGCAATATGCAGGAGTGAAGCCTTCAAAAT
GATAAGTAAGGTCAGAATTTAGCAAAAGTATAATGAGGGACATGACAAAATCTGTGTCCACTAGAATCTA
AGCTCCATGCAGGAACATTGTTTACTGCTGCATGATCGTGACCTTGAACAAGTACCTAAGAAATAGTGGC
TTCCCTGGAATTGTTTAACTTGATAGGAAAAATCTATCATATATAGGACATATATTTGAATATTTTAGTG
AGCTCAGCCCCAATTCGTCATTATAATTGTACTGGGAAAAGGATTCTTGCAAGAAGCCTTAAAATGAATT
CAAGGAAATGACATTTAATTAAAACACATAAAACCAAGCAGTCTACAATCTGAGTAATGTTTTTGCAATT
GGCTTCTGTCCTCAGTTCAGCTTCATTTTCCAAGCAGTATAATAGGCCAAAGTTTCTATCTGATTATTTA
AGACTTTTTCCATACAGTGTACAGCTGTGCTATGTTTCTTTGGCGGGGCTTTTGCTATCTTTCTTTTTG
GGAGCTAGTGTGATAGAAACAGACTGAATGAAGAAAAAAATCCCAACTGGTTTTTAGTTCCATAAAGCTT
CATGAGAAAGGTTTTGCAAAAAAGGGGAATATCATATGGCATGCATTTTAGATGTTAAACTAAGCTGTTA
AGGACACAGCATTTTGGACAACACCCCATACTTCTCAGACATCATTACACGTTATGCAGTGTGTAATGAT
CAAATCATAGTAATTGGATGAAGGGTTTACTCAGGTGTATATTTAGTGGAGGTGGGAGAAAGTTTCCCAC
TGTTGTTTTTTTTTTTTGTCCTGGACCTTACCTTCCAGGACAATGAATACTTAAGTTCCATGATACCTC
ATTTCATGCTACCATCAGAAATACAGGGCCAATAAATGAAAAAGAAAAAATAAATAAAAAAGATAAAAAC
AAAAAAAGAAATACAGGGCCAATAATGCTTTGCTTCATCACCACCAGATTACTAGGGTGGGCTGCTGGAG
CACATGGTTGTTTAAATCAAGATGTTTTCAATTGTGAGAAATGGAAAATCACACTCCAACTAGCTGGAAC
AAAATTTATTGGTATGCATATTTAAAAAGAAGAGGCTGGGCATGGTAGCTTATGCCTGTAATCCCAGCAC
TTTGGGAGGCCGAGGCGGGCAGATCACAGGTCAGGAGTTTGAGACCAGCCTGGCCAATGTGGTGAAACCC
AGCCTCTACTAAAAATACAAAAATTAGTCGGGTGTGGTAGTTGGTGCCTGTAATCCCAGCTACTCAAGAG
TCTGAAGCAGGAGAATCGCTTGAACCCGGGAGGCGGAGGTTGCCATGAGCCAAGATGGCGCCATTGCCCT
CCAGCCCAGGGGGCCGGTATGAGACTCCATCTCAAACAAGACAAAACAAAAAACAAAAAGAATACAGGTA
GGACAGGACCAGGTCTCGTTGAAACAGGGCTCTGGGTCAATTCTTCTGTGATTCCCTCACCTCTGCCCTT
CTGGTTGAGTTGATTCCCACATTTGTTCATTCCAACCTACTGAGGAAATTTACTTAAAGAATAGATGCTC
AGTTAACATTCTCATATCACACACTCCCTTTTCTGTGCACTTCTAAAGCAGTTATTTTCGGAACCTCTTT
TTGCTCTTAATCATGTAGAGACTTTTCATTTTCCTAAATATATCATACCTAAACAAATAACTCATAGAGG
TACTGTGGGTTATGGTTTGCCATTTGAACCATGCATCAACCTTCTGGAGAATCTTTTAAAGTATATACAT
TTTTCCAGAGTAAAATTAATTTTTTTCTAAAACACGTGAAGTAGTTTTTATTAATATATTAATAGTTGTA
TATATTTATGGGATGCACGTGATATTTTGATTTGTGCACATACAATGTGTAATGATCAAATCATGGTAAT
TGGGATATGCATCACCTCAAACATTTATCATTTCTTTGTGTTGGGAACATTCTAAATCTTCTAGTTATTT
TGAAATATACAACAAATTCTTGTTAACTGTAGTTGCCCTACTGTGTTATTGATTAGCTATAATAAATAAG
TTCTAGTGTTACTGACACTGTTCTATCTGATCATATTTTTGTACCCATTAACCAACCTCTCTTCATCCTT
CCCTCACCCCTATCCATCCCAACCTCTGATAACCACCATTCTAAATCACTTCCTCCTTGAGATCAATATT
TTTAGTTCCTATATAGGAATGAGAATATGCAAAATGTGTCTTTCTATGCCTGGATGATTCCACTTAACAC
AATATCCTCTGGTTCCATCCATGTTGCTGCAAATGACAGGAGAAAGAAAATGTGGTATATACACACAATG
GAATATTATCCAGCCATTAAAATAATAAAATCCTGTCATTTGCAGCAAGAGATTGTCTGATTTTTGTTTG
TTTTTTATTTATTTATTTATTTTTTTGAGACAGGTCTCAGTTGACCAGGCTGGAGTGCAGTGGCACAATC
CTAGTTCACTGTAGTCCCAACCTGCCAGACTCAAGCAATCTTCCCACCTCAGCTTCCTGAGTACTAGGGA
CTACAGGCATGCACCAACATGCCCAGCCAATTTTTTGTAAAGATGGTCTCACCATGTTGCCCAGATTAGT
CTCAAACTCCTGAGCTCAAGCTATTTTCCTGCCTCGACATCCCAAAGTGCTGGGATTACAGGCATGAGCC
```

FIGURE 491 cont'd

```
ACTGCACCTGGCCTGAATAAAGAATTTTATCTATATATACTTGGTCTAAACAGAAAAGACCTGCAAAGA
AATCATGAACACTAACAAAGTTTGTTATGTGCATTCATGTTAGTTGGCAACTCCAAAACTACTTGCCAGG
TATTGGAGGACTGAACAGATGCATAAACATACTGATGATGCTGGGGGCCAATTTCTGACTCTTGGAGAAA
GAAGTAAATATGGAATGGGAAAATCCCTTAGGAAGAATCCTGCAATACTTATTTAAAATGAGAGGGGTCA
GTATTTTACACAGACACAGACACACACACACACACACACACACACGACTATTATCCCAATAATGAT
TAGTATGCACAGCACCCAGATCTTGGTTTCTAAGTATCATTCCCCACTAAAAGCAATCAGAGCTCTACAG
AATCTGTGGCTGAGGCAGGGAATATACAAGATAAACCTAATATCTTACTGTACCAGAAAACAAAGGTTCA
TATGGATGACAGACAGGTAGAGAGACATGGGGTAGGGGAAGGAAAAGCTCTTCTAACAAACAGTAGGAT
GCCAATTACTAAAAATAAAAGGAATGACGGAGTCAGAAAGTCATATTTTGCAGTCATCACAGTAATAACT
GATTCAGACAAGAATCATCAATGAACACTAAAACTAGTGGGTGAAAGACGAGATGATAACATAGTCTCAA
AGATCTTCCCACAAATTGCTTATTAATTTCAAAGCCAAAATAGCAATTTTTTAGTGGAAAAACCTAGGAG
ACACCAGTTCACACAAGTTATCAACGCTAACGCCAACAAAACACATCATGTGTTTCCTATTGTGATGCAC
TGACAAGTATGCATTAGTCATGCAATACTCAATCTACAAACATTTAACTTGAATCTAATCATGAGGAGTC
AAACTCAAATTTAGGGTTGTTCTACAAAATAGCTTGTTGTCTTCAAAATGCTCATTTCATGAAAGACAAA
AAATGGCTATGGAACTGATCCAGGTTGAAGACTAAAGAAACATGACAATGAAATGCAGGCATGATACATT
TTAGATTGGACCCTGAACTAGAAATGCTATAAACATTATAGGACAACTGTGGAATTTAAATAAACTCTG
CAGATTAGGAAACATTACTGTTTCTTTTTCTTTTTTTTTTGAGATGGAGTCTTGCTCTGTCGCCCAGGC
TGGAGTGCAGTGGCATGATCTTGGCTCACTGCAAGCTCCGCCTCCTGATTTCACGCCACTCTCCTGCCTC
AGCCTCCCAAGTAGCTGGGACTACAGGTACCACCACAGTGCCTGGCTAATTTTTGTATTTTAGTAGAG
ATGGGGTTTCACTGTGGTCTCGATCTCCTGACCTTGTGATCCACCCGCCTTGGCCTCCCAAAGTGCTGGG
ATTACAGGCGTGAGCCACAACGCCCAGCCAACATTACTGTTTCAACCTACAATGGTCTTAAAATATGTTT
ACAGATTATTTTACTACCCCCTTGATTGTAGATAGGCTTTTGACTGTCTCAACAAACCGAGGCAGAAGTG
ATGTTGGAACTTCCGAGGCGAGATTAAAAAGGGTCATAGTATTTGTGCTGGCTTTTATCTGGATACTAGC
TTTGAGCCACCATGTAATGTCCAGTTTCTGTGAAGTCACCATGCTGAAGAGGTCACAGAGAGATAGAAAG
ACATGTCTGAGAAACCAAAGCTGTGTCATTCTCTCAGTTCAGGCAGTAGATGTGGAAATGAACAGGTCTA
ACTGCAATCACATTAGAGACCCCAAGAATATGTGGGATTCTTTTGTATTATTCTTGCATCTTTTCTTAAT
GTTTAGAATTAATTCAAAATAAAGTTTTAGAACTTTAAAAAACATTACAAAAATGTTAAAAATTACTAC
ACGAGCCCCCTTAAAGTAACAAGATCATATGTGTACATATATACGCATATCACATACACATATATACACA
CTCATACAAAATCCTGTCTCTGCCCACTTTCCTAAACATATTCTCAGTAACTACCAACGTCAATAATTAT
AAATGTACCTCCTCTCATTTCACTCTGTATTCCACTGAATGGATAAGTCATCAAATATTTTGTCAATCCA
ACTGATAAATGCAAAGTTTGCTATTATCAACAATGCAACTGTGAACATCCATTTACACACATCTGTAACT
GCGTGTCTCAGTCTTCAAATGCATCTTAAAAGTTTTCTCCCTTTCCTTCCTGATATGGTTTGGCTGTGTC
CCCACCCAGATGTCATCTTGAATTCCCACATGTTGTGGGAGGGACCTGGTGGGAGGTAATTGAATCAAGG
GGGCAGGTCTTTTATGTGCTGTTCTCATGATAGTGAATACATCTCACGAGATCTGATGGTTTTAGAAAGG
GGAGTTTGGCCAGGTGCGATGGCTCATGGCTGTAATCCCAGCACTTTGGGAGGCTGTGGCGGGCGGATCA
CGAGGTCAGGAGTTCAAGACAAGCCTGACTAACACGGTGAAACCCTGTCTCTACTAAAAATACAAAAATT
AGCCGGGAGTGGTGGCACATGCCTGTAATCCCGGCTATTCAGGAGGCTGAGGCAGGAGAATTGCTTGAAC
TTGGGAGGGGAAGGTTGCAGTGAGCCGAGATCGCACCACTGCATTCCAGCCTGGGTGACAGAGCGAGACT
CTGTCTCAAAAAGAAAAGAAAAGAAAAGAAAAGAAAAGAAAAGAAAAGAAAAGAAAAGAAAAGAAAAGT
GGGGCGGGGGGGAGTTGTTCTGCACAAGCTCTCTCTTTGCCTGCTGCAATCCAGAGACTCTGTCTCAAA
AAAGAAAAGAAAAAAAGGGGGGTGGGACTTTTCCTGCACAAGCTCTCTCTTTGCCTGTCATCCATGTA
AGACGTGACTTGCTCCTCCTTGCCTTCCACCATGATTGTGAGGCCTCCCAGCCATGTCAAACTGTAAGCC
CATTAAACCCTTTTTCCTGTATAAATTATGCAATCTGGGTATGTCTTTATCAGCAGCATGAAAAGAAAG
AGACACAGAGACAAAGTATAGAGAAAGAAAAGTGGGCCCAGGGGACCGGCACTCAGCATATGGAGGACCC
GCGCCAGCCCTGGTCTCTTGAGTTCCCTCAGTATTTATTGATCATTATCTCTACCATCTCAGAGAGGGGG
ATGTGGCAGGACATTAGGGTAATTGTGGGGAGAGGGTCAGCAGGAAAACATGTAAACAAAGGTCTCTGTG
TCATAAACAAGGTTAAGAAAAGGTGCTGTGCTTTGATGTGCACGTAAACAAACATCTCGGTGCATTAAAA
AGCAGTATTGCCGCTAGCATGTCTCATCTCCAGCGTTAAGGCGGTTTTCTCCTATCTCAGTAAATAGAAC
ATACAATAGAGTTTTACACCGAGACATTCTATTGCCCAGGAACGAGCAGGAGACAGATGCTTCTTCTTAT
CACAACTGCAAAGAGGCCTTCCTCTTTTACTAATCCTCCTCAGCACAGACCCTGTATGGGTGTCGGGTGT
TGGGCTGGGGACGGTCAGGTCTTTCCCTTCCACAAGGCCGTATCTCAGGCTATCACATGGGGAGAAAC
CTTGGACAATACCTAGTTTTCCTAGGCAGAGGTCCCTGTGGCCTTCTGCAGTGTATTGTGTCCCTGGGTA
CTTGAGATTAGAGAATGGTGATGACTTTTAACAAGCATACTGCCTTCAAGCACTTTTTTAACAAAGAACA
TTCTGCATAGCCCTAAATCCATTAAACATTGAGTCAACACGACACATGTCTCTGCGACGCACGGGGTTGGG
GCTAGGGTTACAGATTAACAGCATCTCAAGGCAAAAGAATTTTTCTTAGTATAGAACAAAATGGAGTCTA
CTTCTTTTTACATAGACACAGTAACAGTCTGATCTTTCTTTTCCCCATAGTAAAAGCTATTGGATCTTTG
TTTGTATATGTGTGCACATATTTAGATATGTTTATGTGATTATATTGTTACATGTATGTAACATGTATTA
TGTTATGTGTTGGTCTAGCATGATACCAAATGGCCTTGTAAGTAGATAATTATAAATTAGGTACAAATGC
TTTTCAAGTTCACACAGATCTTCAGTAAATAAAACTGGTTTTAAAATCATTAGTAAGATAAAAATGTCTT
CAGAATTGTCAGCATACATTTTTGTCTGGGCAAATAAGTTTTATAGTTTTATAGTTGCCTTGGCTAAATG
TTTTAAGGTGTCACAGTTTGGCACAAAGGTTCTGAGACTATAAACCCAACTGAAAACAGAGTAATCTTTG
```

FIGURE 491 cont'd

TGTATTTTTTTGAAAAATAAAACTAATTTAAAATTTTTAGTTTAATGAAAACAGCTAAATCTTCTGAGT
TATTGGCAAAATGCCCAGTGTTTAAGGTTCTTACTTAGATGTATACCTGATATTCAGATTTTAAAAATGG
TTAACAGGGAAATAACTTTAAATAATCACCAGCTTTATGTAGTATCTCAGTTTTCAGTACTAATCTAGAT
AAGCTGTTAAAAATGAGAAAATATCGAGTACATATGAGATAAATGCTTATAGACTTTTTGTGTAATTTAA
AACCCTAAAAACTTTAAATTAAATAATACTCATTCACCCTTTCTACTTTCCCATATATTATGGCACAGAA
TGGTTGATGACAGTGTAAATCCACGTAATAGGTCAAGACCTCTATGAATTGAAAATAAAATGCTACTAAA
ATTCTAGAGAAACCAAGGGCCAGACCAACAGCTAGCCAAAAAGTAGACAGTAACTCATGACGTGCTGCTA
ACCATCCATTCATCTGTCAGACTGGCTGGAATCAGACCATAGACGCATCACACTCGGGTGAAGGCAGCTC
CTCCTCAACCTGATACCTCAGACAATCAGACTGCTTGGTCATGTAAATCAAGAGAGGACCTAAAGCTATT
TATTAAAGAAAAATCATACAAATAAGTAACACCCTTCTGTTAACATGAATTGTTAATGAATTGTACAGTC
GTAACTACATTCTTTATCTTTGCTAAAACTAACCTTTTTGCTGAATGGGCATAGATGGTGACTTTCCTCC
AAAATAAAAGGCTGTTGGGTCTGCAGGGAGCTACCCCTTTCTTTAATCACAGGCTTGCCATGGTGCATAC
AAACTGCTAACCTGAGCACTTGAGTATTTTTATACTTGGAGTAAAAATACTTACCTGTTTCCCTTCTATG
ATTAGAGTACCACTTACCATGAGTTCCCTGCCTCTGAGAAAACACAGAAACGTATTTTCCTTCTGGTTCA
TAAACAGGTTAATGCCACCCCCACTACAGGATATGCCATAGATGATGGCATATGATGGTTGATGGCAGTG
TAAATCCAGGTAATGGGTCAAGACTTCTATGCATTGAAAAACACAGTAACAGTACACCCCACACTATCTC
CCACGATATGGGATGACTACCTCTTCAACAATGTGGCCAAACCCTTGGACTGACTAATAACATGTGACTA
GGATGGCACAATCAAAATAGCATCCACCTCCATAACAGAGCCTCATCCTTCCCCCTGGGGTTTGCTATGG
GTCTGCGGCACTCATGGTTGGCCTTACTGTTGGGGATCAGCCTTAATACCACCTGTAGGGTACCCGAAGT
CCAGTGGTGACAAAGGAATGAGAAGAGACAGGTTAAGTGTTCATAAAGGTGGGAGCCAGGGGGCCAGAGC
AAATCAGAGGCTGCAAAGGCCCGGAGCTGAAGTCTCTACACTATTTATTGAATATGATCACTTAGATCTG
AGAAGCAGATGTTCAGGGCGAAACAGTGAAAGGGAGGCAGTGCATTATATGCGTGATCTATAGCAGTGGC
GGTTTAAGTGAATCTCCTTTGTGCTCAGTGTATCTTTAACTTATCGGAGAGTAGCTGGTGGGAGCAGGCT
TAACTAGGAGCTTGCGTATCTGTCTACATTTCAATGTCTTAAAGGAGTGACTTTTTTCCTGAACACAGCG
TTTACAGATAAGAGAGCAGGTCTCACTCTGAGCATGGGAACATGATGGCAATTAGGAGGCTTTCCTCCTC
AGAGGCCTCTTGTGGCTTTCCACAACTTATTGTCCGATATTTTATGGCCAATTTATGCAGGCACTCCAC
AAGCCCTTTTCCCAGCACTTACAACTGGAATGGTAGATGCACCTAGGGGCGCCCTTCCCTACCAGGATGT
ATCCTTTCCCATTTAGACTCTCTCCATGCCAACTGGGAAAGTGTAAAAGGCGAGACGATCCCATCAAAAA
TAGGCATCAAGGTGGTTGTACCCAGTAGTCCTTTCTTTCCCCCAGGCAGTGGCCACAGATGTAAAATTAC
AAATAAAAGACCTGGTTAAACAAACGGCTGCTACCTTTAATAATATCCATCATGTCATCCCCTTTCTCGC
TGAAAAACCCTCACAAGATTAGACAAGTCGCCCTGCACAACCACATGGCCTTAGATATCCTGACTGCAGC
ACAAGGCAGCCCTTGTGCACTGATTAAGACTGAATGTTCTGTCCGGGAGCAGTGGACTACAGTGCCTGTA
ATCCCAGCACTTTGGGAGGCTGAAAAGGGTGGATCGCTTGAGGTCAGGAGTTCGAAACTGGCCTGGCCAA
CATAGTGAAACCCTCTCTACTAAAAATACAAAACTTAGCTGGGCATGGTGGTATACACCTGTAATCCCAG
CTACTGGGGAGGCTAAGGCATGAGAATTGAACTTGAGAGGCAGAGGTTGCAGTGAGCCAAGATTGTGCCA
CTGCACTCCAGCCTGGGTGACACAGCAAGGCTGTCTCAGGAAAAAAAAAAAAAAAGACTAAGTATTGTG
AATATATACCACATTATTCTCACACTATGACCTAAGCTATGCATACACTGGACATCCATATTTCTGATAC
AGATATAGGATCCTCTCCCAGGACCCTTTAACAGTGTGGTCCAGCTGACTTCCTTATAAAGACTTTCAT
ATACAGTATGGTTGGTATTCTTCTCATTGTCCTCATCAGCTGCTATGGATTTTACTACTGTTATACACTG
AGGACAGACTTTCTCAAAAGTTCCTAGGTCCTCAGTCCTCACACTGTAAGGCTCCAGCAAGTTCCTGCTA
TAGATCTGGGAATGTGGATATATTTCCAACTCCAAGTGAATAGATTCCATTCTGGTACTTCCCAACTATG
CCCCCTTTCAGCAGGAAGCAGCCAGATTAACTGCGTTGCCCACTTTCCATAAAAATAGGATGAAGTTTGA
CAGTGGGGAATTCTTACAGAGTACTCCAGCTTTGAAATGCATTTAAAACTTTTCTCCCTTTCCTCCCCA
ATCTCAGAATGTGGCCTTATATGTTAAAACTCTTCATCTCTCCCTTTCCCACGAGGTACTTCATGCACAG
TGCTCACTTGTATAATTGTGCTTGCTTAGAAATTCCAAGCACTAATTTTAAAGCAAAACAGACACAGACT
AAATAAATCAGCTGCACAATCCTCCCACTTAAGGGCAGTTATGAACAGTTCATCCACCACTCCTGGGCCA
AAGTCAAGAAGATGCAAACCAGACCTCCAAATGGGTGACTGCTCAAGATAAACCATCAGAAGAAGACATG
CAAGACCTGCACCCGACTGCACCGCTCCCACGTATTTCCCACACCAAGTTTTCCCTCTTAAACTCCTTCA
CTCAGCCCAAAAAGTTGGAATGGTCTTTTAAGGTATGAGCCTGGCCATTTCCCAATTACTAACATTTGAT
TAGTAAAACTGCTTTCCTTTTACTACATTTTGCTTTTCATGTTTTCAGCCTTTGAGTAGCAAGCAGCTGG
ACTTAAGCCAGTTACACATCCATAACACAGGATTACATGCCATATAATGAGATAAAACAAACAAGATTTA
GCTATAAGGGATTTTCATTTATGCATAACTTTGTTTTCACTTTTACTTTGGTAAAATTGATGTCACTGTAA
TTTTTTGAAAAGTTAAAATATCATCCAACCTTCCATGCCACAGTAAACAATTGTTAGCATATTAATATC
CTTCTATTATTTCTATGCATATAATCACATCATTAGGTGGACATACTTCTATTAATTGGATAATCCCAGG
AAGGGTCTAACCTAGTTTTCTCATGAATAATGTCTTCTCTAGTCATTACAGACCTCTGATCATCTTAATG
GCTGTATATTATAAGGATATATCAAGACTTACTCAAATATTTTACTTTTTCCTTTTTGAATTCAGGATAA
ATATCCTTGTGTACAATCTTTCTCGCTTTTGTCACAATCTCCTAAGTGAAATTTCTAGTGCTAGGACTGC
CAGGGCAAAGAGTATTTATTGTCCACTAATACCAAGAGGTCTTAAGCATAGAATGCTGTGTAAGTGGTAA
TCCATCTAAATCATTACACTGAATACAATTTCAAGGTTGGGCACAGAGGTTCACATCCATAATCTCAACA
CTTCGGGAAGCCAAGGTGGGAGGAATGCTTGAGGCCAGGAGTTTGAGACCAACCTGGGCAACACTGCAAG
GCTCTATTAAACAAAATAAATAAACAATAAGATACAATTTCAATAAAGACTCAACAGGTTTCTTGCCCTG

FIGURE 491 cont'd

```
CCACTTCCTTTTAAGGGGATAAATGTGACAAATTAACATGCCTGAAATCTGCCAAAGCTCCTTCTAAAGC
GGCCTACATGGAGGAAAGACTACACATAGAAAAGCAACTTGACCTGAACCTGAATGAAAATAATGAAAGG
AAACCAAGTATTAACAATTCAAGTTTACTAAGAAACTTTTTGTCATCAGTAACTACTTTTAACACTTTCA
GAGTTACAGTACAGCTTAGTGTCCAAAAATTCTAATCATGTAAATTGCAGGGTCACATTAGATAAAAACA
GTATTGTTCAGTCTATAAACTGACACTAAAAATCATACTGTACACAACTGATGATACACTGTACAAAGAA
CTAAGGCTGAAGGATGGGAGCCATTCATGTCTTTTTTCCAAATTTGTGTTAGTATGGATGGCAGTATTAT
ATACTTTTCAGTACTTACTGAAACTAACGTTATTAAGGCTACTTGCAGGATTCCTTTTGAATATAAATTA
ATATAAATTTAGAGTAGAAAACAGACTAGAATTTTCAAGTATTTGTCCTAATTATAGGTATTTTCTTCAC
TTTCTTCAGTAATTGCTGGGCCCTATTATGAGCCAAGCACAATTCTACATGGTAGAGATAGAGTGGTGAA
AAACACCTCCTTACATAGAGGTTACATTTTAGTTGACATCCATTTTTCTGTCAATCATACTTTTGTTAA
AGGAAGGCCTCTCTCCTGTGCAGACTCCGACAAGACTTTTCTGCTGTGTTACATCTTGAGAACCGGGACA
CCTGGTACTCTGATATAAACACTGATCATATTTACAGAACAAAGTTTTCTCGCATCTGTGAAATATGACG
TTTGTAAAGAATTCATGTCCTAACCAAGTCTAAAACACAGCATTTGAGAGACTTCTTTCCTGTCAAGATT
CTTTGAAGCTT
```

FIGURE 492
SEQ ID NO: 484
Genbank ID         : BG253437
Unigene ID(#167)   : Hs.356289
Unigene name       :         steroid sensitive gene 1        URB
>gi|12763253|gb|BG253437.1|BG253437   602363350F1   NIH_MGC_90   Homo   sapiens
cDNA cl
one IMAGE:4471621 5', mRNA sequence
```
GAAAAGCTTGAGAAACCAGAGAAGGAGAAGAAAAAAAAGATGAAGAATGAGAACGCAGACAAGTTACTT
AAGAGTGAAAAGCAAATGAAGAAGTCTGAGAAAAAGAGCAAGCAAGAGAAAGAGAAGAGCAAGAAGAAA
AAGGAGGTAAAACAGAACAGGATGGCTATCAGAAACCCACCAACAAACACTTCACGCAGAGTCCCAAGA
GTCAGTGGCCGACCTGCTGGGGTCCTTTGAAGGCAAACGAAGACTCCTTCTGATCACTGCTCCCAAGGCT
GAGAACAATATGTATGTGCAACAACGTGATGAATATCTGGAAAGTTTCTGCAAGATGGCTACCAGGAAAA
TCTCTGTGATCACCATCTTCGGCCCTGTCAACAACAGCACCATGAAAATCGACCACTTTCAGCTAGATAA
TGAGAAGCCCATGCGAGTGGTGGATGATGAAGACTTGGTAGACCAGCGTCTCATCAGCGAGCTGAGGAAA
GAGTACGGAATGACCTACAATGACTTCTTCATGGTGCTAACAGATGTGGATCTGAGAGTCAAGCAATACT
ATGAGGTACCAATAACAATGAAGTCTGTGTTCGATCTGATCGATACTTTCCAGTCCCGAATCACAGATAT
GGACAAGCAGAAGAAGGAGGGCCTTGTTTGCAAAGAGGACCAAAAGCAGTCCCTGGAGAATTCCTATCAG
GTCCCGTGGAGGAAGGAAGTTGACGGGGAACCCCGGACCCTAAGGAATGAAGACTGGGGCCTATTCACAG
AATCTTGCCCTAAAGGTCAAGCTTCAATTTTGGCTTTGCCCCTAATCATTTAAGCTTAAGGCTGCACACA
ATATGCGCAGGTACAGGTTCCACATAGGAGACTCTTTAACGGAAAGCAACCCCGTGGGAAACACCCAAC
TTCAGGGCCAGATAACCACCGTTGTGAAGGAAGACATGCGTACCCAAAGCGAGAACAGAAAAGCCAGAGA
AACGAAGGAAACGATATACAACAAAAGACAAATAATCTATTTTTTCACTTTTTTCTTTCTTCCTTCCCCC
ACCAACCAAAAACAAAAAATAATACAAAACACAAAAAAAAAGACACAACAAAAAACGAACAACACAACAA
CAAACAACACCCACCAACAAAAAAAACAACAAAACAACAACCAACACAAACATAACAAAAAACACAACACA
AACCAACCC
```

FIGURE 493
SEQ ID NO: 485
Genbank ID         : BF592062
Unigene ID(#167)   : Hs.169859
Unigene name       :         zinc finger protein, Y-linked ZFY
>gi|11684386|gb|BF592062.1|BF592062   7n98h06.x1   NCI_CGAP_Kid11   Homo   sapiens
cDNA
  clone IMAGE:3572962 3', mRNA sequence
```
TTTAACAGTAAAATTTATTTTTATTTTGCATATTCTCAAATACACATTTACAATAGTATCACACTTCCT
ATATGAATTCTTCATAGTTATTTTAAGTATTTTACAATTTGTACAGAGGAAGGGACATACAATATCTAAT
AGGCTATTTTTCAACCAAATAATAATTTATGTCCTTGTAAGATTTTGTACCTCTTTAAAACTTTCAACTT
CAACATCCACTTTTTTAGCTTTGCTAATCAAATTAAGAATTAAAACCAGCCTGCAAATAATAACAGTATA
TAACATTAAGCACAATTTCATTTCTTTCTTTATACAAATGTTCTATATTTACTTGACCAAATGCTTAATT
ACCTTTTAAAGGTTTCAATACCGTGGTTAAAAACAAAACAACTGTGTATACCTCCAGACTATATGAAAAA
TATGAAATATGTAAAGTGTCACGTTTTTTACCTTAGTTTATTTTTAAAAGATAAATAGCTAACTATCTGT
ATTAATTTTAAAGAATGTTTTAAAA
```

FIGURE 494
SEQ ID NO: 486
Genbank ID         : M16276.1
Unigene ID(#167)   : Hs.409934
Unigene name       :     major histocompatibility complex, class II, DQ beta
1      HLA-DQB1
>gi|188397|gb|M16276.1|HUMMHDRDQ Human MHC class II HLA-DR2-Dw12 mRNA DQw1-beta
, complete cds
GCACTGGACTGAGAACCTTCACCAAAAAAATGTCTGCCCAGAGACAGATGAGGTCCTTCAGCTCCAGTGC
TGATTGGTTCTTTTCCAAAGGCCCATCTAATCCTACCACGCACGGAAATATCCACAGGTTTTTATTCTTT
CTGCCAGCTACATCAGATCCATCAGGTCCGAGCTGAGTTGACTACCACTACTTTTCCCTTTGTCTCAATT
ATGTCTTGGAAGAAGGCTTTGCGGATCCCCGGAGGCCTTCGGGCACCAACTGTGACCTTGATGCTGGCGA
TGCTGAGCACCCCAGTGGCTGAGGGCAGAGACCCTCCCGAGGATTTCGTGCTCCAGTTTAAGGCCATGTG
CTACTTCACCAATGGGACGGAGCGCGTGCGTTATGTGACCAGATACATCTATAACCGAGAGGAGGACGTG
CGCTTCGACAGCGACGTGGGGGTGTATCGGGCGGTGACGGCGCAGGGGCGGCCTGACGCCGAGTACTGGA
ACAGCCAGAAGGACATCCTGGAGAGGACCCGAGCGGAGTTGGACACGGTGTGCAGACACAACTACGAGGT
GGCGTTCCGCGGGATCTTGCAGAGGAGAGTGGAGCCCACAGTGACCATCTCCCCATCCAGGACAGAGGCC
CTCAACCACCACAACCTGCTGGTCTGCTCGGTGACAGATTTCTATCCAGGCCAGATCAAAGTCCGGTGGT
TTCGGAATGACCAGGAGGAGACAGCTGGCGTTGTGTCCACCCCCTTATTAGGAACGGTGACTGGACCTT
CCAGATCCTGGTGATGCTGGAAATGACTCCCCAGCATGGAGACGTCTACACCTGCCACGTGGAGCACCCC
AGCCTCCAGAGCCCCATCACCGTGGAGTGGCGGGCTCAGTCTGAATCTGCCCAGAACAAGATGCTGAGTG
GCATTGGAGGCTTCGTGCTGGGGCTGATCTTCCTCGGGCTGGGCCTTATCATCCGTCAAAGGAGTCAGAA
AGGACCTCAAGGGCCTCCACCAGCAGGGCTTCTGCACTGACTCCTGAGACTATTTTAACTAGGATTGGTT
ATCACTCTTCTGTGATGCCTGCTTGTGCCTGCCCAGAATTCCCAGCTGCCTGTGTCAGCTTGTCCCCCGA
GATCAAAGTCCTACAGTGGCTGTCACGCAGCCACCAGGTCATCTCCTTTCATCCCCACCCCAAGGCGCTG
GCTGTGACTCTGCTTCCTGCACTGACCCAGAGCCTCTGCCTGTGCACGGCCAGCTGCGTCTACTCAGGTC
CCAAGGGGTTTCTGTTTCTATTCTCTCCTCAGACTGCTCAAGAGAAGCACATGAAAAACATTACCTGACT
TTAGAGCTTTTTTACATAATTAAACATGATCCTGAGTTAAAAAAAAAAAAGGAAATCGCTGCAGAATGAA
GGAATATCCCTTGAGGTGACCCAGCCAACCTGTGGCCAGAAGGAGGGTTGTACCTTGAAAAGACCACTGA
AAGCATTTTGGGGTGTCAAGTAAGGGTGGGCAGAGGAGGTAGAAAATCAATTCAATTGTCGCATCATTCA
TGGTTCTTTAATATTGATGCTCAGTGCATTGGCCTTAGAATATCCCAGCCTCTCTTCTGGTTTGGTGAGT
GCTGTGTAAGTAAGCATGGTAGAATTGTTTGGAGACATATATAGTGATCCTTGGTCACTGGTGTTTCAAA
CATTCTGGAAAGTCACATCGATCAAGAATATTTTTATTTTTAAGAAAGCATAACCAGCAATAAAAATAC
TATTTTTGAGTCT

FIGURE 495
SEQ ID NO: 487
Genbank ID         : NM_001041.1
Unigene ID(#167)   : Hs.429596
Unigene name       :     sucrase-isomaltase         SI
>gi|4506944|ref|NM_001041.1|     Homo     sapiens     sucrase-isomaltase     (alpha-glucosidase
) (SI), mRNA
TATTTTGGCAGCCTTATCCAAGTCTGGTACAACATAGCAAAGAGAACAGGCTATGAAATAAGATGGCAAG
AAAGAAATTTAGTGGATTGGAAATCTCTCTGATTGTCCTTTTTGTCATAGTTACTATAATAGCTATTGCC
TTAATTGTTGTTTTAGCAACTAAGACACCTGCTGTTGATGAAATTAGTGATTCTACTTCAACTCCAGCTA
CTACTCGTGTGACTACAAATCCTTCTGATTCAGGAAATGTCCAAATGTGTTAAATGATCCTGTCAATGT
GAGAATAAACTGCATTCCAGAACAATTCCCAACAGAGGGAATTTGTGCACAGAGAGGCTGCTGCTGGAGG
CCGTGGAATGACTCTCTTATTCCTTGGTGCTTCTCGTTGATAATCATGGTTATAACGTTCAAGACATGA
CAACAACAAGTATTGGAGTTGAAGCCAAATTAAACAGGATACCTTCACCTACACTATTTGGAAATGACAT
CAACAGTGTTCTCTTCACAACTCAAAATCAGACACCCAATCGTTTCCGGTTCAAGATTACTGATCCAAAT
AATAGAAGATATGAAGTTCCTCATCAGTATGTAAAAGAGTTTACTGGACCCACAGTTTCTGATACGTTGT
ATGATGTGAAGGTTGCCCAAAACCCATTTAGCATCCAAGTTATTAGGAAAAGCAACGGTAAAACTTTGTT
TGACACCAGCATTGGTCCCTTAGTGTACTCTGACCAGTACTTACAGATCTCAGCCCGTCTTCCAAGTGAT
TATATTTATGGTATTGGAGAACAAGTTCATAAGAGATTTCGTCATGATTTATCCTGGAAAACATGGCCAA
TTTTTACTCGAGACCAACTTCCTGGTGATAATAATAATAATAATTTATACGGCCATCAAACATTCTTTATGTG FIGURE 495 cont'd

```
TATTGAAGATACATCTGGAAAGTCATTCGGTGTTTTTTAATGAATAGCAATGCAATGGAGATTTTTATC
CAGCCTACTCCAATAGTAACATATAGAGTTACCGGTGGCATTCTGGATTTTTACATCCTTCTAGGAGATA
CACCAGAACAAGTAGTTCAACAGTATCAACAGCTTGTTGGACTACCAGCAATGCCAGCATATTGGAATCT
TGGATTCCAACTAAGTCGCTGGAATTATAAGTCACTAGATGTAGTGAAAGAAGTGGTAAGGAGAAACCGG
GAAGCTGGCATACCATTTGATACACAGGTCACTGATATTGACTACATGGAAGACAAGAAAGACTTTACTT
ATGATCAAGTTGCGTTTAACGGACTCCCTCAATTTGTGCAAGATTTGCATGACCATGGACAGAAATATGT
CATCATCTTGGACCCTGCAATTTCCATAGGTCGACGTGCCAATGGAACAACATATGCAACCTATGAGAGG
GGAAACACACAACATGTGTGGATAAATGAGTCAGATGGAAGTACACCAATTATTGGAGAGGTATGGCCAG
GATTAACAGTATACCCTGATTTCACTAATCCAAACTGCATTGATTGGTGGGCAAATGAATGCAGTATTTT
CCATCAAGAAGTGCAATATGATGGACTTTGGATTGACATGAATGAAGTTTCCAGCTTTATTCAAGGTTCA
ACAAAAGGATGTAATGTAAACAAATTGAATTATCCACCGTTTACTCCTGATATTCTTGACAAACTCATGT
ATTCCAAAACAATTTGCATGGATGCTGTGCAGAACTGGGGTAAACAGTATGATGTTCATAGCCTCTATGG
ATACAGCATGGCTATAGCCACAGAGCAAGCTGTACAAAAAGTTTTTCCTAATAAGAGAAGCTTCATTCTT
ACCCGCTCAACATTTGCTGGATCTGGAAGACATGCTGCTCATTGGTTAGGAGACAATACTGCTTCATGGG
AACAAATGGAATGGTCTATAACTGGAATGCTGGAGTTCAGTTTGTTTGGAATACCTTTGGTTGGAGCAGA
CATCTGTGGATTTGTGGCTGAAACCACAGAAGAACTTTGCAGAAGATGGATGCAACTTGGGGCATTTTAT
CCATTTTCCAGAAACCATAATTCTGACGGATATGAACATCAGGATCCTGCATTTTTTGGGCAGAATTCAC
TTTTGGTTAAATCATCAAGGCAGTATTTAACTATTCGCTACACCTTATTACCCTTCCTCTACACTCTGTT
TTATAAAGCCCATGTGTTTGGAGAAACAGTAGCAAGACCAGTTCTTCATGAGTTTTATGAGGATACGAAC
AGCTGGATTGAGGACACTGAGTTTTGTGGGGCCCTGCATTACTTATTACTCCTGTTCTAAAACAGGGAG
CAGATACTGTGAGTGCCTACATCCCTGATGCTATTTGGTATGATTATGAATCTGGTGCAAAAAGGCCATG
GAGGAAACAACGGGTTGATATGTATCTTCCAGCAGACAAAATAGGATTACATCTTAGAGGAGGTTATATC
ATCCCCATTCAAGAACCAGATGTAACAACAACAGCAAGCCGTAAGAATCCTCTAGGACTTATAGTCGCAT
TAGGTGAAAACAACACAGCCAAAGGAGACTTTTTCTGGGATGATGGAGAAACTAAAGATACAATACAAAA
TGGCAACTACATATTATATACATTTTCAGTTTCTAATAACACATTAGATATTGTGTGCACACATTCATCA
TATCAGGAAGGAACTACCTTAGCATTTCAGACTGTAAAAATCCTTGGGTTGACAGACAGTGTTACAGAAG
TTAGAGTGGCGGAAAATAATCAACCAATGAACGCTCATTCCAATTTCACTTATGATGCTTCTAACCAGGT
TCTCCTAATTGCAGATCTCAAACTTAATCTTGGAAGAAACTTTAGTGTTCAATGGAATCAAATTTTCTCA
GAAAATGAAAGATTTAATTGTTATCCAGATGCAGATTTGGCAACTGAACAAAAGTGCACACAACGTGGCT
GTGTATGGAGAACGGGTTCTTCTCTATCCAAAGCACCTGAGTGTTACTTTCCCAGACAAGATAACTCTTA
TTCAGTCAACTCAGCTCGCTATTCATCCATGGGTATAACAGCTGACCTCCAACTAAATACTGCAAATGCC
AGAATAAAGTTACCTTCTGACCCCATCTCAACTCTTCGTGTGGAGGTGAAATATCACAAAAATGATATGT
TGCAGTTTAAGATTTATGATCCCCAAAAGAAGAGATATGAAGTACCAGTACCGTTAAACATTCCAACCAC
CCCAATAAGTACTTATGAAGACAGACTTTATGATGTGGAAATCAAGGAAAATCCTTTTGGCATCCAGATT
CGACGGAGAAGCAGTGGAAGAGTCATTTGGGATTCTTGGCTGCCTGGATTTGCTTTTAATGACCAGTTCA
TTCAAATATCGACTCGCCTGCCATCAGAATATATATATGGTTTTGGGGAAGTGGAACATACAGCATTTAA
GCGAGATCTGAACTGGAATACTTGGGGAATGTTCACAAGAGACCAACCCCCTGGTTACAAACTTAATTCC
TATGGATTTCATCCCTATTACATGGCTCTGGAAGAGGAGGGCAATGCTCATGGTGTTTTCTTACTCAACA
GCAATGCAATGGATGTTACATTCCAGCCAACTCCTGCTCTAACTTACCGTACAGTTGGAGGGATCTTGGA
TTTTTATATGTTTTTGGGCCCAACTCCACAAGTTGCAACAAAGCAATACCATGAAGTAATTGGCCATCCA
GTCATGCCAGCTTATTGGGCTTTGGGATTCCAATTATGTCGTTATGGATATGCAAATACTTCAGAGGTTC
GGGAATTATATGACGCTATGGTGGCTGCTAACATCCCCTATGATGTTCAGTACACAGACATTGACTACAT
GGAAAGGCAGCTAGACTTTACAATTGGTGAAGCATTCCAGGACCTTCCTCAGTTTGTTGACAAAATAAGA
GGAGAAGGAATGAGATACATTATTATCCTGGATCCAGCAATTTCAGGAAATGAAACAAAGACTTACCCTG
CATTTGAAAGAGGACAGCAGAATGATGTCTTTGTCAAATGGCCAAACACCAATGACATTTGTTGGGCAAA
GGTTTGGCCAGATTTGCCCAACATAACAATAGATAAAACTCAACGGAAGATGAAGCTGTTAATGCTTCC
AGAGCTCATGTAGCTTTCCCAGATTTCTTCAGGACTTCCACAGCAGAGTGGTGGGCCAGAGAAATTGTGG
ACTTTTACAATGAAAAGATGAAGTTTGATGGTTTGTGGATTGATATGAATGAGCCATCAAGTTTTGTAAA
TGGAACAACTACTAATCAATGCAGAAATGACGAACTAAATTATCCACCTTATTTCCCAGAACTCACAAAA
AGAACTGATGGATTACATTTCAGAACAATTTGCATGGAAGCTGAGCAGATTCTTAGTGATGGAACATCAG
TTTTGCATTACGATGTTCACAATCTCTATGGATGGTCACAGATGAAACCTACTCATGATGCATTGCAAAA
GACAACTGGAAAAAGAGGGATTGTAATTTCTCGTTCCACGTATCCTACTAGTGGACGATGGGAGGACAC
TGGCTTGGAGACAACTATGCACGATGGACAACATGCAAATCAATCATTGGTATGATGGAATTTAGTC
TGTTTGGAATATCATATACTGGAGCAGACATCTGTGGTTTTTCAACAACTCAGAATATCATCTCTGTAC
CCGCTGGATGCAACTTGGAGCATTTTATCCATACTCAAGGAATCACAACATTGCAAATACTAGAAGACAA
GATCCCGCTTCCTGGAATGAAACTTTTGCTGAAATGTCAAGGAATATTCTAAATATTAGATACACCTTAT
TGCCCTATTTTTACACACAAATGCATGAAATTCATGCTAATGGTGGCACTGTTATCCGACCCCTTTTGCA
TGAGTTCTTTGATGAAAAACCAACCTGGGATATATTCAAGCAGTTCTTATGGGGTCCAGCATTTATGGTT
ACCCCAGTACTGGAACCTTATGTTCAAACTGTAAATGCCTACGTCCCCAATGCTCGGTGGTTTGACTACC
ATACAGGCAAAGATATTGGCGTCAGAGGACAATTTCAAACATTTAATGCTTCTTATGACACAATAAACCT
ACATGTCCGTGGTGGTCACATCCTACCATGTCAAGAGCCAGCTCAAAACACATTTTACAGTCGACAAAAA
```

FIGURE 495 cont'd

CACATGAAGCTCATTGTTGCTGCAGATGATAATCAGATGGCACAGGGTTCTCTGTTTTGGGATGATGGAG
AGAGTATAGACACCTATGAAAGAGACCTATATTTATCTGTACAATTTAATTTAAACCAGACCACCTTAAC
AAGCACTATATTGAAGAGAGGTTACATAAATAAAAGTGAAACGAGGCTTGGATCCCTTCATGTATGGGGG
AAAGGAACTACTCCTGTCAATGCAGTTACTCTAACGTATAACGGAAATAAAAATTCGCTTCCTTTTAATG
AAGACACTACCAACATGATATTACGTATTGATCTGACCACACACAATGTTACTCTAGAAGAACCAATAGA
AATCAACTGGTCATGAAGATCACCATCAATTTTAGTTGTCAATGGGAAAAAACACCAGGATTTAAGTTTC
ACAGCACTTACAATTTTCCCTCTTCACTTGGTTCTTGTACTCTACAAAATATAGCTTTCATAACATCGAA
AAGTTATTTTGTAGCGTACATAATGATAATGCTAATTTTATTATAGTAATGTGACTTGGATTCAATTTT
AAGGCATATTTAACAAAATTTGAATAGCCCTATTTATCCTTGTTAAGTATCAGCTACAATTGTAAACTAG
TTACTAAACATGTATGTAAATAGCTAAGATATAATTTAAACGTGATTTTTAAATTAAATAAAATTTTTAT
GTAATTATATATACTATATTTTTCTCAATGTTTAGCAGATTTAAGATATGTAACAACAATTATTTGAAGA
TTTAATTACTTCTTAGTATGTGCATTTAATTAGAAAAAGAGAATAAAAAATGTAAGTGTAAAAAAAAAAA
A

FIGURE 496
SEQ ID NO: 488
```
Genbank ID       : NM_006183.2
Unigene ID(#167) : Hs.80962
Unigene name     :       neurotensin NTS
```
>gi|6006028|ref|NM_006183.2| Homo sapiens neurotensin (NTS), mRNA
CATAGTTCACTCACTTTCAAAGCCAGCTGAAGGAAAGAGGAAGTGCTAGAGAGAGCCCCCTTCAGTGTGC
TTCTGACTTTTACGGACTTGGCTTGTTAGAAGGCTGAAAGATGATGGCAGGAATGAAAATCCAGCTTGTA
TGCATGCTACTCCTGGCTTTCAGCTCCTGGAGTCTGTGCTCAGATTCAGAAGAGGAAATGAAAGCATTAG
AAGCAGATTTCTTGACCAATATGCATACATCAAAGATTAGTAAAGCACATGTTCCCTCTTGGAAGATGAC
TCTGCTAAATGTTTGCAGTCTTGTAAATAATTTGAACAGCCCAGCTGAGGAAACAGGAGAAGTTCATGAA
GAGGAGCTTGTTGCAAGAAGGAAACTTCCTACTGCTTTAGATGGCTTTAGCTTGGAAGCAATGTTGACAA
TATACCAGCTCCACAAAATCTGTCACAGCAGGGCTTTTCAACACTGGGAGTTAATCCAGGAAGATATTCT
TGATACTGGAAATGACAAAAATGGAAAGGAAGAAGTCATAAAGAGAAAAATTCCTTATATTCTGAAACGG
CAGCTGTATGAGAATAAACCCAGAAGACCCTACATACTCAAAAGAGATTCTTACTATTACTGAGAGAATA
AATCATTTATTTACATGTGATTGTGATTCATCATCCCTTAATTAAATATCAAATTATATTTGTGTGAAAA
TGTGACAAACACACTTATCTGTCTCTTCTACAATTGTGGTTTATTGAATGTGTTTTTCTGCACTAATAGA
AATTAGACTAAGTGTTTTCAAATAAATCTAAATCTTCAAAAAAAAAAAAAAAAAAATGGGGCCGCAATT

FIGURE 497
SEQ ID NO: 489
```
Genbank ID       : AW452357
Unigene ID(#167) : Hs.27373
Unigene name     :       Clone IMAGE:4816940, mRNA
```
>gi|6993133|gb|AW452357.1|AW452357 UI-H-BI3-alr-d-03-0-UI.s1 NCI_CGAP_Sub5
Homo
  sapiens cDNA clone IMAGE:3068213 3', mRNA sequence
TTTTTTTTTTTTTCCCCCATCTGTTTGCCAGAGGGGTGGGACTGGCAACAGAACAGCCGTGGCTGCTTTA
TCTCTCCTCTCCACGGTGTACTCAGGCCTGAGTGGTGACTCACGGGAGCCTGGCCACCTCGCAGCTGTTC
GCCCCGCCAACTTTTGAACTGGAACTGCTGGCTCACACAGGGTTTTCGACAACTGCAGCTGAATCTCATG
GAAAAGCTGGATTCCTCTGCCTTACGCAGAAACACCCGGGCTCCATCTGCCAGGTGCTTGCCACTGGTCC
TGGCAGAAATGGCGGCTGCTGAAAGTGACCTTCCAAATCCTTGGTGGCACTTCAGCGCCACAGGCTCTCC
AATAAAAACCCTTTACCCTCGTGCCGAATTCTT

FIGURE 498
SEQ ID NO: 490
```
Genbank ID       : AC007842
Unigene ID(#167) : acc_AC007842
Unigene name     :
```
>gi|5080755|gb|AC007842.1|AC007842 Homo sapiens chromosome 19, BAC 331191
(CIT-
B-471f3), complete sequence
AGCTTAAACACTTACCATCTAGCCCTTTAGAGAAAAGGTGCACTTGACCCCAGTTGAGATCTGTGCCCCA FIGURE 498 cont'd

```
GGGGTCCTTGTGTCTGCGATGCCAGCCCTGAGAGCATCCATGTCTGAGATCCCAGCCCCAGGGTTCTCTG
TGTTCAAGACCTGGGCCCCAGGCCAGGTGTGGTGGCTCAGGCCTATAATCCCAGCACTTTAAGAGGCTGA
GGTGGGAGGATAGCTTGAGCCCTGGAGTTTGAGACTAGCCTGGGCAACATAGTAAGACCCCATTTCTACA
GAAAGATTAATAAATTAGCCAAGCGTGGTGGTGTGCCTGTAGTCCCCCACTACTCGGGAGGCTGAGGC
GGGAGGATTGTTTGAGCCCAGGAAATCGAGGCTGCAGTAAGCTACACTACACTCTAGCCTGGGCCACAGA
GTGAGACCTTAGCTCAAAAATAAAAAAAAAAGATCTAGGTCTCAGGGTCCCCCATGCCTGAGACCTCAGC
CCCCTGGACATCTCCACATTTGATAGAAATTGGTCTCCAATTTCTCCAGGTCCTGGAGGCCTCTGTGCCC
AAGACTAGGGCCCTGGGGTGATCTTCTGGCAAGAGCCCAGTGCCAGGGTCTCAGCAGGATTTGAAACGTT
TGAGACCTTAACTAGGTAAGTCTCATGGCCTGGGGTGTCCCTCAGTGCAAGACTCCATCCCTGAGGGTTG
CTGTATTCAAGACAGTAGCCTTGAGGGTGTCTCACTGCTGAGGCCCTGTCCTGGAGGGTTTCTGTGTCTG
AGACCCTGTTCGTACAGTTACTACATGTGTGACCCCAGCTTGCGGAACCCCTGTGTGGGAGAGGCCAGCC
TTCAAACGTCTCCTTCCTCCTGTGTCCATTATCAATGTACCGCCTCTCAGCTTCAAATACACCCGCGGAG
TTAAGCTTTGTCAACAGAGGGCGCTGGAGAGTCACTGAAGGAGGGAGGGGCTCCTGTTCTGGCTTCTAGC
CAGTTTGGTCCTTCCAGCTCTGGCCAGGGTGCGGGCCACATTCAGCGAGTGCCACTGGCCGCAGCTGGC
TTCCCAGTGAGGGGTTCCCTTCTTGCCAAGTCCAGCCTGCAGAAACCTCTGTGCCACCCAGTGGGCTACA
GCTGCAGTGAGACTGGACTCAGCCTTGGGGCTGATTCTCCCCTCCTTGAAGAGAAGGGGCCAATTTCTCC
CTTCCATGAGGCTTTTACCTTAGCCCTAGAGTGGCGGCTACTTCCTGTGTGTGCTTTGGTGGTATTCTTT
AGTGCTCTCTTTACCGTTTCTTATTTATGTTTATTTATTTATTTGTAAAGTCTGGGGGATTCCCACATCA
GAGACTATACCCCTAGAAATCCTGATCTTCCAGTTAAGAGGGGTCCCCATATCCAATGTCCTGCCTTGGT
GAGGTCTCCGTGCGTGAGACTCAGAACTCTGCTCTCTGTCCCTGCCCCTGGGATCCCAGTCTCTCCCCTG
CCCTTTGGTGCTAGTGTCTGAACCCCAAGCCCGATCCCACACATCAGTGTTCCGCTCATGATGGAACCCT
AGGCTGCTGCTCTTGTATTCTAAAGTCTTATAGGAACCTGACCTCTTCACTTACATAGTCTACGGCTGCT
TTCATGCCACAGTGGCAGAGTGAGTAGCTGGAACGAGAACCTACAGCCTGCGAGCTTAAACATTTACCAT
GTAGCACATTAGAGCAAAGGCGCGCCTGTCCCTGCCTTATACCGAGGGTCTCTGACATCCACCCTGAGAA
AACTACCTCTGAGGGTCCCCACAGCCTGGATTTTCCCTAAGGGTCCCTACCTCCCAAAGTAGGTGGCCCT
GGCCCTGTGAAACCTGGTCTAGGGTTCCCCAGGTCTGCAACCTCAATCATTAGTCCTGTGCACCTCCCGC
CATGGACACCCCAGTTACACTACCCGCAGCCCCAGAGTCCCCATCCTCCATCCCTAGTCCCATCAGCCCC
AGTCCCAGCCCAGCCCAGCACCTTTGTTGACGCAGCTCAGGATGCCTCCGGAGGGCTGGCACACC
TGCCCCGGCTTGCAGCTGTGTTCCTGGCACACCACGACTTTACCCACATGGCACGTGCACTGCTGCCGAC
AGTTGTCAATGAGGACTGTCTGCTCCGGCTGTGGGGAGAGAGGGAACGGCCATCAGGGACACCACGGGTG
GGAGCCGACTCTCACATCTCTGGCGTTCTGGCACAGAGGGGTTTGGCAGACATCACAGACAAGGGACATC
TCTCAGCAGGATGGCCCGTTGTCTGTGAAGATGAGGCACAGCATGGCTTTGGGGCCATCATTCATTGGTT
CATTCACTTTTCTTCATTTACTCATTCATTCCAAAATATCCACTCAACGTCTGCTGTAGGAGAAATGGTG
TGACACAGTAACTAAGGGCAGATCGCCTGGGCTTGGAGCCCATTTCTGCTGTTTCCAAAGTGTGTGACTC
TGGGCAGTTACTTCACCTCTTTATGGCTCAGTTTCATGATCTGCAGATTGCAGATGATAGTAGCGCCTGC
CTTTGGAAATATAACTGAGTTATATTCAGATAATAACCAAGTTATATTCAGACATGTAAAATTCAGATAA
AATGAAAAGGGTAGGCCGGGCGCGGTGGCACATGCTTGTAATCCCAGCACTTTGGGAAGCCGAGGCGGGT
GGATCACGAGGTCAGAAGATTGAGACCATCCTGGCTAACACGGTGAAACCCCGTCTCTACTAAAAATACA
AAAAATTAGTCGGGCGTGGTGGCGGGCGCCTATAGTCCCAGCTACTCGGGAGGCTGAGGCAGGAGAATGG
TGTGAACTCGGGAGGCGGAGCTTGCAGTGAGGCAAAACTGCGCCACTGCACTCCAGCCTGAGTGACAGAG
CGAGACTCCAACTCAAGGGAAAAAAAAAACAAAAACAGAAAAGGGTTTCCTTTAAAACATTCAGATAGGA
GAGATACGTGGGGTAGACATCAAACAAGATCGGGAGAATATGGCTTATTTTTGAAGCTAAGTGATGGGTA
AGTACATGGACAGTCATTCCACTATTCTCTTAATTTTTGCATGTTTGAACGTTTTCAGAATAAAAAGTTT
TTAGATATGTAATGCATATATAAAAATATGCACACATAGCACTTAAAACGGTACCAGATACATAGTAAGC
ACTATCTACACATTTTCTGTTATTATTAATATTATTTATGTGAGGAGAACAACAGAGAGGGTTCCACC
CCTAGGAGAGCTCACAGTCCCCAAGGGAGATGGACATTAGACAAACACATGCTCCAGTCAAAGAAAAAGG
ACCAATGGGGACAGAGTGGGAGAGGGAAGTAGAGGGTGTTAGCAGCTGGTATAACACATGAAAATCTTGT
CTTTGTGGTCAGAAAGGCTCCCTTCGTCCAGACCTGGAAGGCAAAGCCACAACTTGACCTGGGGAGTCAG
GGGAGGGTTTAAAGCTTCAGAGCCCGTGGTCATATTTAGAAAGCTCTTTACCACTGCCACGTGGAGGGTG
GACCAGAGGGAGCAAAGGTAGGAGCTGGAGGGACCCAGGTGGGAGAGGACCAGCTGGACCAAGGCAGGG
CCATGGGGACGGGAAAGGAGTGGGTACAAGAGACACTGAAGAGACTGAGTGGACTAGCTGTGGTGGCTC
ACGCCTGTAATGCTCGCACTTTGGGAGGCCAAGGCAGGAGGATCACTTGAAGTCAGGAGTTCGAGAGCAG
CCTGGCCAATATGGCAAACTCCACCTCTACCAAAATACAAAAAATTAACCGAGTGTGGTGGCACGTGCC
TGTACTCCTAGCTACTCGGGAGGCTGAGACAAGAGAATTGCTTCAACCTGGGATGCTGAGGTTGCAGTGA
GCTTGAACCCGAGAGGCAGAGGTTGCACTCCAGCCTGGGCAACAGAGCAAGACTATATCTTTAAAAAAAA
AAAAAAAAGAGGCTCAGTGGGTCGGGCATGGTGGCTCATGCCATTAATCCCAGCACTTTGGGTGGCCAA
GGGGGACGATGGCTTGAGGCCTGGAGTTCACGACCAGCCTGAGCAACATAGTGAGACGCCCCATCTCT
ATGTGTCCACAGGAAAATTAAAAATTCGCTGGGCTTGGTGGTGCGCACCTATAGTCCCAGGTACTTGGGA
GGTGAGGTGAAGGATTGCTTGAGCCAAGGAATTTGGGGCTGCAGTGAACTATGATGGTACCACTGCACTC
CAGTCTGGGTGACAAGAGTGAGACCCTGACTCTAAAAGAAATAAATAAGAGGCTAAGTAGACAGGCCGTG
GGGCTGATGAGCAGTGGGAGGGGTGAGACCCCATATTCTGCCCCAGATGACTAGGTTCCTACCTCATAGT
```

FIGURE 498 cont'd

```
AGGCACCATTGTGGTAGCAGCCACATTGCTGGATGGGCACGCAGGCTTGGCCGTTGTAGAGGAAGCCGGA
GTCACACTGGCAGCCCTCAGCACACCCATCTGGGCACTGCAGAGGGGCACTGAGAGCCGAGCAGCCCAGG
GAGCAGGTGTCCGCACAGAGCTCGTAGTGACTGTTCTGAGGGCATTCCATGGCTGCAAGGAGGGGGTGCC
GATCAGAGCCCTGGGGAGGGAGGGGCTGCAAGGCCCAGGGTCTACCCCTTCTGTGCCTCAAGCTCTCCCC
TCCCTGCCCCTCCGGCTCTCCCTCACTCACGACAGAAAGTTTCATTCCTCCAGGGCTCCACCTGGCCTCC
AGCTGCCTGGCAAGCACTCACGTAGGCATGGATGTTGCTGCAGAGAATGCTCAGGTTCCCACCACCCAGG
CAGAGATCAAAGATGCAATCTTTCAAGGGACCCTGGGGATCCACCAGCTTGTGGCAAGAGGACAGTGGCC
CTGTGGGGCTGGAGAGGAGCCCACAGAACTCCTCCTTCTGATACTTCTTCTCCAGCTCGGGAGGACACTC
CTCGCTGGGGATACAGCCCTCGCTCCCCGGCGGGCAGGTGGGCGGCGGCAGGCAGGGAGAGTCGGGCACC
ACCTCCTCCCAGGAGTTGCCGAACTCATTGGCGTTGCCTGCCTGCGAGCCATTGGGCTTCTGGAAGTCAT
CCTTGGGGTCGCCGTTGTAGTTCCCACACAGGCCACACATCAGCTGGTAGTAGTTTCCAGGGACGGTGAC
CCGCACATAGTACACAAGGTCGTAGGCCACACGCAGGCCGAAGTCGGTCTCAATCACAACATCTGAACCA
TGCTGGGAGGCACGGATCTGGCCGTTGGCCAGCACCACGGGCAGCTTCATGTCCACACCGTTCACCTGGG
AGGGGAAGAGAGGCAGGCCACGCTTCAGAAAGTATACTTTGAGTGAGGGTGGGACCCTAGTTCAAGCCCA
TGCCTGATGCTGATCTTTGTGACCTCACCCCTTAGGCCCTCAGTTTCCTATTTATTAAATGGATATAATA
ACAGGGCCTGATAGTAGATTGAATGGTGGTCCCCAAAAGACATATTCACCCAGAATCCCATAGCGTGAGC
TTACTCGGAATAAAGTTCTTTGCAGATGTAATCAGGGTAATAATCTCAACATGAGATTATCCTGGATTAA
ATTGGGCCTTAAATCCAATGACTAGTATCCTTATAAGAGCCAGAAAGAAAAAGGCAAAGAGACACACAGA
AAAGGCCACATGAAGATGAAGGCAGGGATTAGAATGGTGTTGTCACAAGCCCAGAGAACCTGGAGTCTGC
AGAGCTGGAAAGGGAAAGGAAGATCCCCCAACCAGTGTCTTTGGAGGGGGTGCAGCCCTGCCCACACCTT
GATGTTGAACTTCTGGCACCCAGGACTGTGGAACATACATTTCTAGTGTTTTAAGCCACCAAGCTCGTGG
TAATTTGTTATGGCAGCCATGGGAAACGAATACAGGTCTCGATGAAGTAACAAGCCTCCAGCTATCCTTT
GTTTACCGCTTGCTGCAGCCATTAATAAGCAATGATCGCCCCGGAGCCACTTGCCCCAGTTCAAACAGT
TTCCCCCTTACCCTCTTTGTGACCTTGGGCAAGTGAGTCACCTCTCCCTGTTTCTGTTTCCTCATCTATC
AAGTGGGAATAAGGCGTTTGCCCCATGGAACTGTTGTCAGGATCACATAAATTAGTATCTGTAAAGTGCT
GAGAAACGTGGCTGGCATAGCATGCATGCTTCAGGAGCATTTGCTGTTATTAGCAGCTATGAGTGGAGGT
TTTTCTTCTGAAGAGTAAACAGAACCACAGGTTTTTGCTTTAAAGCATCAGCGAGTGGAAAGTTAGGCTA
AATTCTTGGGGAAATGAACTTAAACCTATGAGCTGAGGACCAGTGGTTTCAGTTAAAGATTTACTAGGCT
CCAACAAAGCCTGGTAAATCCACCCCTGGACAGGGCACAGTGGCTCATGTCTATAATCCCAGCACTTTGA
GAGGCCAAGGCGGGAAGATCACTTGAGCCCAGGAGTTCAAGGTCAGCCTAAGCAATATATCGAGATCCTG
TCTCTACAAAATAAAAAGAAAACAAATTAACTGGGCATGGTGGTGCATGCCTGTACTCCCAGCCACTCA
GGAGGCTGAAGTGGTAGGATTGCTTGAGAGCAGGAGTTTGAGGCTGCAGTGAGCTAGGATCACACCACTG
CACTCCAGCCTTGGTGATAGAGCGAGACCCTGTCTCTAAAAAATAAATAAATACATCAACCCCTGATTAA
CATGCTTTCTTACCCTTCCTTATCACAGACAGTGCACACCGGATTCTTTTGGAAATGTGAAGAATCAGAG
GAGAAGGCAGGAGAAAGACATGCTCCTGGCTGAGTCTCCTAAAAAGATGGTCAACTGCCACACTTCCCAA
GCAGGGCTGGGCGGTGGGTAAGGGCAACTGACTTAGCCTTGCCTCAGTTTCCTCAGCTGTAAACTGCGGG
GTAATAAGAGCTCCCACATCTGTAGGGAAGCTGGGGGTTTCAGTAAGAAGCAACTAACAAGAACATCAAC
AACTCCTGTGTATTTAGGCGCTGTATGTCAGGGGCTATTCTAGGAGCTTGGGAAACATTAGGGAATATAT
TCAATTAAGTCCTGCATGTCGGCCGGGCACAGTGGCTCATGCCTCTATTCCCAGCACTTTGGGAGGCTGA
GGCCGGCAGATCACTGAGCTCAGGAGTTGGAGACCAGACTGGCCAACATGGTGAAACCCGTCCCACTAA
AAATACAAAAATTTCCTGGGCATAGTGTTGCACACCTGTAATCCCAGCTACTCTGGAGGCTGAGGCAGGA
GAATCACTTGAACCAGGGAGGCAGAGGTTGCAGTGAGCCGAGATCGCGCCACTGCACTCCAGCCTGGGTG
ACAAAGCCAGACTCTGTGCCAAAAAAAAAAAAAAAAAGTCACGCCTGTCCAGTTCGCCAGATTAAGTCAG
TAATTGATCAGCACCTTCGCCAATACTGCCACTAGAAAACAGCTGCGTGTCTGTTTCAGTGGGATCTCA
GGGGAAACCCCTCCACTGTAACTCAGATGCCAGTCTCCACATGAGACCAAATCTTCTCAGTAAGAAAAGC
ACTGCAGAGCAGCACGGGGTTCAAGCTCCACCTTTGCTGGGGACTATGGGCCAGTGATGGCCATCCCA
CTCTGAAAAATAAAGCAAGTCATAGTGCCTGCAGTCCCTGTTGCAAGCATACAGACACCATGGACGTGAA
GTGCCTGGCAGCCAAAAGGTGTGCAGTCAGCTGTATAGAAACTATAGCTGCTGTTGTTGTTAAGGCG
GTGAGAGTGTCACCCACAGATTGTCCTCTGTCCATGAAGCTTCTCCAAACTCGGACTTTCTCAACCTCTG
ATGGCACCACGTCCTGCCAATAAGTGGCAGACTAGGGAGGTGAGTAGGGCAGAATCCAGGACTGAGGTGG
AGAGAGGATGGAGTGGGAGGGAGGAGAGGGTGGGAGAAATTTGAGAGAAAAGTCAATGCATGGAGGTAA
AGAGAGGGTGGAGACTGAGGGACAGAGATGGGGGAGCAGCTCCCAAGTCCCTGATGACACCTCCCTCATT
GGCTTCCCACTCGGTTCTGACTGGCATCTTCTGTCCTCAGAGACCCCAGGCCTCGCACATGCACTCTCAT
CTCTTGTGCCCCAACTCCTGGGCTGAGCGCTGCCTGTGCCCCACCTACCCACAGGCCCCTCGCCCCCTG
CTCCCCATCTGCTCTCACCGTGACCTTCCACTGTCTCTGCTCCAGCCGCAGGGTGAAGTTTGCCACCTGG
ACCGTGATCACCCTGGTCACACTGACTCGCCCATTACCCCAGGCCACGTTCTCCTGCAGGACGGCAAACC
GATGTAGGCCAGGCCGGGTGCCGCAGGTCTGAGCCAGCACATACACGCAGGTGCCCATGAAGTCGAAGCG
GCGGCCATCGAAGGTGGTGTAGTGGGGATCTCCCGACGCCTGGCAGGTGGTAGAGCCCACGGCCACGCAG
CCCAAGCTGCCACCGGATGGCCGGCAGGTCTCATGCGGGCCGCAGCTGGAGGGCTCACAGGACACCTCAC
CGCCCTCCCGGCAGCGGCAAAGGGAATCACACCCAGGGCCAGGGTAGAAGGTCTGGCCCAGTGGGTAGTA
GCGGTCATCGTGGAGGCAGCCACACTGGCCCACAGGTACACACGTGTCACCACTGAGCACGAAGCCAGCA
```

FIGURE 498 cont'd

```
TCGCAGACACAGCCTTCACGGCAGGCCGACTCACAGCCCTCGGGTGCCGACAGGCTCGGGCAGCTCCCAG
GACAGGAGTCACCGCAGAGCTCGTAGTGGCTGTGGGCAGGGCACTGGAAGGCTGTGGGGACAAGGTGGGC
ATCAGCCAGGTAGGTGTTTGAGTCGCAGTCTTGGGAGGCCCTGAGTGGGAAAACTGCTCAGGCCAACTTG
GGCGTCTCTGGGTAGGCACATGTGATCCAGGACATCTAACTGGGGGACTCAGCGTGGGACCTGGAATGGG
AGGGGACATGCCCAGGTCTCTCTGACCAAATATTTCTGAAGATCAAATGACTCTGCTTGGCTGATTTTTT
TTTTTTTTTTTTTTGAGACAGGCTCTCACTCTATCTCACCCAGGCTGGAGTGCAGAGGCGCAATCACAG
CTCGCTGCAGCCTCCACCTAAACCTCAAGCAATCCTCTGGCCTCAGCCTCCCGATTAGCTGGGACTACAG
GAGTAAGCCACCACATCTGGCTGATTTATTATTATTTTGTGTAGAGATGGGGTCTCACTATGTAAGCCAG
GCTTACCTGGGTGAAATGGATCACTTATATCTATTCGGGGTATGCAGGATCAGAACTGACTATGGGCATC
TCAGCGTGTGAATGTGACTGGGGTGTGGGCCACATGTATCTCAGGGTATGGCTCTGCCTGAGGGCACCC
AGCTGTGGGTGTCTGACATGCAGCATCTCCCAGAGTCCTTCTGACATGGTCTGCCTAAGGGTGTGCCTGG
GTGAAGTTGGCAGGATACCTGTGACCAGGAGACCTGCCTGAAGGGAACCGCCTAGGACTATCTAACCATG
CATCTGTGTGGATCTGCCCAAGGCTATGCCAGGATCCTGTTTCTTTCTGAGTGTATCTGACCAGTCAGTA
TAAAATTTAAGCAGATATCACTGAAGGTATGCGACTAATTCCATGTGACTAGGTGTATTTCAGTGTGTGC
AACAGACCTGGGCCCTCTGACCAGCTGAAACTCACTAGGTCTTCCTAACAAGGGGTACTTTGCTATGTGA
CAGAGGCAGGGTCAGCCATCCCAATCTACATGCCTTGGATACCTGAAAGCATGGATCACCAATCCCTAAG
AGTGTCCTGGACCCCAGGTTTCTTTTCTTTCTTTTTTTTTTCTGTTGTTTGTTGTTTGTTTTTTG
TTTTGGAGATGGAATCTCTGTCACCCAGGCTGAAGGGCAGTGGCACGATCTCGGCTCACTGCAACCTCTG
CCTCCTGGGTTCAAGTGATTCTCCTGCCTCAGCCTCCTGAGTAGCTGAGATTACAGGTGCCCGCCACCAC
GCCCGGATAATTTTTGTAGTTTTAGTAGAGGTGGGGTTTCACCATGTTGGCCGGGCTAGTCTCGACCTCC
TGACCTCAGGTGATCCGCCCGCCTCGGCCTCCCAAATTGCTGGGATTACAGGCGTGAGCCACCGCGCCCA
CACTCTGACTAGGTGTTTCTAACGGACTCTCTCACTGCAGTACCTGACTTGGGGCATTTCAGTGTGTC
AGTGCCAAGGTGTTTCCTGACAGTAGATACCGAGCTCGGGAAGGAAGGTGGCCCCTCAGCCTCATGGAGG
AGGAAGGGGCTGCTGTCCTACAGTCCTGGGAAGGGCAGGGAGAGACCCTACTATGTGGACCATGCATGGA
GCAGTACTCACGACAGAAGTCCGGCCGCCTCCACTCGCGGAGCTGGGCCCCAGCGGCCTGACAGGCTGCC
ACGTAGGTGGCCACTGCAGGACAGAGGCCTCCAGGATGGCCCTGAACTTGGCAGGCGTCCAGCAAGCAGC
CCTGGAAGTACTGCGCGGGCGGCACAAGGCCGTGGCAGGGCGCCAGCGGGCCGTCGGTGGCGGAGATCAC
GCCGCAGGCGTCCGGGCCGCCGAAGGACTCTTGCTGCTCTGGGGTGCACGGCGACGGGCATGGCTTGGAC
ACACATTCCCCGCAGCCCTGGGCGCCGCCCACCTGCCATCCGGCGGGCTTCCCGCCCACCGCCTTCAGGT
CGTCTGCGGGGTCCTGGTTGTAGTTCCCGCATAAGCCACAGAGAGAGCCCGCGTACGCCGCCGGCACGCG
CAGGCGCACGAAGCTGTCCCCGTCGAAAGCCAGCGAGAGCCCTGAGGTTGTGGTCACCACCACGTCGGCG
CCGCTCAGGTGTGCGTGCAGGAGCGAGTCCAGCTGGAAGGGCAGAGTGACGAACACGCCGTCCACCTGTG
GGCAGTGGGGGAGCGGTGAACGGAGCAAACACGGGTTTGAATCCTGGCCCCACTACCTACTAGCTGTGGG
ACCCAGAGCATGTCACCTCCCGCTGAAAATAATAATGAGCATCTATAGGCCGGGCCTGGTGGCAAAGCCT
GCAATCCCAGGACTTTGGAAGGCCGAGATGGGAGGATCGCTTGACGCCAGAAGTTCAGATCAGCCTGGGC
AACATAGTGAGACCCCCATCTCTACAAAAAAATGAAAATTAGCCAGCGTGGTGGCGTGTGCCTTTAGTC
ACAGATACTTGGGAGGTGGAGGCCAAGGCGGGAGGATCGATTCAGCCCACGAGTTCCAGGCTGCAGTGAG
CCCTAATCCTGTCACTGCACTCCAGCCTGGGCAACAGAGTCAGGCTAAGAAAAGAAAGAAAGAAAGAAAG
AAAGAAAGCAAGAAAGAAAAAAGAAAGAAAACAAAGAGCCTCTACTGGCTCATGTCACTGACTCCT
TATCCTTCTCGAAAACAGGTACTTTTCCTAGACCAGTTTACAGAGGAATACACTAGGCTCACAGAGGAAG
AAGCTGCTGTGCCAAGCCGTCAGGCTCCTAGGCGTACACTCTGACCCTTCCATCATGCCCCAGCTAAGCT
GTGAAAGGTGCCCAGGGGAATGGTGAAGCCCTTACCATCTCAGGCAACCCCAGAGCTGGCACTTGCTCCT
GTCTGGCCCACAGCCCTCCTCACCTGTAGCTTCCGGGCCAGCGGGCACTCAGTGTCAGGCTGTGGTTGT
AGATTTGCAGGGTGACACTGCGGGTGTAGCTGACAGCCTGGCTGCCCCGGTGCTCATTGGCTACAGTGAC
AGTGAAGTTCTCAGCCCCAAGGGTGGTCCGTGGCAGGGTGCACTCAGCAGGTACTCGCAGGTGCCTTGG
AAATTGAATCGGTGCCCATCCAGAGTGACGTAATGGGGGTCACCCCACGCCTGGCACTCAGCTGTGCTGA
CGGGCTGGCAGCCGTGCTGGCCGGATGGCAGGAGGCCACACACTTCACCCAGCCCACAGCTGGCAGGTGT
GCAGACCAGCGAGCCACCCCAGGCCCGCAGCGACACCACTGGGAGCAGGTGCCATCAGCCCAAAACTCA
CTGCCCGCCTCGTGGTAGGTGCCATTGGCCCAGCAGCCGCAGCCGTTGTTGAGGGGAACACAGCGGTCAG
CACTTAACACGAAACCCGCGTCGCACTGGCAGCCCTCCACACAGGGGCCCTCACATACGGCTGGCGTCGT
AAGGGGTGCAGGGGACGGACAGCTGGCCGGGCAGGGTGAGCCACAGACCTCATAGTGGCTGTTTCTGGG
CAGGTGATCTCTGTGGGCAGATGAAGGAGCAGGAAGGAGAGAAACAGAAGAAGGGTGTTAGGGGTGGGG
TCCCAGAACAGGGTGGGAGGAGACAGAGAGAGACACTAGGGAGCAGACAGAGAAAGGGGGAGACAGAAAA
CAAGACACAGAGAGAGGACACAGAGAAAGAAATGGGAGAAAGCGAGACACCAGGAGACCCAAGCAGAAAC
TGAGGGAGCTAGAGAATGAGAAACAGACAGATAGAGACAAGCAAAGCGAGGCCCAGAGACGAGCACCAAG
AAACAGAGAGACAAACAGAGAAAAAGAAAACAAAGAGACCCAGAAGGACCAGAGTGAAACCAAACCAGC
CCCGAAGAGATGGGACCCCGCCCCCAGCCCCGCCTCTGCTCCCCAACACTCACCACAGCCAACCTGTGC
CCGCCAGTCTTCGATGACAACCCCAGCAGCCTGGCAGGCGGCCACATAGGAAGCCAGAGCCTTGCAAAGA
ATGTCACGGTCCCCACCACCCATGCAGACGTCCAGAACACAGCCCTTGAAGAAGCTCTCAGGTGGCACAT
GAGCATGGCAGGTGGTGAAAGGGCCCCCTGTGCCGGGGGCCAGGGGTCCGCAGAAGCCAGGGCCCTCGTA
CTGCTCCAACCGGTCCTCAGGGCACGTTGGGCAGGACCCCCGACATTCGTCCCAACACAGTGGGTCCCAG
```

FIGURE 498 cont'd

CCTGGGGCTCGCCAGCTGCCGCCCCAGATGGGTATGGAGGGAGCCAGTGTGCCATTAGGGAAGACCTGGT
CATTGTTGGGGTTGCGGTCCATGTTACCGCAGAGCCCGCACACTGCGCCATGATAGCTGCTGGGCAGCGT
CACGTCTACCCGCCAGTTCCAGTCATAGCTGACTTGCAGTCCAAAGTCAGCCACCAGCAGTGCCTTCGAT
GCACCCTGGGTCACTGAAATCCGCCCGTCGGCCACAGAGACAGGCAAGGCTGTGAGCACACCGTTCACCT
GGGGGAAGGAGGGAAGGCAAACGGGTCACTGGAGGTTTTACGGCCCCAGCTCTGGCCCTCTGCCTCCCTC
TCTCTCATCCCACCGGGGGCTGGAGAGGCCAGGGCCTTCCCCCGAGAGTTGGATTGTCATCTGACACAC
TGTGGACAGTTGTTCTAGCCCAGGTCTTGGGGAACGAAACCTCACTTTACTTTTTCTAGATCTTCTCCCT
TCATCTCTATCTCCCTCCCCTGTCTCTGTCTCTCTCTGTGTCTCTCTCCCCTGTCTTCACCTAAGGC
TATGCCTCTGGGTCTTCTCTCTCTGTCTCTGTCTCTCTCTCTCTTTCTGTCTCTCTGTCTCTGTCT
CACCCTTTTCCCTTCCTCCCTACCTCCCTCATTCTTTGTGCATCTCTTCCACTCACTCACCATCATTTAT
TCAGTGCCTACTCTGCTGCATCACTCAGTCTCTCCATGTGAGCTGCCATCAAGCTACATCTCCATTTCCT
TGGGCAGAAAGGATAGCCCATTCCTCTCCCCATCTCCCTATATTTCTTTTTCTTGATTACTTTTTTTAT
TTTTCAGACGGAGTCTCACTATGTCACCGAGGCTTGTGTGCAGTGTTGCAGTCTCGGCTCTTGTAACCTC
TGCCTCCCAGGTTCAAGCAATTCTCCTGCCTCAGTGTCCTGAGTAGCTGAGAATTCAGGAGCATCACCAC
ACCCAGCTAATTTTTGTATTTTTAGTAGAGACGGAATTTCACCATGTTAGCCAGGCTTGTCTCGAACTCC
TGACCTCAGATGATCCATCGGCCTCGGTCTCCCAGAGTGCTGGGATTACAGGCGTGAGCCACCGCACCTA
GCCCGATCTCCCTGTATTTCTCTCCATGTCCTGGTCTCTGGGCCTCTCACTTTTCCCTCACCGACACTCA
AACGACTGTTCACCTGGACTAGACTCTGAGCTCAGCATGTGACATGCACGGCCTTGCTGTGGGGAGGCC
CTGATACGATGCCCACTTCACAGATGAGGAAACTGAGGCCTACCAAGTGAACTGCCCAGCATCACATAGC
TCATAAGGAGGAGAGGCTGGATTGAAACCCAGGTCTATAAAAAAGGCAAATGCTGAGGTCCTATGTTAAA
GCCCTTTGCCAGGGGCTAGGCTCATTTAATTCCCAGTAACAGGGTGACATTTTGTTGCAATTATTCTCT
TTGTTGACAGTTTGTTTCAGGCCCAGGTGAAGACAAAGAGCCTTGAGCTGCTAACTGTGGTCGTCAGGAT
CCCTCCTGCCCTCCCGGGGACCTCAGGGGACCATCCTGCCACACATACCCGGACTTTGCCGATCTCGTCC
TTGTGGATGGAGATGTTGGTGCCGAGGGCAGCCACGGTGACGACTCTCACGTAGGACACAGCAGGGTTGC
CCCGGTTCTGGTTCTTGGTGGTGACGGTGAAGGGTGTCAGGCCCTGGGTGCTGACCCCCGGGCAGCCAGT
TGTTGCCAGCACATAGTTACAGGTGCCCTGGAAGTCAAACTTCCGGCCATCGAAGGAGTGGTAGTGTGGG
TCGCCCCACAGCCAGCACGTGGCCTCATAGTTGGGCAGGCACACGCCCTGGCCACCCTGCTCCTTGCATG
TCTCCTGTGGCCGGCATGTCACGCCGTGGCACGGGTCTGGGGACAGAAGAGGGAGGAGGACCTTGAGGGG
CTGCCCATTGTAAAGGATGGCCGCTCCCTCCACATCTACCCCAGTCTGTGCCAGGGATCTGAGGGTTACT
GCAGGCAAGACCACATTCCAGAGTCCTCATGTCTAGGACCCAGGTCCTATAGTTTGCTTTTTTATTTGT
TTTGTTTTGTTTTATTGGTTTTTTGAGATGGAGTCTTTCTGTCACCCAGGCTGGAGAGCAATGATGCA
ATCTTGGCTCACTACAACCTCTGCCTCCCGGGCTCAAGAGATTGTCCTGACTGAGCCTCCTGAGTAGCTG
GCATTACAGGTGCCCACCAGCATGCTTGGCTGATTTTTGTATTTTTAGTAGAGACAGGGTTTCACCATGT
TGCCCAGGCTGGTCTTGAGCTCCTGACCTCAAGTGACCTGCCCACCTCAGCTTCCCAGAGTGCTGGGATT
ACAGGCCTGAGCCACTACGCCCGGCCTGCTATTTTCAAGACCAGCCCCTGGGAGTCCTGCACATCTGACA
CTGAGGCATCATGGTGGACTGTGTCTATGTCTCGGGTGTCAAAGTTCCCATATCTGAGATCCCGGCCCCA
GAGGTCCCTACAGCCAAGACTTAGGCCCTAGAGTCCCCCTGCCTCTGAGACTGAGGCCCTGCCATCTGCT
GTGTGAGACTGAGGTCCTGGAGTCCCTGCACCTAAGACCCAGTCTCTGGGGTCCCCATGTTTGAGACACT
GGTCCTGCAGATTTCTGTTTTTAAGTTACAGTTTCCATTGTGCCCTTGCTTGAGAGTTCAGCCTGTTCTT
ATATTCTAAAGCTTTATAGAAACCTCACCGTCTTCACTTACATAGGCTACGGCTGCTTTCACACCACAGT
GGCAGAGTGAGTAGTTGTGATCCAGAAGGTATAGCCTGCAAGCTTAAACACTTACCATCAGCCCTTTAG
AGAAAAGGTGCACTTGACCCCAGTTGAGATCTGTGCCCCAGGGGTCCTTGTGTCTGCGATGCCAGCCCTG
AGAGCATCCATGTCTGAGATCCCAGCCCCAGGGTTCTCTGTGTTCAAGACCTGGGCCCCAGGCAGGTGT
GGTGGCTCAGGCCTGTAATCCCAGCACTTTAAGAGGCTGAGACGGGAGGACCATTTGAGCCCTGGAGTTT
GAGACCAGGCCTGGGCAACATAGCAAGACCCCATTTCTACAAATAACTTAATAAATGAGCCAGGCATGGT
GGTGTGTGCCTGTAGTCCCCCACTACTCAGAAGGCTGAGGCGGGAGAATTGTTTGAGCCCAGGAGATGGA
GGCTGCAGTGAGCTATGATTGCATCACTACACTCCAGCCTGGGCGACAGAGTGAGACTTATCTCAAAAAA
AAAAAAAAAAAAAAAAGATCTAGGCCTCAGGGCCCCCATGCCTGAGATCTCAGCCCCCTGGACATCTC
CACATTTGAGAGAAATTGGTCTCCAATTTCTCCAGGTCCTGGAGGCCTCTATGCCCAAGACTACGGCCCT
GGGGTGATCTCTGGCAAGAGCCCAGTGCCAGGGTCTCAGCAGGATTTCAAACGTTTGAGACCCTAACTAG
CTAAGTCTCATGGCCTGGGCTCCCTCAGTGCAAGACTCCATCCCTGAGGGTTGCTGTGTTCAAGACAGTA
GCCTTGAGCGTGTCTCACTGCTGAGCCCTGTCCTGGAGGGCTTCTGTGTCCGAGACCCTGTTCGGACAG
TTACTACATCTGTGACCCCAGCTTGCGGAACCGTGTGTGGGAGAGGCCAGCCTTCAAACGTCTCCTTCC
TCCTGTGTCCATTATCAATGTACCGCCTCTCAGCTTCAAATATACCCACGGAGTTAAGCTTTGTCAACAG
AGGGCGCTGGAGAGTCACCACAGGAGGGAGGGGCTACTGGTCTGGATTCCAGCCAGTTTGGTCCTTCCAG
CTCTGGCCAGGGTGCGGGCCACATTCAGCGAGTGCCACTGGCCGCAGCTGGCTTCCAGTGAGGGGTTC
CCTTCTTGCCAAGTCCAGCCTGCAGAAACCTCTGTGCCACCCAGTGGGCTACAGCTGCAGTGAGACTGGA
CTCAGCCTTGGGGCTGATTCTCCCCTCCTTGAAGAGGAGGGGCAATGTCTCCCTTCCTTGAGGCCTCTA
CCTTAGCCCTAGAGTGGGAGCTACTTCTTATGTTTGCTTTGGTGGTATTCTTTAGTGCTCTCTTTACCGT
TTCTTATTTATGTTTATTTATTTATTTGTAAAGAGACAAGGTCTTGCTGTCTTGCCCAGGCTGGAGAGCA
GTGGTGCAATCATAGCTCACTGCAGCCTCGAAATCCTGGGGTCAACTGATCCTCCTACCTCAGCATCCTA

FIGURE 498 cont'd

AATAGCTGGGACCACAGGCACGCATCACCACACCTGGCTAATTTTCAATTTTTTGTGGAGACAGGGGTCT
CACTATGTTGCCCAGGCTGGTCTCAAACTCCTGGCCTCAAGCGATCCTCCCAAAGTGCTGGGTGTGTGAG
CCACGGCAGCAGGCCCTCTTTACCCTTAATAGTTAATCTCCTATTAATAAGTAAATGTTTAATTAAACTT
TCCTCATTCAAATGGCCATACGCTTTCTGTCTCTCGACTAGATGCTGAGTGATATACCCCCCATTCCTGG
GAGTCCCCATTATCCTGCTCATCAGCCCTGAGAGTCTTAGCCCCCACTCCTTGGTGCGGGAGCTCCCATT
CTCTTATCCTTAGGGGAGGAGAGTTCTCTGCTCTTCACCCTAAGAAATGAGCCCTGGGGGTGGCTGTGT
CCCAGATTTAGTCTCGGGGATTCCCACATCAGAGACTATACTCCTAGAAATCCTGATCTTCCACTTGAGA
TGGGTCCCCATATCCAACATCCTGCCTTGGTGGGGTCTCTGTGCCTGAGACTCAGAACTCTGCTCTCTGT
CCCTGCCCCTGGGATCCCAGTCTCTCCCCTGCCCTGTGCTGCTAGTGTCTGAACCCCACAACTAATCCCA
CACATCAGTGTTCTGCTCACGATGGCCCCCTAGGCTGCTGCTCTTGTATTCTAAAGTCTTATAGGAGCCT
GACCTCTTCACTTACATAGTCTACGGCTGCTTTCATGCCACAGTGGCAGAGTGAGTAGCTGGAACGAGAC
CATGCACCCTGCGAGCTTAAACATTTGCCATGTAGCACATTAGAGCAAAGGCGCGCCTGGGCCTGCCTTA
TACTGAGGGCCTCTGACAGCCACCCTGAGAAACTTACCTCTGAGGGTCCGCACAGCCTAGATTCCCCTTA
AGGGTCCCTGCCTCCCATAGTAGGTAACCCTGGCCCTATGAAACCCAGCCCAGGGGTCCCTAGGTCTGTG
ACCTCAATCTTTAGTCCTGTGCACCTCCCGCCATGGACACCCCAGTTACACCACCCTCAGCCCCAGAGTC
CTTGTCCTCCATCCCTAGTCGCATCAGCCCCAGGCCCAACCCCAGCTCAGCACCTTTGGTGACGCAGCTC
AGGATGCCTCCGGAGGGCTGGCACACCTGCCCCGGCTTGCAGCTGTGTTCCTGGCACACCATGCCTTTAC
CCGCATGGCACGTGCACTGCTGCCGACAGTTGTCAATGAGGACTGTCTGCTCCGGCTGTGGGGAGAGAGG
GAACGGCCATCAGGGACACCACGGGTGGGAGCCGACTCTCACATCTCTGGCGTTCTGGCACAGAGGGGTT
TGGCAGACATCACAGACAAGGGACATCTCTCAGCAGGATGGCCCGTTGTCTGTGAAGATGAGGCACAGCA
TGGCTTTGAGGCCATGATTCATTTGTACATTTGTTCATTCACTTTTCTTCATTAACTCATTCATTCCAAA
ATATCCGCTCAATGTCTGCTGTAGGAGAAATGGTGTGACACAGTAACTAAGGGCAGATCGCCTGGGCTTG
AAGCCCGTTTCTGCTGTTTCCGAACTGTGTGACTCTGGGCAAGTTACCTCACCTCTTGTTGGCTCAGTTT
CCTGATTTGCAAATTGCAGATAATAGTAGCACCTGCCTATGGAAATATAACCAAGTTAATAACACATGTG
AAGTGCAGATGAAAGGAAAGGGTTTCCCTTAAATCATTCAGATAGGAGAGATGAGTGGGGTAGACATGA
AACAAGATTGGGAGAATGTGGCTTATTTCTGAAGCTAAGTGATGGGTAAGTACATGGACAGTCATTCCAC
TGTTCTCTTGATTTTTGCATGTTTGAACGTTTTCAGAATAAAAAGTTTTTAGATATGTAATGCATATATA
AAAATATGCACACATAGCACTTAAAACGGTACCAGATACATAGTAAGCACTATCTACACATTTTCTGTTA
TTATTATTATTATTCATGTGAGGAGAACAACAGAGAGAGGGTTCCACCCCAGGAGAGCTCACAGTCCCCA
AGGGAGATGGACATTGGACAAACACATGCTCCAGTCAAAGAAAAAGGACCAACGGGGACAGAGTGGGAGA
GGGAAGTAGAGGGTGTTAGCAGCTGGTATAACACATGAAAATCTTGTCTTTGTGGTCAGAAAGGCTCCCT
TCGTCCAGACCTGGAAGGCAAAGCCACAACTTGACCTGGGGAGTCAGGGGAGGGTTTAAAGCTTCAGAGC
CCGTGGTCATATTTAGAAAGATCTTTACCACTGCCACGTGGAGGGTGGACCAGAGGGAGCAAAGGTAGGA
GCTGGGAGGGACCCAGGTGGGAGAGGACCAGCTGGACCAAGGGAGGGCCATGGGGACGGGGAAAGGAGTG
GGTACAAGAGACATTGAAGAGACTGAGTGGACTAGCTGTGGTGGCTCACGCCTGTAATGCTCACACTTTG
GGAGGCCAACGCAGGAGGATCACTTGCAGTCAGGAATTTGAGAGCAGCCTGGCCAATATGGCAAAATCCC
ATCTCTAACAAAACTACAAAAATTAACCATGTGTGGTGGCACATGCCTGTAGTCTTAGCTTCTTGGGAGG
CTGGCGCAGGAGAATTACTTGAACCTGGGATGCTGAGGTTGCAGTGAGCTTGAACCCAGCAGTGGAGGT
TGCACTCCGGCCTGGGCACAGAGCAAGACTATGTCATTTAAAAAAAAAAAAAAAAAAAGAGGCTCAGT
GGGTCGGGCCTGGTGGCTCATGCCATTAATCCCAGCCCTTGGGGAGGCCAAGGTAGGAGGATGGCTTGAG
GCCTGGAGTTCAAGACCAGCCTGAGCTACATAGTGATTCGCCCCCATCTCTATGTGTCCACAGGAAAATT
AAAAATTCGCTGGGCTTGGTGGTGCATGCCTATAGTCCCAGACACTTGGGAGGTGAGGTGGAAGGATTGC
TTGAGCCAAGGAATTCGGGGCTGCAGTGAGCTATGGTACCCTTGCCCTCCAGCCTGGGTGACGGAGTGAG
ACCCTGACTCTAAAAGAAATAAATAAGAGGCCAAGTAGACAGGCCGTGGGGCTGATGAGCAGTGGGAGGG
GTGAGGCCCCATATTCTGCCCCAGATGACTAGGTTCCTACCTCATAGTAGACACCATTGTGGTAGCAGCC
GCATTGCTGGATGGGCACGCAGGCTTGGCCATTGTAGAGGAAGCCGGAGTCACACTGGCAGCCCTCAGCA
CACCCATCCTGGCACTGTGGAGGGGCACTGAGAGCTGAGCAGCCCAGGGAGCAGGTGTCCGCACAGAGCT
CGTAGTGACTGTTCGGAGGGCACTCCATGGCTGCAAGGAGGGGTGCCGATCAGAGCCCTGGGGAGGGAG
GGGCTGCAAGGCCCAGGGTCTACCCCTTCTGTGCCTCAAGCTCTCCCCTCCCTGCCCCTCCGGCTCTCCC
TCACTCACGACAGAAAGTTTCAGTCCTCCAGGGCTCCACGTGGCCTCCAGCCGCCTGGCAAGCACTCACG
TAGGCATGGATGTTGCTGCAGAGAATGCTCAGGTTCCACCACCCAGGCAGAGATCAAAGATGCAATCTT
TCAAGGGACCCTGGGGATCCACCAGCTTGTGGCAGGAGGACAGTGGCCCTGTGGGCTGGAGAGGAGCCC
ACAGAACTCCTCCTTCTGATACTTCTTCTCCAGCTCGGGAGGACACTTGTGGCTGGGATACAGTCCTCG
CTCCCCGGCGGGCAAGGGTGGGCGGCAGGCAGGGAGAGTCGGGCACCACCTCCTCCCAGGAGTTGCCGA
ACTCATTGGCGTTGCCTGCCTGTGAGCCATTGGGCTTCTGGAAGTCATCCTTGGGGTCGCCGTTGTAGTT
CCCACACAGGCCACACATCTGCTGGTAGTAGTTTCCGGGGACGGTGACCCGCACATAGTACACAAGGTCG
TAGGCCACACGCAGGCCGAAGTCGGTCTCAATCACAACATCTGAACCATGCTGGGAGGCACGGATCTGGC
CGTTGGCCAGCACCACGGGCAGCTTCATGTCCACACCGTTCACCTGGGAGGTGAGAGAGGCAGGCCACGC
TTCAGAAAGTAGACTTTGAGTAGGGGTAGGACCCTAGTTCAAGCCCATGCCTGATGCTGAAGATCTGTGT
GACCACACCTCTTAGGGCTTCACTTTTTGTATCTCTAAAGTTGGTAGAATAATAGGGCCTGATAGTGGAT
TGAATGGTGGTCCATAAAAGACATATTCACCCAGAATCCCATAACGTGAGCTTACTTGGAATAAAGTTCT

FIGURE 498 cont'd

TTGCAGATGTAATCAGGGTAATAATCTCAACATGAGATTATCCTGGATTAAACTGGGCCCTAAATCCAAT
GACAAGTGTCCTTATAAGAGCCAGAAAGAAAAAGGCAAAGAGACACACAGAAAGGGCCACATGAAGATGA
AGGCAGGGATTAGAATGGTGGTGTCACAAGCCCAGAGAACCTGGAGTCTGCAGAGCTGGAAAGGGAAAGG
AAGATCCCCCAACCAGTGTCTTTGGAAGGGGTGCAGCCCTGCCCACACCTTGATGTTGAACTTCTGGCAC
CCAGGACTGTGGAACATACATTTCTAGTGTTTTAAGCCACCAAGCTCGTGGTAATTTGTTATGGCAGCCA
TGGGAAACGAATACAGGTCTCGATGAAGTAACAAGCCTCCAGCTATCCTTTGTTTACCACTTGCTGCAGT
CATTAATAAGCAATGATCGCCCCAGAGCCACTTGCCCGAGTTCAAACAGTTTCCCCCTTACCCTCTTTG
TGACCTTGGGGGTCACAAAGTCACCTCTCCCTGTTTCTGTTTCCTCATCTATCAGGCGGGAATAAGGTGT
TTGCCCCACGGAACTGTTGTCAGGATCAGATAAATTAATATTTGTAAAGTGCTGAGAAACGTGGCTGGCA
TAGCCATGCATGCTTCAGGAGCATTTGCTGTTATTAGCAGCTATGAGTGGAGTTTTTTCTTTTGAAGAGTA
AACAGACACCACAGGTTTTTGCTTTAAAGCATCAGCGAGTGGAAAGTTAGGCTAAATTCTTGGGGAAATG
AACTTAAACCTATGAGCTGAGGACCAGTGGTTTCAGTTTAAGGTTAATAGGCACCAACAAAGCCTCCTAA
ATCCACCCCTGGGCTGGGCACAGTGGCTTATATCTATAATCCCAGCACTTTGAGAGGCCAAGGTGGGAAG
ATCACTTGAGCCCAGGAGTTCAAGGTCAGCCTGAGCAACATATGGAGATCCTGTCTCTACAAAGTAAAAA
AAATAAAAAAAAAAATTGGTCAGGAGCAGTGGTTCACAACTGTAATTCCAGCACTTTGGGAGGCCAAGGT
GGGAGGGTTTCTTGAGCCCAGGAGTTCGAGACCAGCCTGGGCAACATAGCAAGACCCCTCTCTATAAAAA
AAAAAAAATTGTCCGGATGTGGTGGCTCACGCCTGTAATCCCAGCACTTTGAGAGGCCGAAGTGGGTGGA
TCTCGAGGTCAGGAGATTGAGACCATCCTGGCCAACATGGTGAAACCCACGTCTCTACTAAAAATGCAAT
AAAGTAACTGGGCATGGTGGCGGGTGCTTGTAGCTGAGGCAGGAGAATCACTTGAACCAGGGAGGCAGAG
GTTGCAGTGAGTTGAGATCGCGCCACTGCACTCTAGTCTGGGTGAGAAAGTGAGACTGTCTCTCAAAAAA
AAAAAAAAAAAAAAAAGTCACGCCTGTCCAGTTCACCAGATTAAGTCAGTAATTGATCAGCACCTTCGC
CAATACTGCTACTAGAAAAACAGCTGCGTGTCTGTTTCAGTGGGATCTCAGGGGAAACCCCTCCACTATA
ACTGAGATGCCAGTCTCCACATGAGACCAAATCTTCTCAGTGAGCAAAGCACTGCAGAGCAGCATGGGGT
TCAAGCTCCACCTTTGCTGGGGACTATGGGCCAGTGATGGCCGTCCCACTCTGAAAAATAAAGCAAGT
CATAGTGCCTGCAGCCCCTGTTGGAAGCATACAGACACCATGGACGTGAAGTGCCTGGCAGCCAAAAGGT
GTGCAGTCAGCTGTATAGAAACTATAGCTGCTGTTGTTGTTAAGGCGGTGAGAGTGTCACCCACAGA
TTGTCCTCTGTCCATGAAGCTTCTCCAGACTTGATTTTTCCCAACCTCTGATGGTATACATCCTGCCAA
TGAGTGGCAGACTAGGGAGGTGGGTAGGGCAGAATCCAGGATTGAGGTGAGGAGAGGATGAAGCGGGAGG
GAGGAGAGAGTGGGAGAGATTTGGAGAGAAAAGTCAATGCGGCCAGGTGCAGTGGCTCACGCCTGTAATC
CTAGCGCTTTGGGAGGCCAAGGCGGGTGGATCACAAGGTCAGGCGTTCAAGACCAGCCTGGCCAACATGG
TGAAACCCTGTCTCTACTAAATAGAAAAATTAGCCAGGTGTTGTGGTGGGCGCCTGTAATCCCAGCTACT
TGGGAGGCTGAGGCAGGAGAATCCACTGAACCCAGGAAGCGGAGGTTGTAGTGAGCCCAGATCGCACCAT
TGCGTTGCAGCCTGGGCGACAGAGCCATACTCCATCTCAAAAAAAAAAAAAAAGAAAAAGAAAAGTCAA
TGCATGGAGGTGAAGAGAGGGTGCAGACTTAGGGACAGAGATGGGGGAGCAGCTCCCAAGTCCCTGATGA
CACCTCCCTCATTGGCTTCCCACTCTGGGTTCTGACTGGCATCTTCTGTCCTCAGGGACCCCAGGCCTCG
CACATGCACTCTCATCTCTGTGCCCCCAACTCCTGGGCTGAGCGCGGCCTGTGTCCCACCCACCCACAGG
CCCCTGGCCCCTGTTCCCCATCTGCTCTCACCGTGACCTTCCACTGTCTCTGCTCCAGCCGCAGGGTGA
AGTTTGCCACCTGGACCGTGATCACCCTGGTCACACTGACTCGCCCATTACCCCAGGCCACGTTCTCCTG
CAGGACGGCAAACCGATGCAGGCCAGGCCGGGTGCCGCAGGTCTGAGCCAGCACATACACGCAGGTGCCC
ATGAAGTCGAAGCGGCGGCCATCGAAGGTGGTGTAGTGGGGGTCTCCTGACGCCTGGCAGGTGCTAGAGC
CCACGGCCACACAGCCCAAGCTGCCACCGGATGGCTGGCAGGCCTCGTGCGGTCCGCAGCTGGAGGACTC
ACAGGACACCAGGCCGCCCTCCTGGCAGTGGCAAAGGGAATCACATCCGGGGCCAGGGTAGAAGGTCTGG
CCTGGTGGGTGGTAGGTGCCCTGGTGTACGCAGCCACAGGAGGCCAGGGGCAGGCAGGACTCACCACTGA
GCGCAAAGCCCTCATCGCACACGCAGCCCTCATGGCATTCTGAGCCACAGCCCCCGGGCACTGGGAGGTC
TCCACAGGACAGCGGGCAGCCGTAGGAACACGCCTCATAGTGGCTGTGGGTGGGCAGCTCAGTGCTGCA
GGGAGAGGAGACATCAAGATCAAGAATTCCTGCTCCCAGGTCAGGAGTTCGAGACACACTCACATACAAG
TGGTCCCTCAACACATTCGTATGCACACAAACACTCAAACACACTCACACACAAGTGGTCCCCCAAGACA
TTCATATGCACACACACGCTCAAACACACTCACACACACACAAGCGGTCCCCAACACATTCGTATGCAC
ACACAGATGCTCAAAGACACTCACACACAAGCGGTCCCATTGCAGGGTGCTTGGGGAACACATTACATCG
CAGTTAATCTGATCCTGATAATTAAGATTCTTTCCCAATTTAACTATGGTTTGGAGTTATCTATTATGGT
TTTTTTTTTTTTGAGATAGGGGTCGCTCTGTTACTCAGGCTGGAGCGCGGTGGTGCTTGCTATCACAGC
TCACTGCAGCTTTGACCTCCTGGGCTCAAGCAATCCTCCCACTTCAGCCTCCTGAGTAGCTGGGACTATA
GGCGTGCACCATCATGCCTGGCTAACTGTTCAAATTTTTTATAGAGATGCGGTCTCGCTATGTTGCCCAG
GCTGGCCTCAAACTCCTGGGCTCAAGCAGTCCACCTGCCTCAGCCTCCCGAAGTGCCGGGATTGCAGGAA
TGAGCCACCACACCCAGCCTTCTATTATGTCTTTAATGACCTTATTCAAGTTGGATACATGGTGTTGATA
TGTGGCATATATTTTAAACATGCATATGCATATATTTCTGTGTTTGTATAATCTATGCAATATTTGTGAA
TGCAATACTTTTAGCTTCTTCCTTCTATAGCAGTAATTAAAATATTTAGCCAGTGTTATAAGAAAAAAA
GAAAAACCTCCCTGCTCCCCTCCCCAAACCTCCAGTCACTCCATAAAAAGCAAATCTAAGTGACTAAAACT
AAACCACATTAAATCTCTATCTGTGCTGTCAAATACAGTAGCCACTAGCCACTTGTGACCATTTGGATGT
AAGTTAATTAAAATGAAACAAAATTGAAGATTTAGCTCCTCAGTCACAACAGCCTCATTGCAAGTGCTCA
GCAGCCACATGTGACCTGTGGTGACCTGGTATGTATTTGAACAGCTCAAATATGGAGCTGTCATCATTGA

FIGURE 498 cont'd

AGTTCTGCTGGGTGGTGCTGTTCTGAAGCTGACATCCAGCTTACAGGAGAATCATGGGACATAGGGACA
AGTTCAATAACACTCCAAAATAGCAACTAGCCAGATCCTGAAAGTATGAAATTCTGCAGGATAAATAACC
TATCTTTCCCAGTAAATAAGTGACATAGACAAAAGGAAGAGCTGGATGGAGGGATAGCTATGTGATAAGG
CAAATGAATGAATTAGAATTAGAGTGAAGAGGCCGGGCGCGGTGGCTCACACCTGTAACCCCAGCATTTT
TGGAAGCCGAGGCAGGAGGATCACTTGAGGTCAGGAGTTCGAGACCAGCCTAGCCAACATGGTAAAACCC
GTTTCTACTAAAAATACAAAAATTAGCTGGGCATGATGGCGCACATCTGTAATCCCAGCTACGTGGGAGG
CTGAGGTGGGAGAATCGCTTGAACCCGGGAGGCGGAGGTTGCAGTGAGCTGAGATTGCACCACTGCACTC
CAGATTAGGCAACAGAGTGAGACTCCATCTCAAAAAAAAAAAAAAGAAAGAAAGAAAGAAAGAAAAAG
AAAAGAAAAGAATTAGAGTGTAGAGTCCAGGTGGTAGGTTTATGGGTCTTCACTGTAAAATTCTTTCAA
CTTTTTTGTATATTTGACAATTTTCATAATACTATGTTGGGAGGAACAAAGGAAGGAAATTCTGACAGAG
TAAAAGCAAAGAGGTAGATCAATCCAATGCAGTATGTGTATTTGGTTTGGTTCTAGAGCCAAACAAAATA
GAAAAAAACCTTTTTTTTTTTTAGACAATTGGGAAAATTTGAACCCAGATTGGGCTTTACATGATGTTA
GGGAATTAATGTTATTGTTGTTACTGGTAATTACCACATGCCCTCATATCTCTTTCTTTCTTCCTTCCTT
TTTTTTTTTTTTTTTTAGAGACAGGGCCTCACTGGAGTGCAGTGGCACAGTCTCGCCTCACTGCCACCT
CCACCTCCTGGGCTGAAGATATTCTCCCACCTTAGCCTCCTGAGTAGCTGAAATGATAGGCACTAGTCAC
CATGCCCGGCTTATTCTTTATTTTTATTTTTGTAGAGACTGGGTTTTGCTATGTTGCTCAGGCTGGTCTT
GAACTCCTGGCCTCCAGCGATCCTTCCACCTAGGCCTCCCAAAGTGCTGGGATTACAGGCATGAAAAGCA
AACTCCTGTGCCTTAAAAGTCCTTTTTTGTTGCTGAAAAGCAGATGCTTACTGAAGTAGTTAGAGGAGAA
CTGATCTGCCTAGAATTTGATCTAAAATATTCTACCAAAAAGAGGGGTGGAGTGAGAGGTAGAGGAAC
TAAGAATGGCAAAATACCAATAATTGTTCAAGCTGGGTCAGGCCTCCGTCTGCATATCTAAGACCTCATG
ATCCAGTCTTCTAGAACTTCCAGGTGGTACAAGGAAAGGAGTAGTTTTAAGGAAACAAGAGATTCTCAAT
TTCCACACAGGCCACAGAGTCTGATAATTAACAGCACAAAATCAGGAGCCAGCCTGTTCAAATCACCCCA
CCGGCTGTGTGACCTCAGGCTAGTTCCTTAACATCTCTGTGGTTCAGTTTCCTCGTCTTGTAAAATAGGA
ATAAGAGCAATTCTGCCTCACGGGGTGGTTGTGAGGATTCAATGAGAAACCCTTAGAACAGGACCTGCCC
AGTGGGATGCGTGTCACACAACTGCTAGCTGGAATTATACGTGTCCTGCCTAAAAGGACAGCCCAAGAAT
GCTCTGTTAGAAGAGCATTCCCACTTCCCATTGTCCACCTGTCCCCTTCACAAGTGTGCTTCCTGCACTT
TACAGAAGAGAACAGTGCAGTCCCCCACCCATCCTGAATCTTTTTTTTTTTTTTTGAGACAGGGTCTC
GATCTGTGGGCCAGGCTGGAGTGCAGTGGTGCGATCTCGGCTCACTGCAATCTCTGCCTCCCAGGTTTAA
GCTAAGATTCTCCTGCCTCAACCTCCCAAGTAGCTGGGATTACAGGCGCTCACCACCAGGCCTAGCTAAC
TTTTGTATTTTTTGTAGAGACAGGGTTTTGCCATATTGGCCAGGCTGGTCTCGAACTCCTCACCTCAAGT
GATCTGCCCGCCTCAGCCTCCCAAAGTGCTGGGATTACAGGCATGAGCCACCACACCCAGCCCCATCCTG
AATCTTAACACATGGCACAGTGCCCTGGAGTGTGAAACCTCTGAGGACATAAACGGACGATTTCAAATAT
TGCTATCGCTGTGAACACAACGAATGCTGAATCATTATTGAGTAATAAATCAAAGGAGGGCCTAATAGA
ATTGGCTGCTCACAGATAATATAAAATAAATTTGTCGTGTCTCACTGTGTGCCTTCCCTATGACTCAGAA
GGGGTTCAGAGCACGGAGTGATGTTACTCCACCTGCACTCTGTCCACTCCCACCCACTTATTAATATCAT
GTAAGCCAGGAGCTGTGGCTCAAGTCTGTAATCTCAGCACTTTGGGAGGCCAAGGCGGGAGGAAGGCTTG
AGCCCAGGAGTTTGAGACCAGCCTGGACAACATAGCGAGATCTTGTGTCTACAAAAAATAAAAAATTAGC
CAGGCATGGTAGTGTGCACCTGTAGTCCCAGCTACTCAGGAGGCTGACACAGGAGGACTACTCGAGCCCA
AAGATGGAGGCTACAGTAAGCTGTGATCACACCACTGGACTCCAGCCTCGGTGACAGGATAATACCTTAT
CTCAAAAATAAATAAATATCATATCTACAAAAATGAAAGATAGGATTAGAATTGATGCTGAACCCTGTCT
CATTCTAACAATATATGTGAAATATTGGGTGGGGTAAGCTCACTGAGTGATGCCATTACAATGGCCATT
ACAATTTACTTCTGTTTAATATTTTTATCAATTGTGCACAAACAATTCTTGCAATGATATCTTACTCCAT
TAAAAAAACCACTTAGAGTCTTAGAGTCTCAGGAATTTCTAAAACTTCTTATATCTTTTATAAGAAGGCT
GTTTTGTCCTGGGAGGTTTCACACCCCAGGGCAACATGCCACGTGTTGAGATTTGGGATGAGTGGAGACT
GCACTGTTATTATTTTATTTTATTTTATTTATTTTATTTTTGAGACAGAATCTCGCTCTGTTG
CCCAGGCTGGAGTGCAGTGGCTTGATCTCGGCTCGCTGCAACCTCTGCCTCCTGGGTTCAAGCGATTCTT
CTGCCTCAGCCTCCCGAGTAGCTGGGATTATAAAATTCTGAAATCTTAGTCATAGATGTGTATGTTTGT
GGCAGAGAAGTGTGATGGCGATTGTGACACAGGCTGCCAATGGTCACGTCTTGACTCTGGGCATGACCAT
GGCACTTGCTTTGGCCAATGGGACATTGGCCACCATGATACCAAGTAGAGCCTTGGAAAGTGCTTGCACA
CTGGGGCTTGTGTGCTCTTAGGAATCTTGAGAGCACCTTGGGAAGAAGCCTTGGCTCACCTGCTGGAAGA
TGAGACCAAGTAGAGCAGAGACAAGAATTCCCAGCTGAGGGCCCCCAAACCAACCAGCTTGACAACTGC
CAGATGTGTAAAATCACCCTAGATTACCCGGCCTTGGCTGAGCCTCCAACAGACTGCAGAGATCAACCAA
GCTGGCCCAGGCTGGGAGAACAGCTCAGCAGCCCCAGAATCATGAGAAAGAATAAATACTTGGCCGGGC
ATGGTGGCTCACACCTGTAATCCCAGCACTTTGGGAGGCTGAGGCGGGCAGATCACCTGAAGTCAGGAGA
TCGAGACCAGCCTGGCTAACATGGTGAAACCCCCATCTCTTCTAAAAATACAAAGAATTAGCCGGGCATG
GTGGCACATGCCTGTAATTCCAGCTACTTGGGAAGCTGAGACAGAAGAATCACTTGAACCCAGGAGGCGG
AGGTTGCAATGAGCCGAGATCACACCATTGCACTCCAGCCTGGGCAACAGAGCGAGACTCCATGTCAATA
AATAAATAAATAAATAAATAAAAATAAACACTTGTTTTAATGCACTCAGCCACTAAGCCTTG
GGTTGTTTGTTAGGCACCAAAAGCCAGCTGATACAGTGACTTTAACAAAAGACTTCCATGCATTCAAATG
TGTTACATTAGGTTAAATTCTGTTAGAACTAAAAGCATTAGAAAATCAGTTCAGAAAGGCAAGGATTTG
TTTTCTTATTCTCTCCCCTATTGTATCCGGAGTGTTTAGAATAGTGCCTGGAATACAGAAGGTATTTTTG

FIGURE 498 cont'd

```
AATGTTTTGGATATTTGTTGAATGAATGAATGTAAGTTGAAGGAGAAAAAGGAATGATGTATTTATCCTG
TATTTTTCAGTGGACAATGATGTGTACCACTGTGTGCTATGTATCTGTTGAATACATTTAAAAGAGGAGC
ATAAGTCAAGTAATGGTTTCATTTTGAAATACCAATATTATGTTGATAATTGTGGAAACTAAATGATGGA
TATATGCTGGCTCACTATCCTAGTTTACTTTGGATATGTTTAAATTTTTCCCTAATAAAAATGTTCTTAA
GGCCATGAGCAGTGGCTCACGCCTGTAATTCTAGCACTTTGGGAGACCGAGTTGGGCGGATCACTTGAGG
TCAGGAGTTCGAAACCAGCCTGGCCAACATGGTGAAACCCCTCTCTACTAAAAATACCAAAAAATTAG
CCAAGCATGGTGGCGGGCGTCTGTAGTCCCAGCTACTTGGGAGGCTGAGGCAGGAGAATTGCTTGAACCC
AGGAGGCGGAGGTTGCAGTGAGCTGAGATCGTGCCACTGCACTCCAGCCTGGGTGACAGAGTGAGACTCC
ATCTCAAAAAAAAAAAAAAAAAGGTTCTTAAAAGTCAAAAGTTACCATTTGTTAGAAATTATAAGTTT
TATGATTATTTCAGGTGAAAAACTAGACATGTATGCTTCTATTAATTCCAAAATTCAAAAACTTTAGAAG
TCAGAATAGTGGTTACCTCTTGGGGTTGGGAACCTGGATTTTTTTTTTTCTTGAATTTGGGACAGTTCA
CACAGGTTTGTTCTCTTGGTGAAAACTGATCAAGCTGTTAGCTTATGATATGTACATATTTTAAATATC
TGTATTATATTTCAATAATAAATTTTTTAAATTAAAAATCGGGTGAGAGGAAACTGGTACGATGGCTCAC
ACCTGTCATCCTAGTATTTTGAGAGGCCGAGGCAGGAGGATTGCTTGAGCCCAAGAGCCCGAGACCAGCC
TGGGCAAAATATCAAAACCCTGTCTCTATAAAAAATATTTTAAAAATTAGCGGGGATGGTGGTGCAAGC
CTGCCGTTTCAGCTACTCAGGAGGCTGAGGCAGGAGAATCGCTTGAGCCCAGGAGTTCCAGGCTGCAGTA
AGCTATGATTGCACCACTACACTCCAGCCTAGGCAACAGAGCAAGACCCCATCTTAAAAAAATCAGGTG
AGAGGATGCATGGCTTTTCAAACTTCTTTCATAGGCAAGCAAAGGTGTTGGAAAACCATTCATGCACCCA
CCTCTGAAACAAGGCTCTCAAACTGACTGCCCAAGGGGTCAGGCAGATGTAAATAAGCGAGGTAGGATAG
ATGGGGACCAAAAGAACCAGAGAGGGGATGAGACTCCTAATGACAATACTGTTGCTCATATCTCAATGA
CAGCTGTTATGTGGGAATCAGACCCTGGGCCACCAGGTGTACTCAGTCATTTTACAAATACCAACTGCCG
CTGGGCACGGTGGCTCACGCCTGTAATCCCAGCACTTTGGAAGGCTGAGGTGGGCGGATCACGTGGTCAG
GAGATCGAGACCATCCTGGCCAACATGGTGAAACCCCATCTCTACTAAAAATACAAAAATTAGCTGGGCT
TGGTGGCGCATGCCTGTAATCCCAGCTACTCTGGAGGCTGAGGCAGGAGAATAGCTTGAACCAGACTCAG
AGGTTGCAGTGAGCCGAGATCATGCCACTGCACTCCAGCCTGGTGACAGAGCAAGACTCCATCTAAAAAA
AAAATACCAACTGCATGCCCACCATCTGTGATTTTCTAGCTATCATGATCCAGGTGTGTAACTGAACCT
TTCTGAACTTCAATTTCTTCATCTGTTAAATGGGTATAACCACAATCCCTACCTCATAGGGCTATTATAA
GGATTAAATGAATTAATGATATTTATACATTAATGAATATATATAAGGCTGAGTCCCCCAGTTGCCACTT
CCGATACTCACGGCAAAGTTCTTCACTCCTCCAGGGGTGCACTGTGGCTCCAGCAGCCTGGCATGCAGCA
GCATAGGTGGCCAGTGCGTCACACAGTGGCCCAGACTGGCCTGGCAGCAGGCAGCGGTCATAGACACAGT
CGCGCACGGCACCCTGGGGGTCCAGCTTGCTATGGCACTCCCGGAAGGGCCCCTTGGGGTCGGCAAGGAT
TCCACACTCATTCTTGCTCTGCAGCTGCTGGGCCACCAGGGAGTCCAGCTTGGGACAGTCACCCGGTTCA
GTTGCTCCACAGCCGGGCCTCGTCTCTTCTTGCCAGCTGTTCCCAAAGGCCAGTGCATTGGCAGCTTGAC
CCCCACCCCGCAGAGCCAGGTCATCAGCTGGGTCCCCGTTGAAGTTCCCACAGAGTCCACACAGGGCCTC
AGCATAGCTGCTGGGCACCTTGGCAGTCACTCGTGCATTCCAGTCATAAGTGACAGTCAGGCCAAAGTCC
GTGCGCACGACGGCATCCCTGCCCTGTCGGAACACCTGCACCTGCCCATCTGCTGCTTGGAAGGGCAGAT
ACTGAAGGACGTCATCCACCTGGGTGGAGATGCAAGAGGGCCACCTGGTCAGGGTATTCACAGTTCTGTG
GCCCACCCTTCAATTCACTCACCTCCAGCTACCCTGACCTCCTTGCTATTCTCTTGGACATATTACGCTC
AGTCCCACCTCGAGGCCTTTGCACTTGCTGTTCCCTCTGCCTGGCTCACCATTCACCCCTCTTCATTCCT
AAAGCACCAGCTTAAATCCAAATCCCTCACCCATGGCCTTCAAAACCTACATGATCTGTCTATCTCCCCA
TTACCTCCCTCGCCTCACCTCTTCTCACTGTCCCTCTCACTCAGGCTGCTGCAACCATACTAGCTTTCTT
TTCTTTTTTTTTTTGGACAGGGTCTCACTCTGTTGCCCAGGCTGGAGTGCAGTGGCACAATCTTGGCTCA
CTACAACCTCTGCCTCCTGGGTTCAAGCGATTCTCTCTCAGCCTCCCTAGTAGCTGGGATTACAGGTGTG
AGCCACTGCACCTGGCTAATTTTTTTTTCTATTTTTAGTAGAGAGGGGGTTTCACCATGTTGGCCAGGAT
GGTCTCAAACCTCAGATGATCCACTCGCCTCAGCCTCCCAAAATGCTGGGATTACAGGCGTGAGCCACGG
TGCCCAGCCACTAGCTTCCTTTTTAAAATAGAGACAGGGGTCTCACTCTGTCACCCAGGCCAGAATGGAG
TGGCACGATCATAGCTCACTTCCTAGCACTTCAGGAAGCTGAGGCGGGAGGGTCACTTGAGCCCAGGAGT
TGGAGACCGGCCTGGGCAACTTAGTGCGACTCCGTTCTGCACAAAAAGGAAAAAGGAAAACGAAAAAAT
AAAATCTTCTAACAGGCCTCCCCCACCCTCAGGCCCATCCAGAACTCCAAGTCTTCAGAGGGTATTTCCT
GCTCCGTCACCCAGCCCTGGGCGCCACGTCGCTCACCAGCACTTGCCCGGGGTACTCCCGGCGCACGGCC
ACCTTCACCCCGCGGGCCTCCACCCGCACGGCGCGTGTAGCTCACAGTCTGGCTGCCCCGATGCTCGT
TTTCCACCAGCACCCGGAAGGCAGGCAGCGCTGCGTTCTGGCCGCATGAGCGGACCAGCAGGTACGTGCA
GGTGCCCATGAAGTCGAAGCGCCGGCCGTCGAAGCTCACATAGTGTGGGTCCCCGGACCCCTGGCAGGTC
CCGAAGCGATCGGGGTAGCAGCCCAGGAGGCCGTTCTGGACGCTGCAGCGCTCACCCGCCGGGCAGCTCT
GCTTGTCGCGGCAGGTGACCTGATGGGTGGCGCCGTTGCAGGTGCAGCGCCTTTGGCACAACTCGTCCGC
CCACACTTCCTGGCCCGGAGCGAGCTGGAGACCCTGGAAGGTGCAGCCACACGACGAGGCCGGCACGCAG
GCGCCGCCGCTGGCCACGAAGCCTGGGAGGCACACGCAGCCCTCCACGCAGGGCGCCCGGAGCAGTTGG
ACGGCGCCGCAGCCCCGTTGCAGGAGGTCGGGCAAGCAGGGCCGCAGAGCTCATAGCGGCTGTTGGCAGG
GCAGGACAGGGCTGCGGGGAGATCAGAGAGGGTGGATCAGGCCCGCGTAGCAGGGGCCGTCGAAGAGCGC
CCTGTCGGGGACGGCGCCCAGGAATTCCATCCCCAAACCCTGCTCCTCTCTCAGAGCTCGCCATCTCAGA
TAATGGCACTGCCATTCTTCTGGGTGCTCCTGCGCCACACCCCAGCGACGCAGTTAATCTCCACCCCGCC
```

FIGURE 498 cont'd

```
AACCCCCTAACGCTCACTGGACAACCAATCTGTCAGCAAGTCCTGTGAGCTCCATATTCAAAATCTACCC
AGATTGGCCGGGAGTGGTGGCGCAGGCCTGTAATCCGAGCTACTCAAGAGGCTGAGGCAGGAGAATCGCT
TGAACCCGGAAGGCGGAGGTTGCAGTGAGCTGAGACCACACTACTGCACTCCAGCCCGGGCGCAGAGCAA
GACTTTGTCTCAAAAAAAAAAAAAAAAATCCACCCAGTTACAGAATCTGCCTCTGATCCTATCCACCGCA
GCAGCCTCCTGCCTGGGCTCCCTCCTGCCCCACAGCCTGTTCCTCACACCAGGCCGAGGAATCTGGGAA
CATCTGGGTCAGATCAGGTCCCTCCCCATCTCAGAGCACTACTGTGGCTTCCTCTCACTCAGGGTAAACG
CCAGAGTCCTCCCCATGCCTCAGGAGGCCCTGTGCCATCTGTTCCTCTCACCTCTCAGCCCTCACCTCTT
CTCCCTCTCCCTCGGGCTCACTCTGCCCCAGCCCCAGCTGCCTCCTCCTCCCGGGTCCTCACCCTCCCAC
CTCAGGGCCTTTGCATTGGCTGTTCCCTCTGCCTTCCCTTTCCCAGAAAGCCCACTGGGGCCCAGGTGG
CCTGGGTTCAGATCCCAGATCTCTCCTTCTCGGCCACTGACTCCAATCTCCCCGTGCCTCAGTTTCCCCA
TCAGTAAGATGGGATAATGTAGTCGAGACCTCACAGGGTTGTTGTGAGGATTAAATGAGTTGATCTATGG
GGAAACATTCTGTGGACATCACTGTTAGTTAGTACTTAGCTGACTCCATTGCCTGACCCTGGTCTCAGCT
CCAATGTTACCTGCCCAGAAAGGCCTTCCCTGATCACCCTCTTCACGAGCCTCACAGTCACTGTCATTGA
ATGAACTTGTTTCTTTGCCTCTCTGAAGATACTTCCTAGTTCATCTGCTCACTGTCTGTGTCCCTCCCCT
GCCGCTAAGAGAGAAGTTCTGCGGGAGTGGGGACCTGATCTGTCTCAATCACTGCTGAGTCCCCAGCACC
AAGGACAGGGCCTGGTACGCAGCAGGTGCTCAGGAAATACTGCAGAAGTGAAAGGGAGAATAAATGAACT
CTCTGATTCCTATTTTGCGCCAGGCATGGGGTTGGGGGGGTGCTTACTGGGCAGTGGGGACACAGAACTG
GCCAAGACAAACACCTAGTGGCCTCTATGTCTGCCCTGTACTTACTCCCCCTCCCTCTGGGCCTGGGCCT
GGATGCCTCTTCCTCCCTCCTACCTGTCCTTTCTGCCTCTGGGACATGTCTCTAGGAGCCTCACTCACAA
GGGCAGGAATAGATTTATGCTGGTCTTCACTGTGTCTTCAATATCATTAGCATGCACAGGGGCAGGCAG
GGGTTCAAGGAATGCTTGTGGAATGAATGAGTGAACGATTAAGCAGACGGACACCTGGCTAAAGAGCCTG
GACTTTATCTAGAGGGCAATGGGAGTCATGGGAGGGCTATAGGCAAAGGAAGAGACGTCACGTCTCTGTG
TTGGGATTCTGCAGACAAGAATTCCCGTCCTGCCAAGCCTTTGAGCATGCTGTTCTCTGGGCCTGCAACT
CACTTCCTCCTCTTTCTCTTGGCAACTTCCAGCCCCTCTTATGGGTTTCAAATTGGACATCTTTCTCTAG
AAAACCCTCCCTGACCACCCCTGCTCCCCAGGCTGGGCCAGGAACCTCCTCTGGTTTCCCATAGCCCCAC
TGACTTCCTCCATCCTGGCCCCAACCCCTCTGCCTGTGTCCCCGCAATCCCAGCCCTGACTCATCTGCC
TGTCTCTCTCCCATCCTGGCCCCAACCCATCCGAGTGGGCCTCCCCATCCTGCCTGGACCCCTCCAGACT
GTCAATGTCTAGTGAAACGTCTCTCCAACCTTAGGCTCATTGTGGACAGAGCTGGCTGTCTTGGCCATCA
CTAGGCCCCTGGCATTGCCCAGCACCAGGCTGAACCATAATAACTTCTCAGATATTAAGCAGATGCTAGG
GATCTCCTGCCCCTCACTGTATGCTCCCAGCCCCCACCCAGGGCATCACTCACGGCAGTTGGCTGGTGAT
CTCCAGTCCCCAACCGAGATGCCAAGCTCCAGACAGGCCTGGGCATAGGCGCTGAGGCCACGGCACAGGC
TGAGCCGCTCCCCACCGACCACACACAGGTCATATACACACTGCTCCAGGAAGGGCCTGGGGTCCAGGGT
GTCATGGCAGACAGCGAAGGGGCCATCGAGCTTGGCTCAGCATGCCACAGAGTCGGTCGCCCTCATAGTGT
TGGGCCTGGCCTGGGGTGCAGGCGGGACAGTTGTTCTGGCAGCCATCCTCACACAGGTAGTCCCCATCAT
CCAGCTTCCAGCTACTTGCGAACTCCACAGCGTCAGGAGCCAGAGCCCCGTCAGGCGTGAGGAAGTCGTC
TGCTGGGTCACCATTATAGTTGCCACACAGCCCGCACACCTGGTCTTGGAAGCGTGCAGGCAGGCTGAGT
GCCAGCTGGCAGTCCCAGTCATAAGTGACCACCAGCCCAAAGACCAGCTCCACCACGGCCCGTGGTCCGC
TCTGGTACACACGCAGGCGACCCTCACTCAGGGAGACTGGCAGGCGCGAGCGCTGGTTGTCAACCTGCAG
AGTGGGTGAAGAGGAGGTGGTCAGGCCCCTGTGCCATCTGGCCTCCAGCCCTCATTAAAGTACTTTTTAA
TTAAAAGTTTTAAATAGGAGAATATAGAAAAAGAGTATGTGCTCAAACGTCACTGACTCAAGCCTTCCCT
GACTGCCCTATTTTATGATTTTATTTTATGGTTTGTTTGTTTTGTTTTATAGAGATGAGGTCTTG
CTATGTTGCCCAGGCTGATCTCAACTCCTGGCCTCAAGCAATCCTCCTGCCTCAGCCTCCCAAAGTGCTA
GAATTACAGGCATGACCCATGGGACCCAGCCTACACCCCTTTTTAAATGGCAGCCTTGGGCCGGGCGCAG
TGACTCACACCTGTAATCCCAGCACTTTGGAAGGCTGAGGCGGGTGGATCACTTTATGTCAGGAGTTTGA
GACCAGCCTGGTCAACATGGTGAAACCCTGTCTCTACTAAAAATAAAAAAATTAGCTGGGTGTGGTGGGG
CACGCCTGTAATCCCAGCTACTCAGTTGGCTGGGCAGGAGAATTGCTTTAACCCAGGAGGTGGAGGCTG
CAGTGAGCCAAGATCGTGCCAAACAGAGTGAGACTCTGTCTAAAAAAAAAAAAAAGGCAGCCTCTCCCTA
TTCCATAGCCTCCTTCCCTGCTTTCCTTTTTTTCTATAGCATCTGGCCTTCTGAAATATAATTCACAAA
TTGACCATGTTTATCATCTGTCTTACTCCATCAGAATGGCAGCTCCACAAAGACAAGGGTTTGGGTCTGC
TTTGATCACTGCTTTATCCCCAGTGCATAGAACAGGGCCTGGTAGAATCCCAGGCACTCACTAAGTGAAT
TAAGTCACTGCTGCATTTAATAAACATTCACTGGGCACTCACTCTGTGCCTGGCCTTGAGCTGGGAGATC
CTGGGAATACGAAGGTGGCGGAGACAGCCCCAAGCCCTACCCTCATGGGGCTCCCAGTCCATTGGGAGAA
ACAGACACATCACCAGACAGTGAGAGCTCAGAGGGGTCAGGGCAGAGATGGGAGAAGCACAGGCAGAAAA
GTCAAGGCCAGGATCAGAAAGGCCCAGGCAGAGGGGTCAAGGATGGGATAGGGAGGTACAGGCTGAGGG
TTCAGAGCTGGGATAGTGGGGAGATAGGAGGCTGTGAAAACCTAGAAAAATGGCCAGATCTAACCTTGCT
GGTCAGGGATGTTGAAATCTTAACACCCAACATGATGGTATTAAGAGTGGGGGGAGGCCTTTGGGAGGTG
ATTAGGTCATGAGGGTGGCACCCTCATGAATGGGATTAGTGCCCTTATGACAGAGGCCTCAGAGAGCTCT
CAGATCCGCTTTCCACCGTGTGAGGATACAAGGAGAAGTAGGCCATCTGCAACCTGGAAGAGCACCCTCA
CCTGAACCTGGCAGTGCTGGTGACCTCATCTTGGACTTCCAGCCTCCAGAACACAGAGACGAGGTTGTGT
TGTTTATAAGCCTCCCAGGCTCTGGAGAAGCCTGAAGTCTGACTAAGAACCAGGAGATAAGAACTATGTC
TCTCTGTGCCCTGGGGCATCTTTTTTTTGAGATGGAATCTTGCTCTGTCACCAAGGCTGGGCTGCATTGG
```

FIGURE 498 cont'd

```
CACGATCTCGGTTCACTGCAACCTCTGTCTCCCAGGTTCAAGTGATTCTCCCACCTGGGATTACAGGTGC
CTGCTACCACGTCCAGCTAATTTTTGTATTTTTAGTAGAGATAGGGTTTCACCATGTTGGCCAGACTGGT
CTTGAACTCCTGACCTCAAGTGATCTGCCCACCCCTGCTCAGCCTCCCAAAGTGCTGGGATTACAGGCAT
GAGCCACCGTACCCAGCCTTTTTTTTTTTAATTAATAAAAAAATTTTTTAAATTAGATATGGGGTCTC
ACTATGTTGTCCAGGCTGGTCTGGAGCTCATGGCTCAAGCAATCCTCCCACCTCGGCCTCCCAAAGTGCT
GGGATTATAGGTGTGAGCCACCGCACCCAGCCTGGGCATCTCTTTCTTACTCTTTCCTTACACATTCTCT
GAGCTGTGCCAGAGCTGAGACTTGAAGTGGAGAAGTCTTAGCCAAGAGGATGGAATATGATAAAAGGAGC
AACAGGAGAGAGGACAGCATGAGCAATGGCCCAGAAGGAAGACAGAGCATTCACTCATTCCGGCTCCCAG
CAAAGCTTCTGTGAGTCCCACTGTGTGGCCTGCTCTGTGCCAGCTGGTGCTTTAGACACTGCAGTGATGG
AGACAGGCCATGGCCCATGCTCAGAGCTCTCAGTCCAGCATGGCTGCTCAAATCTGTTTCTCCCCTAAG
TCCAGTGATCTCCATTTTAATTTTTCTATTTTTTTATTTATGTATTTTTTGAGACAGTTTTGCTCTGTC
ACCCAGCCTGGAGTGTAGTGGCAGCATCATAGCTCACTGCAGCCTCGACCTCCTGGGCTCAAGCCATCTT
CCTGCCTCAGCCTCCCAAGTAGCTGGGACCATAGGCAGGCGCCACCACACCCAGCTATTTTTTTTTTTT
TTTTTGGTAGAGATAGGGTCTCCCTATGTTGCCCAGGCTGGTCTCAAATTTCTGGGCTCAAGTAATCTTC
CAGCTTCAGCCTCCCAAAGTACTGGGATCACAGGCGTAAGCTACCATGCCCAGCCAATCTCCATTTTAA
ATGACACAAATAATATTCGTTCATTACAGAAACTGAAAATGCACAGGAGCAAAATGAGAAAAGAAAAT
CACCCTGTAGGCAGACACATACAAATGTATAGATCCTGTTGAGTTTTTCCTACCTTTAGATATATTTAC
ACTTAAAAAAAAAAAGACCATGCTGAAGTCACTATTTCATTAACTCCTCTCCTAACAATGTCTTGTGAGT
ATCCTACTATGATTCTGACAGTAGCTCTGCACCTTTGTCAAGTCACTGACCTCTGTGAGGATCTGACGGA
AAAAAAAATGAAAGGCCGGGTGCGGTGGCTCATGCCTGTAATCCCAACACTTTGGGAAGCCGAGTTGGGC
GGATCACAAGGTCAGGAGATCAAGACCATCCTGGCTAACACAATGAAACCCCAGCTCTACTAAAAATACA
AAAAATTAGCCGGGCGTGGTGGCATGTGCCTGTAGTCCCAGCTACTCGGGAAGCTGAGGCAGGAGAATCG
TTTGAACCCAGGAGGCGGAGGTTGCAGTGAGCCGAGATCACGTCACTGTACTCCAGCCTGGGCAACAGAG
CGAGACTCCGTCTCAAAAAAAATAAAAAGTAGTTTTCAGAGAGAGGTATAAAATTCTGTATATAATTCA
AGGGATCTGAAGTCCGCCTGAACTTGTGCTCAACCCCTCCAGGGCTGAAGAACACCTCCTTTCACCAACT
GATTATTAATCGCAGAGATCTACCTGCACACTCACAAAATCAGGGAGGTACAAGAATATTTATTTCAGGT
CAGATACAGGGGCTTACGCCTCTAATCCCAGAACTTTGGGAGGCCAAGGTGGGAGGATCACTTGAGACCA
GGAGTTCGAGACTAGCCTGGGCAACATAGCAAGACCTTATCTCTACTAAAAATAAAAATACTTAGCCCAG
TATAGTGGCATGAGACTGTAGTCCCAGCTACTTGGAAGGCCAAGGCTGGAGGATTGCTTGAGCCCAGGAG
TTTGAGGTTGAAGTGAGCTATAATCACACCACTGCACTTCAGCCTGGGCAACAGGGCAAGACCTTGTCTC
AAAAAAAAAAAATCAAAAAAATATTCATTGCAGTATTGTTTGTAATAGTGAACAATGTGTCCATCCACA
GGGGACTGGTTGAATGAACCATGGTGTTCATATCCATATAAAGAATTGTGCAGATGTTAAAAAAAAATAG
AGGCTGATAGAGAAACTGTTGATAGAGAAACTGTTTCAGAATGTATTGCTAAATGCAAAAAGCAAAGTAG
AGAACACAACATATATATACACATATACATGTATATATGTGTGTATATATGTATATATATATATATAC
ACATATATACTCTCTCTCTATATATATATATATTTTATTTATTTATTTTTTTTTTGAGACAGAGTCT
TACTCTGTCACCCAGGCTGGAGTGCAGTGGTGCAATCTTGGCTCACTACAACCTCTGCCTCCTAGGTTCA
AGCGATTCTCCTGCCTCAGCCTCCCGTGTAGCTGGAATTACAGGCATGCGCCACCACGCCCAGCTAATTT
TTGTACTCTTACTAAAGATGGGGTTTCACCATGTTGACCAGGCTGGTCTCTAACTCCTGACCTCAAGTGA
TCCACCCACCTAGGCCTCCCAAAGTGCTGGGATTATAGGCATGAGCCACTGCGCCTGGCCCTGAAGTTAT
TGAACAGGCAAAACTAATCTATGCTGGAAAAAAAAAATCAGAATTGTGATCATCTCCAGGAGTAGGTTGG
GGACTGTTTGGTAAGGCACATGAGGGAATTTTCCCAGGTGATAAAAATATTCTGTATCTTAATGGGCAAT
TTGGTTACACATTTGCCAAAGGTGAACTATACAGTTAAGATTTGTGATTTTTGTTATATATAAATTTCAC
CTCCAAAATCAGCCAAAAGAAGTGTGAAAATATTATATTCTAGTTAATGACATGGTGAAGTCTTTTGGGT
GATATGTACTCATGTCTGGAACTTTGAAGTGCATAAAAAATAAGAGAGATTGTGGAATGGACAGAGGGAT
GAACCGATGGATCAGTGTGTGATCAATCAAGAAGAGTACAGTGTTTAGAATCTAGATGATTGGCACCTGT
AATCTCAGCACTTTGGGAGGCTGAGGCAGGCCGATCAGTTGAGGCCAGGAGTTCCAGACCAGCCTGGCCA
ACATGGTGAAACCCCTCTCTACAAAAATACAAAAATTAGCTGGGCATGGCGGCACATGCCTGTCATCCCA
GCTACTCGGGAGGCTGAGGCAGGAGAATCGCTTGAACCTGATCCTGCCGCTGCACTCCATCCTGGGTGAC
ACAGCAAGACTCTATCTCAAAAAAAAAAAAAAAAGAAAGAAAGAAAGAAAGAAAACTCTAGGCGATTG
GCATATGAGCATTCACTGTATAAGAATTTCAACTTTGGACATTTTAATATTTTCATAATAACATGGCAG
AAAAAGGAAGTAATTGCTCTAGGCTGCTGTTATTCATATGAACTGAATAGAAATGCATTTACCAGAGTCA
GGACAGCTGAGGGATTAAGAACAAGGACTCCAGAGCCAGCATGCCTGTGCCCTTAGCTCCACCTCTTACT
AGCTCTGAGCCCTGGGAAGTCACTAGCCTATCTCAACCTCAGTTTCCCAATCTGAACATGTTCATAATA
ATAATGCCTCCTGCACTGAGTTTGTGAGCATTAAATTCGTTAAGATGAGAAAGTGCTAAGAAACATATC
TGGTGCATAGCAGGTGCTCATTAAATTTAGTTATTTGGTCAACGTAAATCCCCATTGCTGGATAATTTT
TTGTTTGTTTGTTTTTGTTTTATGCTATTATAAACCATGTTGGCATGTTACCCCCAGTCTCTGTCTCTG
AATATCCTTTAAATTTCTAGACGTGGATGGCTGGAGGGCAGGGTTCTAAGGTCCTGCTACTGATTTTCA
AATCCGCCTCCCCACCCTCCAACTCCATGGCCCACTTCCCTGCACCCTGGTTTGAGGTCGGCCATTGGGC
TTTGCCTCCGCCTTCGGACCCGCAGCTCATGGATGTTAACCCCCAAAGCCCCCAGGTACTCACCAGGAC
GAAGCCAACTTCACCGCGGGTCAGCGACACAGAGTGGCTGTAGGCGCGCACAGTGACGAGGCCCACGTAG
GAGACGCGGCGGCTGCCCCGGTGCTCGTTCTTGGCCTCCACGCTGAAGGCGGGCAGGGTGTCGTCCTCGC
```

FIGURE 498 cont'd

```
TGCACAGCTCCACCATCGTGTACGAACAGGTGCCCATCATGTCGTAGCGACGGCCGTCGAAGGTGGTGTA
ATGGGGGTCGCCCTGGGCGCGGCAGACAGCGGTGGACTCCGCCACACACCCGGCCTTCCCGCCTACCACC
TGGCAGCGCTGCCCGGCTGCGCACTGCATGCCTTCGCAGGAGGGCTCCACTGGGGACAGTACAGCTGGGG
AGGGAAGGGAACGGTGAAAAGAGAGAATCAGAAGTGTCCGCGGGGTTGTAATCCCAGCACATTGGGAGGC
CAAGGTGAGGGGGGCGGATCACTTGAGGTCAGGAGTTCGAGACCAGCCTGCCCAACATAGTGAAACCCCA
TCTCCATTAAAAACACAAAAATTAGCAGAGCATGGTGGCACATGCCTGTAATCCCAGCTACTTGGGAGGC
TGAGGCAGGAGAGTCTCTTGACCCCAGGAGGCGAAGGTTGCAGTGAGCTGAGATGGCACCACTGCACTCC
AGCCTGGGTGACAAAGTGAGACTCTGTCTCACAAAGAAAAAAGAAGAAAGAAGAGGAAGAAGAAGAAGA
AAGAAGAAAGAAGAAGAAGAAGAAGAAGAAGAAGAAGAAGAAGAAGAAGAAGAGGGAAGGGGGAGGAGGAGGA
AGAGGAGGAGGAGGAGGGAAGAAGAAGGAAGAAGGAAGAAACCGCCTCAGGCCTCAGAGGGAGGCAT
CCTGGAGCCCACCTTGCCGGGGAAGCTTGAGCAATTCGCTCACAACTGCCCATTTTTGCCCATTTTTGCC
CATTTTAAAGGTGGGGAAACCGAGGTCTGGAACCCCACAGGGAGAGAGTTGCTCAGGCCTCTCTGAGAGC
CCCATGTTTTCTGATTCTCCAGTTTAACACAGGGCAGCCTAGAAGAAGGGAAGGCAGTAAATAAGAAAAG
GCAGAAACGGTCATTAAAATGTTAATTTGTGTTTTTCTCTCCCCTTTTCCCCTCTTCCCTACCTTCCCT
CCAGGGTCAAAAAGAGCTAAGGGATTTTTTTAAGGACAGAAAATGGAAGACAGCCTTCAGCAGGATGAAA
AGGACTATGGAGTCAGGCCGCCTAGGTAGGAATCCTGGCTCAACCAACTGGCTCTGAGACACTGGGCAAG
TGGTTTTAAACTCCCTCTGCCTCAGTTTCCTCATTTGTAACATGGGGGTGATAATAATACCTCCTTCGTA
GGGATCTTGGTGGGGGTGTTAGGATTAAATAAGCTAAAACTCGAGAAAGCTTTAGAACTGAACCTACGT
GTTAAGTGGAGTGTTACCCATTATAATTAATCACCCACCGCTCCCTCATTCTATTTCTCAAGCCCAAAGT
GGCTCCTTGAAGTTGGGTGGCTTCCATGCCTTGGAGGGGAGGGGAGGGGCATTTTTGCCAGGTCCAGGAA
TGCCAGAGTCTTAGCGTGGCAGGGACTACATGGGAAGAAACAGCTTTCCTCCATCTGCCTCCCAGTCCTC
AAAAGTTTTTGCAGCTGGGTGTGGTGGCTCAGGCCTGTAATTCCAGCCCTTTGAGAGGCTGAGGCAGGAG
GATCGCTTGAGCCCAGGAATTTGAGACCAGCCTGGGCAACATGGAAAGACCCTATCTCTACAAAATATAA
ATTAAAAATTAGCTGGGTGTGGTGGTGCATGCCTATAGTCTCAGCTACTTGGGAGGCTGAGGGAGGATTG
CTTTAGTCCAAGAGTTCGAGGCTACGGTGAGCTGTGATCACACCACCGCACTCCAGCCCGAGTGACAGAG
TGACACCCTGTCTCTAAAACAAAGTTTTGAGGGAGAAACAGTTATCCCCATTTTACAGATGTGGAAACTG
AAGCCCAGAGAGATGAAGTCACTTGTCCAAGATCACACAGCAGAGCTGGGATTTGAACCCTGGGACCCTG
CACTACACTGACAGCGTCTCATGGGCTGAGCCTGAGGTCACACAAACTGCCAGGTCATATACATTAACTG
TGTCAAAAACACGTGAAACACCTAGAAAGATTGCAAGATACTCCCCTCCCCAACGCGTAGTCATCTTATT
ATCATACATTTAGATCTCCTAAGTTTGGGTATCAACATTCCTACATGAGGTGTGGAGAGTGGCTTAGCAA
CTGGTGTGGCTATGTCAGTTGCTAAAATATCAAAATATTTCCAAACTGGTTGGTGAGAAGCTGCTGACCT
GACTGTCCCCACAACCCCAAAGATCCCTCCTTCTCAGCACCCTGGCTCTCCCCTAGGGCCCTTTCCAGA
ACAAACCAACAGACAGGGCTGATGCCAGCATGATGGGGGCTTCAGGACCCTGTCACAGTGCTTTGGCTG
CTGTCTCTTCTGACTGGTAGTGCCCCAGCTCTCCCTGGTTGCTAAATATTTAGAATATTGTTTCTGGGCG
GATGGGAGGGGCTGAGAAGACTTGAGGAAGGATGTCGCGGAGAAGAGAAGTGAGGGGAGGACAATCAGGA
TCCCGAAAGCCACAGAGGAGTAGGTGGGTGGAAAAGCGGTCACCAGGTGGACAGGACCAGGGACATTTC
CATTACTTACTCCGGCCGCAATCAGCAGCTGTTGCGTAGCCTATAGCCTTGGCCAGCCCGAAGGTGAGCA
GTCCCAAGTTGGTGGTGGCCTCGGCCGTGTGGATCATGTCAGCTGTGCCGAGCTCCACTTCAGCATACGA
GAACTCACTGCCTGGCACAGCCTCCCAGGTGAGCTTGGCCCCCACTGCATGCCCATCTATGGTCAGCCCG
CTGATAGCCTTCGTCTGTGCCACTACCAGGGCCACGCCCTCACAGCCTGGTACACTCTTGACCACATAGG
CTGGGCAGTAGGCCGCCACATCTGGGATCAGGACCAGGTAGGGGTCATAAGTCACTTCATTCCTTATGGC
ACCTGTGCCAAACAACAGGACCTGGATGCCCACATTTGCAGACAGGTAGAGTGGCCAGGATGGCCGGACC
TCAAACTCTACCACATCACCTGCCTGGAGCCCACGGGAGCCAGTGATACCCCATGGTTGTAGGTCAGCT
TTGTGGCCTGGCTGGCCACAACGAAGGCCAAATCATAGCGAGATTGGGAGGCCAGCGTGGGTACTACATA
GTGGGTGCCCCAGGCAGACGTGGGTAGCAGCTGCTCAACCACATGGTTGCAGGTCGTATGTTTCTGCGCA
CAGCTGTGGCCAGAGAGGACAGCCACGGGCTACTAGCTGTGACCTTTGACCCCGAGAGATCCACTGAGC
TCTGTAGCTGGGCCACATTGTAGGGCTGTAGAGTCACTCTTAGGACATCGCCTGCTGGATAGAACTTGCC
ATTGAATGTCACTGACCCCTTCAGCGTGACACTGACCGAGGCACCTGCGGCACCGGCCACCACGGCAAAC
TCCTTGACATTCCTGGCTGAGGTGCCGGGGGTGTGAGCACAAAATACTCGGTGCCTAGGGCCTGGATGG
GCCGCAGCAGTGTCAGCTCCGCTGTGTCAGGCTTGGCATTTAGTGCCTGCACAGAGATGGCATAGTCAGA
ATGGATCACCACCGCATGCTGGAAGATCTTGCTGCCTATCATCTCAGCCTTGGCACTGATGTTGACCATG
ACCGACTCCCCGGGCCTCACTGTGACCTTCTTTGAGGTGTTGTCTGCCTGGCTGAGGATGGAGACTGAAG
CGGGGCTCTCTGACAGCTGGAGATAAGGAGGCGGGGGTAGGCCTTGCTGTAGGCCAGCTGATAGTTCTG
CAGGAAGGCTGTGAGGAATTCCTCTCTGCCAGTGTTCTTGAGGTCCACTGAAGCCTCCTGGGTCAATCCT
GGTTGAGAAAATACAGTTGTGGGTCCACTTATCCAATCCTCCCCACTTTTGCTCTGCACCCAGAAACATG
TTGAAGTATTAACTTGGGCTTTCCCCCACCACCCTTCTCTTTCCTTTCTTCTGATTCATGCAGCTTTCGT
CTACAAGCCTTCCTGGCTTTTGTTTTTCAAAAATCTAAACACCTTAGACAGGGCCCTCAAACTCCAATGC
TGATGGGGCCAGGCAAGAAATATAAATGTGTGAAACAGTCCCGGAGGGGCGACTGTGGAACTGAAGCACT
CCTATACCATCTAAAGTGGGTTGTTGCTTATGCAAATCCATCAGTGTGATACATCTTATCAACAGAATAA
AGGACAAAAACTATGTGATCACTTCAATTGATGCCAGAAAAGCATTTGATAAAATTTAACATCCTTTCGT
GATAAAAACTCTCAAGAAAGTAGACACGGAAGGAACACACCCCAACATGATGAAATCCATGTACAACAGA
```

FIGURE 498 cont'd

```
CCCACAGCTGGTATCATACTGAATGGGGAAAAACTGAAAGCCTTTGCTCTAAGATCTGGAACACAGCAAG
GATGTCCACTTTCACCACTATTCTTCAACATATTATTGTTAGTCCTAGCTAAACCACTTAGACAATAGAA
AAAAATAAAGGGCATCCAAACTGGAAAAAGGGCATTCAAATTATCTTTGTTTGCAGATGATATAATCTTA
TATTTAGAAAAACCTGAAGACAGCTGGGCTTGGTAGCTCACGCCTATAATCCCAGCACTTTAGGAGGCCG
AGGTGGGTGGATCACCTGAGGTCAGGAGTTCAAGACCAGCCTGGCCAACATGGCGAAACCCAATCTCTAC
TAAAAAAAAACCAAACATTAGCTGGGTATAGTTGCACATGCCTGTAGTCCCAGCTACTCGGGAGGCTGGG
GCAAGAGAATCTCTTGAACCCAGGAGGTGGAGGTTGCAGTGAGCCAAGATCACACCACCACACTCCAGCC
TGGATGACAGAGCAAGACTCTGTCTCAAAAAAAAAAACAACTTTGGCTGGGTGCAGTGGCTCAAGCCTGT
AATCCCACCACTTTGGGAGGCTGAGCTGCACAGATGAAGAGGTCAAGAGATTGAGACCATCCTGACCAAC
GTGGTAAAACCTGTCTCTATTAAAAATACAAAAAAATAATTAGCCTGGCATGGTGGCAGACACCTGTAAT
CCCAGCTACTCGGGAGGTTGAGGCAGGAGAATCGCTTGAACCTGGGAGGCAGAGATGGTAGTGAGCTGAG
ATGGCACCGAGCTGAGATGGCACCATTGCACTCCAGCCTGGGCAACGAGAGCAAAACTCCATCTCAAAAA
ACAAAAAACAAAAAACAAAACAAAAAAACAGAAAACCTAAAGACTTCATCAAGAAGCTATTAGAACTGA
TAAACAAATTCACTAAACTTGCAGGATACAAAATCAACATACAAAAATCAGTAGCATTTCTATATGCTTA
CAGCAAACAATCTGAAAAAAAAAAGGAAAGTAATCCCATTTACAATAGCCACAAATAAAATAAAACACC
TAGGAATAAACGAAAGAAATGAAAGATCTCTACAATGAAAACTATAAAACAGTAATGAAAGAAATGGAGG
AGGACACACACCAAAAAAAATGGAAAGATATTCCATGTTCATGGATTGGAAGACACAATATTGTTAAAAT
GTCCATACTAACCAAAGCAATCTACCGATTCAATGCAATCTCTATAAAAATACCAGTGACATTCTTCACA
GAAATAGAAGACTAATCCCAAAATTTGTGTGGAAACACAAAATACCCAGAATAGCTAACGCCATCCTGAG
CATAAAGAACAAAACTGGAGGAATCACATTACCTGACTTCACATTATACTACAAAACTATAATAACCAAA
ACAGTGTGGTACTGGCATAAAAACAAACACATGGACCAGTGGAACAGAACATAGAACCCAGAAACAAATC
CACCCACCTACAGTGAATTCATTTTTGACAAAGATCCCAAGAACATACATTGCATTTATTGAAGATAAAT
GGTACTGGGAAAACTGGATATCCATATGCAAAGAGTGAAACTAGACCCCTATCTCTCACCACATACAAAA
ATCAAATCAGAATGGATTAAAGACTTAAATCTAAGACCTCAGACTACGAAACTACTACAAGAAGACATTT
GGGAAACTCTCCAGTTCATTAGTCTGGGCAAAAATTTATTAAGTAATACATCAAAAGCACAGGCAACCAA
AGAAAAATGGACAAATGGGATCACATCAACCTAAAAAGCTTCTGCTCAGCAAAGGAAACAATCCACAAAG
TGAAGACACAACTGACAGAATAAGAGAAAATATATACAACCCATCTTAGCTAAAGCAATTAGACAAGAGA
AAGAAATAAAGGCATCCAAACTGGAAAAAAAAAAAAAAGAAGTCAAATTATCCTTGTTTGCAGATGATAT
AATCTGATATTTAAAAAAAACCTAAAGACGCCATCAAAAAGCTATTAGAACTGATAAACAAATTCACTAA
ATTTGCAGGATACAAAATCAACATACAAAAATCAGTAGCATTTCTAGATGGTACTGACAAGGGATTAATA
ACCAGAATATAAAAGGAGCTCAAACAACTCAATAGGAAAAAAATCAAATAATCTGATTTGTGTGTGTGTG
TGTGTGTGTGTGTGTATGTGTGTGTTTGAGATGGGGTCTTACTCTGTCACCCCAGGCCGGACTG
CAGTGGCACGATCTCAGCTAACTGCAACCTCCGCCTCCTGGGTTCAAGTGATTCTCTTGCCTCAGCCTTC
CAAGTAGCTGGGATTACAGGCATGCGCCACCATGCTCGGCTAATTTTTGTACTTTTAGTAGAGACAGGGT
TTCCCCATGCTGGCCAGGTTGGTCTCGAACTCCTGACCTCAAGTGATCCGCCTGCCTCGGCCTCCCAAAG
TGCTGGGATTAGAGACGTGAGCCACCACGCCCGGATTAATCTGATTTTAAAATGGGCAAAAGATCTGAAT
AGACATTTCTCAAAGAAGACATACACATGGCCAGCAGGTATATCAAAAAATGCTCAACATCACTAATCAT
CAGAGAAACACAAATTAAAACCACAGTGAGATATCATCTCACTCGAGTTAAAATGGCTTTTATCCTAATG
AAAGGCAGTAATGAATGCTGCTGAGCATGTGGAGAAAAGGGAACCCTGTTACCCTGTTGGTGGGAATGTA
AATCAGTACAATCACTATCGATAATAATATGAAGGTTTCTCAGAAAACTAAAACTAGAACTACTGTATGA
TCCAGCAATTCCTTTCCTTCCAAGTCAGGAAGTCAGTATATGTAAGAGACATCTGCTCTCCCATGTTTAT
TGCAGCACTATTCCTAATAGCCAAGATACGGAATCAACCTAAGTGTCCATCAACAGATGAGTGGATAAAG
GAAATTTGGTACATACAAACAATGGAGAATTATCCACCATAAAAAAGAATGAGATCACCCGGCACAGTGG
CTCACACCTATAATCCCAGCACTTTGGGAGGCCAAGGCAGGTGGATCACTTGAGGTCAGGAGTTCAAGAC
GAGCCTGGCCAACATGGTGAAACCCTGTCTCTACCAAAACTACAAAAATTAGCCAGGAATGGTGGCATGT
ACCTGTAATCCCAGCTACTCGGGAGGCTGAGGCACGAGAATCACTTGAACCTGGGAGGCGGAGGTTGCAG
TGAGCCAAGATCGCGCCACTGTACTCCAGCCTGGGCAACAGAGTGAGACTCGGTCTCAAAAAAAAAAAAA
AAAAAGGAATGAGATCCTGTCATTTGCAACAACATGGATGGAACTGGAGGACATGATGTTAAGTGAAATA
AGCCAGTATAGAAAGACAAATTTCACATGTTCTCACTCATAGATGGGAATTTAAAATTTTTAACTGATGA
ACTCATAGAAATAGAGAGTAAAATGATGGTTACGATGATTACCACAGGCTGGAAAGTGTAGCGGGACTG
GGGGATAAGTAGATATGGTTAATGGGTACAAAAATACAGTTAAACAGTTAGATAAAATAGATAAAATCTA
GTATTTGGTAGCAGAACAGGATGACTATTGTTGACGATAATTTATGGTATATTTAAAATAACTGAGAGT
GGAATTGGAATGTTCCTAACACAAAGAAATGACAAATGCTTGAAGTGAGGGATGCCCTAGTTACCCTGAT
TTTATCATTACACACTGTATGCCTGTATCAAAATATCACAGGTACCCCATAAATGCAAACCCATAAAAAT
TAAAAATTTTAAAAATATATAAACTAGTAAAAAAAAAAAAAGTGGATTGTTGGTACTAGCTTTCACCTGT
TATAATGAAAGAATGTGAGCTTTTTAAATTGTAAGACCTTCCTGTTTTTCTTTTTTTTTTCTTCTGAG
ATGGAGTCTCGCTCTGTCACCCAGGCTGGAGTGCAGTGGCACGATCTCGGCTCACCACAACCTCTGCCTC
TCAGGTTCGAGTGATTCTACCACCTCAGCCTCCCGAGTACTGGGACTACAGGTGTGCGCCACCAGGCACA
GTTAACTTTTGTATTTTTTCTTTTTTTCTTTTGAAATGGAGTCTCACTCTGTTACCCAGGCTGGAGTGC
AGTGGCGCGATCCTGGGTCACTGCAACCTCTGCCTCCCGGTTTCCACGCCCAGCTAATTTCTGTATTTTT
AGTAGAGATGGGGTTTCACCCTGTTGGCCAGGCTGGTCTCAAATTCCTGACCTCAGGTGATCCACCTGCC
```

FIGURE 498 cont'd

TCGGTCTCCCAAAGTGCTGGGATTACAGGCGTAAGCCACCACGCCTGGCCGTTCTTTCTGTTTTTAAAGA
GAATGTGGCTATCTGAATTTTCATGTGAAATCTCCAACCCACAATTGTTTTAAGCACTTTGGGGCTCAAG
GTGGATGTACTCTGCTGCCAGTGTATGATTTCCATCTTTTTACAAACTGGAGTGCAGTGGCTTAAACACA
ACACACTGCAGCCTCAACCTCCTGGGCTCAAGGGATCCTCCTGTCTCAGCTTCTGGTATAGCTGGGACCA
CAGGCACGCACTGTGTGCCTGGCTCATTTTTAATTTTTTTCTAGAGGCAGGGTCTCACTTTGTTGCCCA
AGCTGGTCTTGAACTCCTGGGCTCAAGTGATCCTCCTGCATCAGCCTCCCGAAGTGCTGGGATTACAGAC
GTGACCAACTGTACCCAGCTGGTTTTTGTCTTAATAGGACTTGTGGGGGCCAGGCGCGGTGGCTCTTGCC
TGTAATCCCAGCACTTTGGGAAGCCAACGCGGGTGGATCACTTGAGGTCGGGAGTTCATGAGCAGACTGA
CCAACGTGGTGAAATTCCATCTCTACTAAAAATGCAAAATTAGCCGGACATGGTGGCATGGGCGCCTGT
AATCCCAGCTACTAGGGAGGCTGAGGCAGGAGAATCGCTTGAACCCAGGAGGTGGAGGTTGCAATTAGCT
GAGATCACACCATTGCACTCCAGTCTAGGCAACAAGAGTGAAACTCCATCTCAAATAATAATAATAATAA
TAATAATAATAATAATAATGGGACTTGGGGGTTTGTGAAAAGGGGATAAAGAGAAGAAGGGGATTAT
GGAAGGGTGAATGAATTGTCTCCTAGAAATAGATGGCAGTGGGGCTTCTGACCACCCCAACTAGGAAG
AGCGTCCCTGGGGCTGAGGAGAGAGAGGTCTAAGGAATCTTGAAGAGAGTGTGGGGCTATGGAATGACC
ACCTTCCATATAAAGGGGCTTTGAAGGATATCCCAGGGGCCAGGGGATCAGGAACAATGGACATTTCA
AAAGTAACCTAGATGGATGCTGACTGGTGACGAGAGGGTCCTCATATCCCATCCTCCCCCAGTACTTTG
GCTTTATCCAAAATTTTAGTTCTGGACACATCCCTGGGAGAAGTGGGGACAACACCCTCCAAGAATGACT
TTCGTGAAATTTTCCATCAACTTAGCAGAATGAGGCTCAGAGTCAAAACCTTAGTTGAGTTGCAGAAAAC
CAAGAAAGTTCTTGCACACTTGAGTTTGGGGACTAAGGTTTTTGCCTGTGCTCCCATCCAGAAAAGGGTG
AGAATTGGTGAATTCTACCACATCCCCCTGCAGAGACCTAAGGGCCTCTCTCCTGTCTCAGCTAGCCTGGG
GTGACATGTGGAGGAGGCACACATGGAAGGCGTGGACCCACGCAGAGTTCCCCAGATTGGAACAAGGACA
TGGAGAGGGTCTTGGTCTGACTTACCCCACAGGAGGGTTGCTCCAGCCCAGAGTATCCACCAGCTCCATA
GGGCACCCATGGCTGCAGTAGGAAAAGAGAAAGGATCATAGAAGGCTGATCCACCGCCTCTGCTGGAGAC
TGTCCTGGGCAGAAGGGCCCACTCTCATGACAAGGGCCACCTGGGACCATGAAGGCTGAGGTGGGGAAAG
AAGTCGGGCAGATTGGGCCAGGGGGTATGGATCCAAGGACCAGTGTGTGTGTATAGGGGAGGCTGGCTGT
CCAGCGGGTCTGGAGGTGGGTTGGGGAGGGCAGAAGCCAGGGACGGGGTGGAGAGTTGGCTGTCTTGTGG
GTCTAGGGGTAGGATGAGGAGGCCTACAGTCAGGGGCAAGAGTAGGGGACCTGCTGTCCCACTTCCAAAG
GGGACCCCAGCCCTTCTCACCTGCAGGTCCCTGGAGCTGCAGGGCCAGCCCTGTGGCAGGGCTATATAGT
GGAGTTTCTGGGCCACACCCTGGGCCACGTGCCAGGCAGATGATGCCAACTTCCTGGAGGAGGCTGCCAT
CCTCATGGCCAGATGAAATGGGAAACTGTGAAGGCCTGGGAAGGAGGGACAGTGATTCTGGATGCCTGGG
TTCCAAGAAGGGAGTGAGGACAGCTGGTGGCCATTCCCTGGAAGCCTTCTGGAGAGTTTGGTCCTGGAAG
GGTGGGGTCCCTGAGGGAGACAGCTGGGAGCAGGCAGATGAGCACCTGGGTCCCTGGGTGGAGGTGGGG
TAGGGTGGGGGTGTGGGCAGTGAGGGTGGGAGGTGGCATGTGGTCATATTTGCTGGCTTAGTGGCTAGGT
TCCTTCCTTTGGCTCCTGCCAGGAACAACAGTGAGGGACCCATATCCGGGTCCTGGTTCCTTCTCAGTCC
CCACAGGCTGGGGAGTCCCTAGCCACCCACATCCTGCTTCCAGACACCACTAGGGGCAGGTGTCTGGGAT
GGGCAGGAGTCTGAGGCTATGGAGTGGGACACAAGACCTCCACCGCAGCCCAGTGGGGCGTCTGCGGTTT
CTCATCTGCAAAATGGGAACACCAAAACCAGCCTCTCTGGGCATCTTTACGTCCCAGAGATGTAAAAAAA
TTCTCAAGGACTGTAGAGCTGGGGGGCAGCCTCCTCTGGTGTGGGCGCAGGCCAGGCTGCAGGTGGGCAC
TGGGACTGAGGCGGTGTGTGAAGAAGGGACAATGGCCTCTGTTTCCTGGTTCCACACAGACACCCAGATT
CTACTTCTGATCCCAGACACCTGCTCCTCAGTGGTGCTGGAAACAGGATATAGGTGGCCAGGGACTCCCC
AGCCTGTGAGGACTGAGGAAGAGCCAGGACCTGTTGGTTTTGGAGTTTTTTTGTGTGTAGGGAGGGTTTG
CTCTTAGCAGGGGCTAGCTGAACAGGTTTAGGGGACTCTGTGCCTCTCCATCACCCCAGAATTTGCCTGA
GATGGGAGGTGGAGGTCTAGGTTGCACACAAGGAGCAGAAGAATGAGCTGAAAGTTGGGCTTTCTCAGCT
GGAGTCAGCTCCTCTGAGGGGCTGGCCTGACCCATGCCCTGCCTGCCTTCTCCCTGACTCAGGATCTCAT
TGTTTGCTGGGGGAGTCTCCCCTGGGACCAGCAGCTGCAAAGCCTGGGTGCTCTCTTGGACCAACACCCT
AGCAGCTGCTGCCCCTGGGGCTCCTCCTCTCTTATCACAGCAGCCTGGGCCTCTGGGAGGCCAGAGCGGG
TGGGGGGCTTCTCTCTCCCTGGAGCTCCAACCAATCCCCACGCCCACCCAAGAAACGTTCCTGGAGGGAA
AGATAAAGGCTAAGAGTTGACTGGGACATAAAGTCAACCAGGAGAATGAGGTGAGTAAATAGGAGACTGG
CTAAAAGCCAGAGATAACAAGAAACAAGCAGGGGCAGGGGACCCACAGGAAGTGGAAGCTTTGGGAAAAG
GATGCCTGGGTCCCTGAGGGGTCTAAAAGTTGGTGGAAGGGCTGCTGGGTCCCTGAGACAGAGAAGGAC
TCGGAGGAGGAGACGTCGGGATTCCTAGGAGGAAACAGCAATTGCAAACCAAGATGTGAAAATTCTCGT
CTGAGGCCAGGCGCAGTGGCTCAGCTTATAATTCCAGCATTTTGGGAGGCTGAGGCAGGAGGATTGCTTA
AGGCCATGAGTTTGAGACCAGCCTGGTTCAAGACCAACATAGTGAGACCCTGTATCTACAAAAAAATACA
AAAATTAGCCAGGCACGGTGGTGCACGCTTGTAGTCCCAGCTACTTGGGAGGCTGAGGCAGGAGGATCAC
TTGAGGCCACAAGGTCAAGACCAGCCTGGGCAACATAGTGAGACCCTTTCTCTACAAAAAATATAAAAAT
AAACCGAGTGTGGTGGCATGCACCTGTAGTCTCCACCATTCAGGAGGCTAAGGTGGGAGGATTGCTTGAT
CCTAGGAGTCTGAGGCTGCAGCGAGCCGTGATCATGCCACTGCATTCTGGCCTGGGGAGAAAAGAAAAA
AGAAAATAAAATCCTCTGTGTGCCATATGCCTCTTGTAATTAGAGGCACTCAGAGACAAATGGGAGGTGA
AGGGAAAGAATCAGGGTGAGTTTCATGGGTGTTTCTGGCCCTCAATTCTCTCTAAGCCTTGGGGTTTCCC
CTGGTTGATCACAGAAAGAAGCTTCCTGCCTTCAAAATTCATCATCGCTCTCCACAGCCAGAGTCCCCAG
AAATGGGGTGGTTGTGGTGGGAGATCTCACAAATTAATACTCTGTATGTGCCAATCCCCTTGGGTCTTCT

FIGURE 498 cont'd

```
TTCTCACTCCTTTTAAGGCCCAAGTGGTGTGTGTGTGGGTGTGTGTGTGGGTGTGTGTGTGTGTGT
GTATGTGTGTGTGTACACCCCTGTGCTTTACCCTGTATTATATCAATTCTCAGGAAACCCTTTGGTGACC
CGGGAAATAAACTCTGGGGACACTTCCTTATGGTCAGAGAAATCGCATCCATCCCTCCACTGGCAGCCTT
GCTCTGAGCCCAAACAAGGGTATTTGTGTACCTGAGCCTTTCGGCCTCTTCCTGCTTATCTGCTTCCGTC
TCCTTGCAGCATGGGCACTGGCTATACCATCCCAGACCCCTGGGCCCCTCTGACTAGTCTTGGCTTTATA
GACTGGAGCACAGTGGAAGAGAATTTACTCTCTCCAGCTAAATTCAGGCTTGCGGGCAATTTCTAACTTA
ATTCCTTTACGCTCTGGATCCCACAATCCGACTTCCATAAGCACTGAACGTTTTGTTAAACTCTCCAATG
ACCCATTATTTGCCACTTGCCTCTAGTTCCTTCCCTCTAACATTTGACATTCACACTTCCTCTCTGCCTA
TAATAATTGAAATTCTATAGGAGATGTTCTCTGACCATAATGGAATCAGCTTGAAATGAATAACAGAAAA
ACAGGAAAATCTCCACTCACAAGGATATTGAGCAACTCACTTCTAAATAATCCATGGGCCAAAGAGGAAG
TATCAAAAATACATAGAATTAAATGAAAATGAAAAGAAGATATTTCAAAATATGTGGGATATAGCTAAAG
GGAAATTTATGGCATTAAATATTTACATTAGGAAAGAGGAAAGTTCTTAAACCAATATTCTAAGCTCTTC
TTACACAATAAAGTAGTAAAAGACCAAAACAAACACAACGCAGAAGAAAGGAAATAATGAAGAGCAGAAA
TTAATAAAACTGAACATGAGAAAATCAATGAAACGAAAGAACTACTTCTTTGTTGTTGTTGTTGCTA
ACAAGAGCAAGTCTTTGAATTTCCCAAATGTATTTGTGGATTTGTCTATTGTTGAATAGAGCATTCTATA
AATATCAATTAGATCCTGTTGATTGATGCTGTTATTCAGTTCTTTGATATTCTCACATATTTTATCCTGG
TAGTTCTATCAATTTGGTGAGACTGACGTTTTAATTCTCCAACTATATTTGTGGACTTGTCTATTTCAC
CTTTCAGCTCTATCAGTTTTTGCTTCATGTACTTGAATCTCTGTTGTTTGGTACATATACCTTAGGATTG
CAATGTCTTGGCAGAATGATCCTTTGTTTTAGCAATGTTTTTCGCTCTGAAGGAAAGTATTTTCGTATT
AATATAGTACTTCCTTCCTTTTAAAAATTTATATTTAAAATTATATATATATTTATTTATTTATTTATCT
ATTTATTTTTTAGACAGAGTCTCGCTCTGTTGCCCAAGCTGGAGTGCAAGGGCATGATCTCGGCTCACTG
CAGCCTCTGCCTCCCAGGTTCACGCAATTCTCCTGCTTCAGCCTCCCAAGTAGCTGGGATTACAGGCACC
TGTGACCACGCCTGGCTAATTTTTGTATTTTTGGTAGATACGGGGTTTCACCATGTTGACCAGGCTGGTC
TTGAACTCCTGACCTCAAGTGATCTATCTGCCTTGGCCTCCCAAAGTGCTGGGATTACAGGGGTGAGCCA
CTGCACCCAGCCTAAAATTTATATTTATAATAACATAAATTAATAAAATTAATATATATTTCTATTCTTT
TATTTTCAACCTACCTATGTTGTTATATTTGGAGTAAAGTTTTTGGAGACAGTATCTAGTTGGATCATT
TTTTAAATCCACTCTACCAATCTCTGGCCTTTTATTTCATGTAAGGAGATAGACTATTTACATTTAAAGT
AGTTATTGATATGTTTGGACTTAAGATTAACATTTTAATATTCATTTTCCATTTGTTCCATTTCTCATTC
TTATTTTTTCTTGCATTCCTGTGAGTTACATGAGCATTTTTAGCATTCCATTTTGATTCATATTATTTT
CGAATACATAATTTGTAGAATTTTCTTAGCACTTGCTCTAGTACTACAATATACATATGTAACTGATTAT
AATCCAACTTATGAATATTTTACCACTTTGATTGAAGTGTTGAAACTTTACATCCATATAGATCCTTTTA
CCCTCCCACTTATACATATGCGTGTGTGTGTATACACATATAACTATTTTAAGTATTGTCTCTTCCTATA
GACATCAGATAATACTATAATTTTTGCTTCAACCAACTACGATTTTTAAAAACTCATGAGAAGGGTAATC
TGCTATAGTTATCACTATTTTTGTCCATTCTGCTGTTCTTCCTTCCTTTCTAAAGTTCTGAGCCTTTTCC
TGTAATCATTTGGACTTTGGAGAACTTCCTTTAATCATTCTCTAAAAATAATTCTGCTGACGGCAAAGTC
TTGTAGTCTTCCTTCATCTAAAAGCTTTTTATTTCTTCTTCATACCCCGTAGATAGTTTTGCTGCATATA
AGATTCTCGGCTGGGCACAGTGGCTCACGCCTGTAATCCCAGCACTTTGGGGTGCTGAGGCGGGCAGATC
ACAAGGTCAGGAGTTCCAGACCAGCCTGGCCAACATGGTGAAACCCTGTCTCTAATAAAAGTACAAAAAT
TAGCCGGGCATGGTGGCGGGCGCCTGTAGTCCCAGCTACTTGGGAGGCTGAGGCAGGAGAATCACTGGGA
GGTGGAGGTTGCAGTGAGCCAAAAGCACACCACTGCATTCCAGCCTGGAGGACAGAGCGAGACTGTCTCA
AAAAAAAAAAAAAAAGATTCTCAGCAGATAGTTATTTTCTTTCAGCACTTGAAGAGTATTGCTCCAGGC
TTTCTTCTCCATGGTTTTTGATAAGAAATTTTTGTCATTTGATCAGTGTTCCCTATAGACAATTTATAA
TTCCTCTCTAGCTGCTTCCAAGATAGTTTCATTGTTTGCCTTTGTTTTCATAAGTTAGTTATACTGTGTT
TTGGCATGGAATCCGTCAGATTTATTCTGTTTAGCTTCTTGCATCTGTAGGTTTATGTCTTTTGCCAAAT
TTGGGAAGGTTTGGTCATTATTCTTCAAATATTTTTCAGCCCCACTTTCTTTTCTCCTTCTGTTAATCTG
ATAATACAAATGTTAGCTATTTTATAATTGTCCTGCAGGTTCTCTGAGCCCTTGTTAGTCATTTCTGTT
TCTCTTTTTAAAGTTGATTGTCTCTCTGTTTTTGGATTGGGTAATTTTATTGTTCTATCTTCAAGTT
CACTTCTTATTTCCTTTGTCATAGTTGCTCTGCTCTTGAGCCTTTCCAGTGAGTTTTTATTTTAGTTATT
GTATTTTCAGTTTTATCATTTTCATTTGATTCTTTAAGAACATACTTTCCATTTCTTTGGTGAGATTTT
CTTTTCTTTCCCATCTTTGCAAGGAATTTCTACTTGCTTGGTGAAACATTTTTATGATGGCTACTTTAGA
TCTTTGTCAGATAATTCTAAAATCTTTCATCTCAGTGTTAGATTGTTGATTGGCTTTTCTCATTCAAGTT
GTGATTTTTCTGGTTGTTCATATTATGTATGATTTTAAATTATATCCTGGACATTTCTGGTATTATGAG
AGGAGACCCTGGATCCTATTTAACTCTTCCATTTTAGCAGTCACTGTTTTAGGTTAGCATGCAGGTCCT
GGCCTACTTTTGTGTGCTATGATTCCAATGACAATTTAGTTTTCAGAGCCCTTGCATTATTATTCCGGTC
TATTTCATTTGCCTGGTGCTGGTTGAGCTCATACCCAATTCCTGTTAGTACCACCAATGGAGGTTAAAAG
CATTTTCTTGGGGCCTGCTTGGTGCTGCTACGTTAGGAGTAGGAGACACTGGCACAAAAGGGTGGAGAGT
ACTTCCCTGGGCTGCGTGGTGCCAGCAGGGCTCTTCCTTCATCTCTGCCATCCACTAGGGTGGGGAAAGC
ACCTACCTGGGTGCTTTCTGCCGCTGGATAGGGGCTGGGGAGATGCTGGATCTAGACCACGTCCTGTCG
TTGGGTGGGAAATTGAGAGATGCTGGGCCACTGAGATGTTTCTCGAGTTCTAAGGCCCTTGTCAGTTTTC
CTTCTTTTTATCTTTCAGAGTCCTCTTAAGAATGTCTGTTATGTTATTCCAGGGTTTTTAGCAGAGAGGA
GCCAGGAAAAATAAATCTATGTCATCTTGACAGAGATGTTACCATCATCCTGGCTTGTTGTAGTCTCCTA
```

FIGURE 498 cont'd

```
AGATAGAAATCAAGTGAGATTACCAGACACAGTATTAAAGAGAAAAAAAAAAAAAAGTTTGTTTCCGTTT
GTGCAGAAGGGAGGTCAGCACCGTGAAAGGAAAAGGGTAGGCTGCTCCCCACAGGGAGCAAGTCGATCTG
TCTTGTAGGGGTCCAGATGCCATGATGTGCCTGTCATCATGTGTTAACAAGGGATTTCTTGGCGCCTGCA
CAATGGTTCAACATGGTTTTTCATACATTGCATGTAATATTGGCATTTTAAATCTCTACCTCTGAGCATG
ATTTTTAGCATTGAAATAAGGAAATTATCACTGTAAGTTGAAACCTAAGCTGTTCCTGTGGCTTCCTGGG
GAAGTCCCTAAGCCCCTAAAGCAGGAACTTGTGGTTAATAGCTTCTTGGGCCTCTGATGCTGACTGGCTG
GAGGTTAGGTATAGAACAGGAATTAAAAGAAATAAAGAATGTGTAAGCAAAACTTAGTTGTATGTAAGAA
AACCCAATTCCCCCTGAGGAAGAGAAAGAGCTGGAGTCCTTTAAAATTAACTGCCTGTTTTCTATGGCT
AGTGAGCCTTATCTCTCCCTTTCCCAGGCATTGTGAAGACTCTGTTTCTCTAGCTGTGCAGCTGTAAGAT
CACTAGACAGATAATCTCAAGTCGTAAAACATGCTGTTCCTTGAAAAAAAAATGATATAATGCATGTCTC
AATTGAATGACTGTCTTTGTTTCTCACTTCTGTGATATGCTTCCCCCTGCACAGATCTCCCCCAGCCCCA
CGAAATGCTTAAAAGGTAGCTTGACTCTTTGTTCAGGGCTCAGTCCTTTGGATGTTAATCTGACTGGGTC
GGTGCACCTGAATAATTAAATAATTCCTCCTCAACCCCACGGTCTCTCTGATTCCTTAATTATCCTGCTG
CAGACAAGCTACAGCTTGAGTAAGGGGCTTTTGTTCTTTTTCACTAAACCACCTCAAAATAGGAAGCCAG
CCAGCTGTCTCACTCCCAGCCAAGAGATTTCATTCTCCTTATTCTTTTTTTTTTTTTTTTTTTTTTAGA
CCAGGAGAAATAACTTTATTTGAATAGGACCCGAGACAGCATATTGGGCTAAGGAGGAGAGGTAAGGTTC
CAAAACCGCAGTCAAAGCTCATCAACCAAATGGACTCTACTTCCCAGCAACCTTGCAGTTAGTGCAACCA
ACAAAAGGCCTGCTGGGGAATGTATTTGCCACTAAATCCCCCAAGTATGCCAACATTACAAAAAAGATAG
AGGTTTTTCATCATAATTGAATTTCCACAAACCTCCCCAATCACAAGTATTATAAGTGGAAGTAAAAAAT
CACATTTTACAGATCTCAAACTTGTCTTCAACATTTAGTTCATCATCTTCAAAAAATAGCTCCCCTGCCT
AATTCATTAGCTATATGATCTCTCCAAGCAGCAACAAGATGGCCAGGCCATGGCAATCCTCTTCCTATTT
CCCCTAGCCACTCAGGGCTCAACAGCAGGGTGAGGCTCAGGTGGAGGTAGGGGGTGGGGAGCACAAGGGC
TACATTCCCCCAGTACAACGTGGCATCTGAAGCTTGATGGGAGAGCAGAACTGGTGGGACTTGAGGGAAG
GGTCCAGGGCCTGTATTCAGTCAGAATCACTGCTGGAAGAGGAGGAGGAAGAGGAGGAATGCTTGTCATG
CTTGTGGTACTTGTGGTGCTTTTGGTGCTTGTGCATCTTTTTATGAGCTTTCTTCATTTCTTCTGCATC
TTCTTGTCCACTATCACTGCTGGTCCAACCATGCCAGGAGCCAAGGGATTCACAGGAGGGATTCCAGGGG
CAGGCGGTGGGTATGGAGGAGGGTAGGGACCCAACGGTTGGCATCCTGGATACCCTGGCTGTGGCACAGG
ATGAGGGGGCCCACCTGGGGGGAAAGCTGGATTGCCATGGGGAGCTCCTGGGGGAGGAGGACAGGGGCCT
GGGGGAAAGGGTGGATTAATAGGTGGTGGGTGGGCAGGATTGGAACCTCCAGGGCACCCAATATTGGGGG
GATATGGATTTGGCCCTGGCTGCCCGGCATTGGGATTCCACATGTTTAGGTGTGTCCTCCAGCCTTTCCA
CCGCCGCCTGGGCTTGCTGCGTTCTCCTTCGCAGTCCTCATTCTCCTTATTCTTAAGGAGCAAAGGTCTC
TTCTGGAACTACTTCCTGCTAAGCATGGACATAGTCTCTACATCTATTTCCAGGAGGAGTAGAAATTTCT
TATGGCTTGCTGAAGGGGCTGATACGGCTCTGGGCTAGTGGTCTCTGAAACAGGCTGGAAGCCTGGCAAG
ACCATTTACTTGGCATGAAAGCATTACAGTCTGAAAGACGTGAATTTTACCAGCAGGTTAAACAAGCATG
GTTTAAAAATTAAAAATTTAAAGATTAAAAACTTTAAATATTAAAAGAAGAAAGATAGCCAATAAGGGCT
TAAGAAAGGGAGGAACCAAGTTACAAGCCTTACAAGGGTAAGGTTCATCTGACAGCATTGTACACTAAGT
TGACTTCCTTTATCAAAAGAGTGTAACCAATTTCCTGATTGTAAATTGCCTGGGTGTTAACCTCTACTCG
CCCAGTAGTATTTATCCAAGTGCAGCAGGAGGTATGGTGACTGTACAAACATCTTCCTGTTCAGCTAATA
AGTAACCTAGAAGTCTTGCACAATGATTAACTTGACATGAAACTATTGTAGTCTGAAAGACACAAATTTT
ACCAGCAGGTTAAAGAAGCATGGTTTAAAGATTAAAAGAAGAAAGATAGCTAATAAGGGCTTAAGAAAGG
AAGGAACCAAGTTATGGAGGGTAAGGCCCAAGTTATGGAGGGTAAGGCCTAGCAGTTGTCCAACACCACA
TTAGCAAGAGAATTGAGGGAGGTTTTAGCCTTTCCAGGGCCTGCCTCACCTGGTCCACTATATGCCTAG
GGCTATTGTGACTCCAGGTACCCTGCACCCAGACTAAAAGGAAGAGGTTACAGTGAGATAGAAGGTACAG
TGGCTGGGCGCGGCGGCTCACGCCTGTAATCCCAGCACTTTGGGAGGCCGAGGCGGTGGATCACAAGGT
CAGGAGATCAAGACCATCCTGGCTAACACGGTGAAACCCCCATCTCTAAAATACAAAAAATTAGCCAGGC
ATGGTAGCATGCACCTGTAGTCCCAGCTACTTAGGAGGCTGAGGCAGGAGAATCCCTTGAACCCAGGAGG
TGGAGGTTGCAGTGAGCCGAGATCGTGCCACTGCCCTCCAACCTGGACAACAGAGTGAGACTCCGTTTAA
AAAAAAAAAAAGGAAGAGGGTACAGTGGGAGCATGATTCATGCCAGGCCCTCACCATGTCTTGAGTATG
ACCTGTGCACCTAATAGGGAAATGATCCCAAACTATCTTACCCAGCTGGGGTAATATTTTATTATTATAT
TGTCTGCTAAATTTTCCCCAAGTTGATAATGTATTTTAAAGCCTGATTTAAGTCTTCATCTATTAGAAAG
TTTGTCTTGAGAAAGGACTGCTCCAATAGGTCATTTTAAAAGGGCTGAGCTTTAAGTTCCCCTTTGGGGT
GGATCTTATTCTTAGTAAGGCAATAGGGAGGCACTTAATCCATGATTTCTGGGCTTCTTGGCATAGTGTA
GCCAAGGTTCTTTTTAAGGGTTTGATTCATTCTCTCAACTTTCCCAGAAGATTGAGGATGCCAGGCAGAG
TGAAGTTTGTATTGGATGCTAAGACTGCTAGACAGCCCTTTGGTGACCTAGGTGATAAAAGACAGCCTGT
TGTCACTTTGTAGGGAGGCTGGAAGCCCAAACCTAGGAATTCCTTGTTTAAGCAGCCATTTACTTTTTGT
TTGTCTGGTTTGGTTTGGTTTTAATTTTTTTTTGACAGAGTCTCGTTCTTGTTGCCCAGGTTGGAATG
CAGTGGCACGATCTCAGTTCACTGCAACCTCCACCTCCAGGGTTTAGGTAATTCTCCTGCCTCAGCCTTC
TTAGTAGCTGGGATTACAGGTGCCCTGTGCCACCATGCCCAGCTAATTTTGTATTTTTTTTTTTGAGA
CGGAGTCTCGTTCTGTCACCCAGGCTGGAGTGCAGTGGTGCGATCTCGGCTCCCTGCAAGCTCCGCCTCC
CGGGTTCACGCCATTCTCCTGCCTCAGCCTCCCGAGTAGTTGGGACTACAGGCGCCTGCCACCATGCCCG
GCTAATTTTTTGTATTTTTAGTAGAGATGGGGTTTCACCGTGTTAACCAGGATGGTCTCGATCTCCTGAT
```

FIGURE 498 cont'd

```
TGTGATCTGCCCGTCTCAGCCTCCCAAAGTGCAGGGATTACAGGTGTGAGCCACCGCACCTGGCCTTAAT
TTTTGTATTTTTAGTAGATGGGGTTTCACTATGTTGGTCAGGCTGGTCTCAAACTCCTGGCCTCAGGTGA
TCCGCCCACCTCAGCCTCCCAAACTGCTGGGATTACAGGCGTGAGCCACTGCACCCGGCCTTTAAGCAGT
CATTTACAAACTTCAATTGCTTTTTCTGTTTGTGTGGGGAAAGCTTCCACCCAGCCTGCGAAAGTGTCTA
TAAAAATCAGAATATATTTGAATTCCCCTTTAGGGGTATCTGTGTAATTCGCCAATCTTCTCCAGGATAG
GTCTTCTTATGCTGCACTGGGCAGAGCCAGTGGATGGGCTCAGGAATTATTTCTAAGACAAATTTCACA
TGCTTGAGTTACAGAGTCCACTGTGGCTTTTTATTTTTATTTTTGAGACTGAGTCTCACTCTGTCACC
CAGGCTGGAGTGCAGTGGCATGATCTTTGCTCACCGCGGCCTCTGCCTCTCAGGTTCAAGCAATGCTCCT
GCTTCAGCCTCCTGAGTAGCTGGGATTACAGGCATGCGCCACCACACCCAGCTAATTTTATATTTTAG
TAGAGACGGGATTTCACTAAGTTGGCCAGGCTGGTCTCGAACTCCTGACCTCAGGTAATCCACCCACCTC
AGCCTCCCAAACTGCTGGGCTTACAGGTGTGAGCCACTGCACCTGGCCCACTGTGGCTTTTTCTTTCTTT
CTTTTTTTTTTTTGACAAGGTCTCGCTTTGTCACCCAGGCTGGAGTGCAATTGTGCAATCTTGACTCA
CTGCTGCCTCAAACTCCTGGGCTCGAGCAATCCTCCCACCTCAGCTTCCCAAGTAGTTAGTACCACAGAT
GCATTCCACCATGCCCAGATAATTTTTAAAAATGCTTTTGTAGAGACACAGTCTTATCGTGTTGCCCAGG
CTGGTCCTGATCTCCTGGGCTCAAGCAATCCTCCTGCCTCAGCCTCCTCAAATGCTGGGATTACTGGTGT
GAACCACCATGCCTGTTAGGCTGTAGCTTTTAAAGCCTTGCTCACTAGGAGATTTTGGATTAAATTCCAT
AGTGAGTCTCTCTCATAATGAGTTTCCTCATGAAGTCTTTTGATGACTTTCCATTGGTCAGCTTCTGGTA
GGAAAAGGCATTGTTGCTGATCTTCTAGCCACCCTGACCATTTAAATTATACCCTCCTTCATCTGCTCAG
TTTTTTTTTTTTGATGGAGTCTCGCTCTGTTGCCCAGGCTGGAGTGCAATGGTGCCATCTCAGCTCATG
GCAATCTCTCCCTCCTGGGTTCAAGCGATTCTCCTGCCTCAGCCTCCCAAGTAGCTGGGACTACAGGCAT
GCACCACCACGCCCAGCTAATTTTTGTGTATTTTAGTAGAGACAGGGTTTCACCATGTTGGCCAGGCTGG
TCTCGAACTCCTGACCTTAGGTGATCCTCCCACCTTGGCCTCCCAAGGTGCTGGGATTACAGGCATGAGC
CATCACTCCTGGCCAACCACTGCCAACTTCTTTTTTTTTTTTTTTTTTTGAGATGGAGTCTCGCTCTG
TCCCCTAGGCTGGAGTGCTGTGGTGCGGTTTCAGCTCACTCTAAGCTCCACCTCCCGGGTTCACGCCATT
CTCCTGCCTCAGCCTCCCAAGTAGCTGGGACTACAGGCGCCTGCCACCATGCCCAGCTAATTTTTGTGT
TTTCAGTAGAGACGGGGTTTCACCATGTTAGCCAGGATGGTCTTGATCTCTTGACCTCGTGATCCGCCTG
CCTCGGCCTCCCAAAGTGCTGGGATTACAGGAATGAGCTAACGCGCCCGGCCCAGCTGCCCGTTTGGCAG
CTCTATCAGCCTGGTTGTTTCCTTGGCTGATTAAAGAATTGTCTTTTTGATGCCCTTTATAGGACATAAC
AGCTATTTGGGCAGGGAGCTTAATATGGTTTGGCTCTGTGTCCCCACCCAAATCTCATCTCGAATTGTAA
TCCCCTCATGTCAAGGGAAGTACTTGGTGGGAGGTGACTGGATCACGGGGGCAGTTTCCCCAATGCTGTT
TTCACAATAGTACGTGAGTTCTCATGAGATCTTAAAAGTGTGTGGCTTCCTTCACTCACTCTC
CTGCTGCCATGCAAGATGTGCCTTGCTTCCCCTTCACCTTCCGCCATGATTGTAAGTTTCCTGAAGCCTC
CCAGCCATGCAGAACTGTGAGTCAATTAAACTTTCTTTGTTTATAAATTACCCAGTCTCAGGTATGTGTT
TATAGCAGTGTAAGAACAGACTAACATAGAGATGAACTGCCTCAAGGAGGAATAAAATCGCTTCATTGGG
TTTTGTCGGGGTGCTCCTGGCAGTTAGCATTCTCCTCTTTCCAGACAGCTGCATGAGTATGGAGCATTAG
GAATCCATACTTAGAATCAGTATATATATTAAGTCTCTTCCCTTCTTCAAGCTGAAGAGCCCTTAACTAA
GGCTTGGAGCTCTGCTTCCTGAGCTGAAGTGCTTAGGGGAAGTTATTTTGCCTCTCTGGTCCAGCGTAGG
CTGACAATAGCATGTTTTGCCTTCCGGGCTCCATTTTATTTGTTTGTTTGTTTTTTTAGATGGAGT
CTCGCTCTGTCACCCAGGCTGGAGTGCAATGGCGTGATCTTGGCTCACTGCAACCTCCGCCTCCCAGGTT
CAAGCGATTCTCCTGTCTCAGCCTCCTGAGTAGCTGGGATGACAGGCGCATCACGAGCCCAGGACTTCGA
GACCAGCCTGGGCAACATGGTGAAACCTGTCTCTGCTAAAATACAAAAAATTAGCTGGGTGTGGTGGCGT
GCCACCATGCCTGGCCTGCAGGCTCTATTTTCTACAAAACAACCCCCATCTGTAAACCATTCTTCATCTG
GATTCTCTCAAGGGGTCTCCCGTAAATCTATCCAACTAGAATAGATCTGCTCCAAAGTTTCCACATAGGT
GTGTTCCAGTGTCCCCAAGGTGGGCAAGGGAAGGAGGGTGGCAGCATTCAAGGACTCATATATCTTTAAG
GTCAAGTCTGGGGTGTCTAACAGTGGGGCTTGATTTTGAGTTAACCTTCCCCGAGTTAGCCAGTGGCTCC
CTTTGATTTCCAACACATTCTGGACCTGGTAAGGAGTATAAACTTCAAGGGATTGGCCTAGCATGAGTTT
GGAGATATCCCTGACCAGGAGGCTGGTGGCTGCCACTGCCCTAAGACAGCCAGGCCACACCTGGGCTACT
GGGTCCAGTTGATTTAAAAAATAAGTCACTGGCCTTTGGACAGGCCCTAGCTTCTGAATTAGGACTTCCA
GGGCTTTGCCCAGAGAGGTGGAGGCTATCTGGAAACCCCGGGGTAGCACTGTCCAAGTACAGTGGGGAG
CTTCCTGAGTCTCTGGATCCTTCCATTCAAAGGCAAAATGTAGGTGGAGTCAGGATGCAGCATATATTA
AAGAAAACATCCTTTAGATCCAGTACAGTGTAAAACTGTGTGCACCCAGGGATTTGAGAGTGGAGTGTGT
ATGAATTAGGGACTGAAGGATGTGTGGGAACAACTGGATGCATTCACTACTCTAAAGTGTGGAAGAAACTG
GTATTCTACATTTGGTTTCTTCACAGGCAGGACTGGAGTATTACAAGGGGACTGCAGGGCTGAATTAGTC
TGTTCTGTATCAATGTTTCCAGGAGGGGCCATATCCCTTGTAGGGCTTCTGGCCTCAAATGGTATTTTGG
CTTGCGTGGGTAGGGTAGGCCTGGCTTAAGCTTTATTTTAATATTCTCCTCATTGATGACCTGTCCTGAA
ATGTTGGTATCCCATACAGACTTTTCCACTCAAATCAATATCTTTTCTAGGACTGGGGGTAGCTTCTGAT
CTTGGGGAACCAAAAGGGCCAGTAAATGGATTCCTTTCTCAGGAGGCACTGAGACTTGTATGGCATTCCC
CTGGAGGGAAACTGAGGCTCCCAACTTAGATAATAAGTCATGAACCATTAAAGGAAGGGGACACTCAGGG
ACATATAGGAAGGAATGAGTGATAGCCTTAGATCCAATTTTACAAGTCAAAGGAAAGGTAAACTGTCTTA
CCTTGGGTTGTCCATCTGTTCCCGTCACTGTACAACTGGCGCTGAACAGAGATCCATCAGGATGGGTCAG
GACAGAGTAGGGGGCTCTGGTATCCATAAGGAATTCAGTTTCCTACCTGCCATATTGAGGGTGACCCAAG
```

FIGURE 498 cont'd

```
GCTCCACAGTGGTGATGGTGATGGAACTCTTCAGGACTGGAGGCAGATAAGCATTTGAGAACACCTCATT
CAGAGGGGGTAGCCTTTTTATTTGAGAGGCCAGCAACAAGAGGAGTGGGCTGGGGAGGTCTACTCCATCC
TGGCTTCCCAGAAAAGAATGGACAGTCCTTTCTCCAGTGCCTCTTCTTACAGTAAGCACACTGGTTGCAC
CCCATTTCCATGGACATTGGGTGGGGTTTAATCCCCACCCCCCGCATTCAGGTTTCTCTGTTACCTAAG
GTCACCTCAAGGTGGGCCTATGATTATAGCAGCCAAAATGTGTGTCTTCCTTTTTATTCTCTCATTTTTC
TACACCTTCTCTGCCTGGTCCCAGTTGTTAAAAATGTTGAAGACCTCTGCTACCAACGTTGCTTGAAGGG
TCTAAGGGTCAGCTTTCAGCTTTTGAAGGTTTTCCCAAATGTCTGGCACAGCGTGGGTTATAAAATGCAT
GGCCAGAAGTGTTAGGCCTTCATTGGTCCTTGGGTCTATGTTACTATACTTTCTAAAAGCCTCAGAGAGC
CTATTAAGGTACCCAGCTGGATTTTCATCCACTTCCTGAGCAATTATTTTACTTTATTATACTTTACTGG
TTTTGTCTGACACCCTCTGATATGCAATTAAGGAAGTGATTGATCCTTAACCAGTCCCTGTCATCCGTAT
AAACCCATTGCGGGTTCTGCTCTGGGACTGCCTCACCAGATACCCAGTAAATGACATGGCCAGGATTATA
TCTGGCCATCTCCTCTGCATATTTCTTACCCTTTCCAAGATTCGAGTTTTTTCACCAGGAGTACAACAAC
GAGTTAGGACTACAAGAACATCTTGTCAAGTCAAAGGAAAGGTTAGACTAAACTTAATAAATTCATCACT
AAACCTATCTGGATTGTTCAAGAACCGGCCAAACCAATCCTTGCCTTGATTTATGTCTGACATTGGTAAG
GGTCCATGTACCTGAGTTGCCCCTCTAGTTCCATCCGTTACCTCCCAGGGGGAAAGCAGCCCTGGTATGG
TGGGGAAGTGAAGGAGGGTGCTGACTTGGAGCCCAGTTGGAGCCACACTGGGGACAGCACTGAGGGTTGT
TGAGGAGTAGAAGGGGAAAGCCTTCCTGACCCAGCATGGTATGGAGGAGGCTCCAGACAGAAGGAGAAAG
GATCCACAGTAGCAGAGAGGCCTGCTTCCCACCCTGCCCTTAGAAAGGTAGTGAGAGAATTGAGCCCTAG
GGGTTAAAATCTGAGACAGGACTTGGCTCATCTCTCAGCTGTTGCTTGAGAGGTACCATATAAACCTGGC
AGGAGTCCTAGAGTTTGAGATCCAGATATAATTTCCTGAAGGCCTGCATGTATGGAATCTCAAGCTATTT
ATTAGAATTTTTTACAGTATATATCCAATTGGAAAATGATGTTGTAACTGAAGGACCCCATTCTCAGGTC
ATTTCTCTTGGTACCCCAGGGGATACTGAGGCCAAGCAACATCACAGAGAAACACGAGCTTCTTTTTCTT
TGTAATATCTCATTTAAACTGATCCCAATTACAGAGGATGCATCCAAGGGGGGGAATCTTTGGGACGTC
TGTAGTGTTTCCCATGGTAGAGCTGGTGTCCTGTAATCAAGAGGTCTGGTGAGGGATGCAGCCTCTGACT
CTGACAGTCTTCACAATTGCAGCACACATCCTGGTCTGACTCATCCCAGACCTTCAAATCCCTGGCAAGA
ACTAAGCAAGCCAAAGAGGACAGAGGGAGGAGAGCAGAACGAGGGGGCTTGAGAGCCTTTAGCTCTTGGA
TTTGCCAGCTTCAACCCACAAAGTCTAGCAAGTAGTAGATTTTACATCAGCTCCAAGTAGAACTTACTCT
ACACCCACATTTATTTACATGGACTCTAACAAGAAACGAGATGATGTACTAGACAGAGGAAAAATTTCAT
CTGGCCTAATGAGTAAGGCTTCCTTCCAAGAATCCTGGAGGGTGGCTTCACCCATGCAACAAGGACCAGA
AACAAGAACGCATTTCCATTCAGACAACTGACAAAACAGATTATAAACGTCCAGGCTCCACAAAGAAGAA
TACGGTCAGGGAAAATACTGAGTGGTTTCAGTATTTGAAACAAAAGAGAATTCCAGATTGCCGGCTGGTA
CCTAGCCCACACATGTCTGGGCAGTTCCCTAGACCAATCTCAGAAGGGCCAGCCAGAATCACTCCAACT
GCCTACGCAAGTTTCCCAGAAGGGCTAACTGGAATCACCCCAACTTCCCACCCAAATTTCCAAAAATAAG
GGAGAGAAGGAGAGACAAAAGAAAGAAAGAGGCCCTTATCAATGTCAGACATAAGTCAAGGCAAGGATTG
GTTTGGCCGGTTCTTGAACAATCCAGATAGGTTTAGTGATTAATGTATTAAGTTTAGTCTAACATTTCCT
TTGACTTGACAAGATGTTCTAGTAGTCCTCACTCATTGTACTCCTGGTGAAAGTTTCAAATCTTGGAAAG
GGTAAGAAATACGCAGAGGAGATGGCCAGATATAATCCTGGCCATGCCATTTACTGGGCATCTGGTGAGA
GAGAGAGAGAGAGAGAGAGAGAGAGAGAAGAAGAAGAGCAGACTCACCTAGGGTCCAGACTTGACTCT
CCAAAGCACCAACACCAAAGCAATGGTCCAGAGTGGCCACCTTTGTTACCACCTGGTCAGTTGCCTCTGT
CCTCCAGGAAGTCTTGCTAACTCCTGTGGGACCTAAATGAGGGTCCCATCTGGGGTACCAGGAGATGT
TACAATCATCCTTGGTTCTTGTAGTCTTCCAGGATAGAAATCAAGTGAGATTGCTGGGTGTGGTGGCTCA
CCCCTGTAATCCCAGCACTTTGGGAGGCTGAGGCAGGTGGATTGCTTGAGCCCAGGAGTTCAAGACCAGC
CTGGGCAACATGGTGAAAACCCATTTCTACTAAAAATACGAAAAAAAACAGCTGGGTGTGGTGGTGCACA
CCTGTAATCCCAGCTACTTGGGAGGCTGAGGCAGGAGAATTGCTTGAACCTGGAAGGCAGAAGTTGCAGT
GAGCTGAGATTGTGCCATTGCACTCCAGCCTGGGCGACAAAACAAGACTCCATCTCAAAAAAAAAAAAAA
AAAGAAAGAAAAAGAGAATGTTTATTTTAGCTTGTGCACAAGAAAGGTCAGCACTGCAAAAGGAAAAGGG
TGGGCTGCACCCCAAAGGGAGCAGGTTGATCTGTCTTATAGGGGCCTAGCTGCTGTGACGTGCCTGTCAT
TGAATGTTTAGGAGGGATTTCTTTGGTGCCTGCACAGTGGTTCAACACGCTTTTTCATACATTGTATATA
ACATTAGCATTTTAAATCACCTCTGGGCATGATTTTAGCATTAAAATAAGGAAAAGTTGAAACAAGCCT
AGCTGTACTTGCAGGTCCCTGGGAAGTCCCTAGGCCCCTAAAGCAGGAACTTGTGGTTACTAGCTTCTT
GGGCCTTTGATGCTGATTGGCTGGAGATTAGGTAAGCTACATCTTGAGTAAGGGCTTTTCTTCTTTTTC
TCTGGACCACATCAAAACAGGAAGTCAGCCAGCTTGCCTGTCACAAAACCAGGAGTCAATAAATAAATG
ATTTATTATTTGAATAATGTATTTGTAGGTTCTTTTGGGTTCTCTACACATACAATCATATTGCTTATGA
ATTAGTTTAATTCCTTCCATTCTCATCTTTATAACTTTTCTTTAGGCTTTCCAATAGATAATTGAATAAA
AGATATGATGGGGGCATCCTAGTCTTGCTTCTGATCACAAAGAAAATACTTTCCATTGGTTTTTGTTGTT
GTTTGAGAGGGAGTCTCGCTCTGTCACGCAGGCTGGAGTTCAGCGGCACAATCTAAGCTCACTGCAACCT
TTGCCTCCTGGGCTCAAGCGATCCTTCCATCTTAGCCTCCCAAGTAGTAGGGACTACAGGCACATGCCAC
CACGCCCAGCTGATTTTTGTATTTTTCTGTAAAGATGGGGTTTTTGCTCAGGCTGGTCTCGAACTCCTGG
GCTCCAGTGATCCACCTCCCTCAGCCTCCCAAAGTGCTGGGATTACACGCATCAGCCACTACACCCAGCC
TGTTTTCAATATTTTGCTATTAAGTATGATGCTTACCGTAGCATTTTTGAAAGTATACATTATTGTATTA
AAGAAGTTTCCTTCTACTTTTAATTGTTTAATCATAAATAGATGTTTAACTTTATCAAATGATTTTTCTG
```

FIGURE 498 cont'd

```
CATCTGTCTCAATGATATTAATATCCATTGTTGATCATTACCTTGATGTAGAGTTGCTAACTAAGATACA
AGACCTCCAGTTCAATTTGAATTTCAGGTGACAATTAATTTTTAGTATAAATATGTCCCATGCCATTTAT
TGGCTAAATCTGGAAACCTGTCTAGTTCCATTATTTCACCAGGGCTTTGCAAATGGGGATTTTTAATGT
ATTATTTTCTCTTCATTTATTAACTACAATAGCTATTATACAAAGAAGCATCCCCTCATTAATTCTCTGGT
TACCCTAAATTGTAGTTAATACAGAAAAAGCAACTTAAATGCTTCAATTTTCAGTTTTAGTACATTCTCT
CTAAAGGTAACCAAAACGTGTGTGTGCGTGTGTGTGTGTGTGTGTGTGTGTGTGTGTGTATGTAATAT
CCTTATGAATGCATGGATTTTTAACATTTGAAGTGGTCAAACCTTAGACCAGTGGGAGCTGTCTTGGTTT
ATGGTACATTTCCTACCCAGAACCACAATCATCCATTTCTAAAAGAGCCACAATTCCTATGATTACCAAA
TTGTATTTATTTATTTATTTTGAGACAAAGTCCTGCTCTGTTGCTGAGGCTGGAGTACAGTGGCATGATC
ATGGCTCACTGCAGCCTTGACCTCCTGGGCTCAAGTGATCCTCCTGCCTCAGCCTCCCAAGTAGCTGAGA
CTACAGACGTGCATCACTACACCCAGCTAATTTTTAAATTGTTTGTAGAGACAAGGTCTCCCTATGTTAC
CCAGGCTGCTCTCAAACTCCTGGATTCAAGTGATCCTCCTGACTTGGACTCTCAAAGTGCTGGGATTATA
AGTGTGAGCCACGTGCCTGGCCCCAAATTGAATTTAGACACTATAATTTGAGCACTAGGGGAGGAACTGC
CTTTAATATTTTTAATTTTGTAAAACATTTGCACAGTTCCAGAGCCAAAACTTGACAATAAGTTATCTTC
ACAGAGCTTTAGCTGCCATCCCTGTCCTCTCCACATTTCCTCCCTTCTCCTGTGAGTAACCATTTTTATG
GGATTTTCATTCAACTTTCCATCATTTCTCTTTGAAAATATAGGGAAAGACATACATATACAAGTGTGCG
TGTCTGTGCATTTCCCTTTCCTTCTTTTGCAAAAGGTAGCATATTATAGCATATCATACACATTGTGTTT
TCTTCTTTTTGTTTTGTTTTGTTTTGTTTTATGAGACCAAGTCTCACTCGGCCGCCCAGGCTGGAGCGC
AGTGTCACGATCTCACCTCACTAACCTCCACCTCCCAAGTTCAAGCGATTCTCCTGCTTCAGCCACTCAA
GTATCTGGGATTACAGGTGTGTGCCACCATGCCCGGCTAATTTTTGTATTTTTAGTAGAGACGGGTTTC
ACCATGTTGGCCAGGCTGGTCTTGAACTCCCGACCTCAGGTGATCCTCCCACCTCAGCCTCCCGAACTAT
TGAGATCACAGAAGTGAGCCACTGCGCCCAGCTCACACTGTTCTTTATTTTACTTTTTTACTTGACTTT
TTTTTTTTTGAGACGGAGTTTCACTCTTGTTGTCCAGGCTGGAATACAATGGCACGATCTTGGCTCACCG
CAACCTCTGCCTCCTGGGTTCAAGCAATTCTCCTGCCTCAGCCTCCCGAGTAGCTGAGATTACAGGCATG
TGCCATCACGCCCGGCTAATTTTGCATTTTTAGTAGAAATGGAGTTTCTCCATGTTGGTCAGGATGGTTT
TGAACTCCTGACCTCAGGTGATCCGCCCACCTCAGCCTCCCAAAGCGCTGGGATTACAGGCATGAGCCAC
TGTGCCTGGCCCATGAGCCACCACGCCAGGCAGGCACGTACTATTTTTCATTCCCACTAGCAATGTGAGA
GTGCCAATTTTCCCACAACCTTGGCAAGAGTATGTTATCAATCTGATAGGTGAGAAATGGTATCTCGATA
CAGTTTTATGTTGCATTTGTAGTATCATGAGATAAATCATTTGTTCATTTAAGGGTTTGCATTTTCTATG
AATTCTGTTCTTTTGTTTTCTTACCTTGTTGTGTTTTGTCATGCATAAAATTGTAATTATTATGTAGTC
AAATGTATCAGTCCTTTCTTTTATTGCTTCTGTAATTTGAATCAGGTAGCAAAAAAAATTGACCACTGCC
AGGTTATAAAGAAATTCATTGGCCGGGCACAGTGGCTCATGCTTGTAATCCCAGCACTTTGGGAGGTCAA
GGCAGGAGGATTGCTTGAGCCCAGGAGTTCGAGACCAGCCTGGGTAAAATTGGGAAGTTCTATCTCTACC
AAAGAATTACAAAAATTAGCCAGTTGTGCAGGTGTGTGCCTGTAGTCCCAGCTATTCAGGAGGCTGAGGT
AGGAGAATTGCTTGAACCAAAGGGGCAGAGGTTGCAATGAGCCGAGATCATGCCACTGCACTCCAGCCTG
GACAGTAGAGCCAGACCCTGTCTCAACTTAAAACCTAAATGAATAAATTCATTCACATTTAGTAGTTACA
GGGTTTCACATTTTAAAATTTAGATCTCTGACCTTTTCACATTTGTCCTGCTGTGTGGTTTGAGGAATGG
GTTTAATTTTATATTCTTCCATAGAGTTGTCAGCTTACTCCAGTATCACTGATTAAAAAGTCCTTCTTGT
CTCCAATGATTTGAGATGCAACCTTTATCATATACTAAATATCTATATGCATTTGGGTCTGCTCTGGATT
CTCTATTCTGTTCCTTCATTCTGTGGTATTCATGTGCTAATACCACACTGTTTTCATTAGAGGTTTTCTG
TTTTAATATCTAGTCAGGTCGGCCAGGCGCGGTGGCTCATGCCTGTAATCCCAGCACTTTGGGAGGCTGA
GGCATGTGGATCACGAGGTCAGGACCTCAAGACCAGTCTGGCCAACATGGTGAAACCCCGTGTCTACTAA
AAATACAAAAATTAGCTGGGCATGGTGGCACGCATCTGTAATCCCAGCTGCTCGGGATTACAAAAACAA
GAACAGCTAAGAAAGTTCTGAAAAACTCAGGAGGCTGAGGCAAGAGAATCACTTGAACCCAGGAGGCAGA
GGTTGCAGTGAGCTGAGATTGTGCCACTGCACTCTAGGCTAGCGATATATATATATATGTGTAGTCAG
GTCAGTGGTGCCTCCCTACTCTGGTCTTTTTCAGAATTTTCTTAGCTGTTCTTGTTTTCTCATTCTCCC
AAATAAGTTTTACAATAACTTCTCTAATTCTAGATAAAAACCTGATGATATTTTGGAGGGATTGCATTA
CATTTTTAAACTAACTTTTTGAGAGATATTTTTATTATGTGAGTCTCCTATCCAAAACCATTGCCCTTCC
ATCTATATATGTTCATGTTTACCTTTGTGAATAATAGAAAAGCAGACACTATTCACGTTTATCTTTAAAA
AAAAAAAAAAAAAAAAGCAAATAGGCCGGGTGTGGTGGCTCACGCCTGTAATCCCAGAACTTTGGGA
GGCTGAGGCAGGAGAATTACTTGAGTCCAGGAGTTCAAGACCAGCCTAGGCAACATGGTGAAACCCCATC
TCTACAAAAAATCAGCTAGGCATGGTGGTGTGCACCTGTAGTTCCAGCTACTCGGAAGGCTGAGGTGGTG
TCAGGCCTCTGAGCCTAAGCTAAGCCATCGCATCCTCTGTGACTTGCACGTATAAGCCCAGATGGCCTGA
ATAACTGAAGAATCACAAAAGAAGTGAAAATGTCCTGCCCCGCCTTAACTGATGGCATTCCACCACAAA
AGAAGTGAAAATGGCTGGTCCTTGCCTTAAGTGATGACATTACCTTGTGAAAGTCCTTTTCCTGGCTCAT
CCTGGCTCAAAAAGCTCCCCCACTGAGCACCTTGCGACCCCCACTCCTGCCTGCCAGAGAACAAAACCCC
TTTGACTGTAATTTTCCTTTACCTACCCAAATCTTATAAAATGGCCCCACCCCTATCTCCCTTTGCCCCC
ACCCTATCTCCCAGAGTAGGGAGGCACCACTGACCTGACTACATATATATAAATATATATATATATAT
ATATATATATATATATATATCGCTAGCCTGGAGTGCAGTGGCACAATCTCAGCTCACTGCAACCTC
TGCCTCCTGGGTTCAAGTGATTCTCTTGCCTCAGCCTCCTGAGTTTTTCAGAACTTTCTTAGCTGTTCTT
GTTTTTTGTAATCCCGAGCAGCTGGGATTACAGATGCGTGCCACCATGCCCAGCTAATTTTTGTATTTTT
```

FIGURE 498 cont'd

```
AGTAGACACGGGGTTTCACCATGTTGGCCAGACTGGTCTTGAGGTCCTGACCTCGTGATCCACATGCCTC
AGCCTCCCAAAGTGCTGGGATTACAGGCATGAGCCACCGCGCCTGGCCGACCTGACTAGATATTAAAACA
GAAAACCTCTAATGAAAACAGTGTGGTATTAGCACATGAATACCACAGAATGAAGGAACAGAATAGAGAA
TCCAGAGCAGACCCAAATGCATATAGATATTTAGTATATGATAAAGGTTGCATCTCAAATCATTGGAGAC
AAGAAGGCTGACTCTCTTTTCGGACTCAGCCCACCTGCACCCAGGTGATTAAAAGCTTTTATTCTCACAC
AAAGCCTGTTTAGTAGTCTCTTCACACAGACATGCATGAAAGGTGGGAGGATCACTTGAGCCTGGGAGGT
GGAGGTTGCAGTGAGCTGAGATTGTGCCACTGCACGCCAGCCTGGGCAACAGAGACATCCTGTCTCAAAA
AAAAAAAAAAAACAGTAAAATTGATATGTATAGATTTGTGTAACCACCTCCATGAAGGGGTAGGTTGCCC
CTCCACACCTCTGGGTGTTTCTCGTTAGGTGGAATGAGAGACTTGGAAAAGAAAGAGACACAGAGACAAA
GTACAGACAAAGAATAAAGGGGGCCCAGGGAACTGGCGTTCAGCATACGGAGGCTCCACCGGCCTCTGGG
TTCCCTTAGTATTTATTGATCATTCTTGGGTGTTTCTCGGAGAGGGGATGTGGCAGCGTCATAGGATAA
TAGTGGAGAGAAGGTCGGCAGATAAACACTTGAACGAAGGTCTCTGCATCGTAGACAAGGTAAAGAATTA
AGTGCTGTGCTTTAGATATGTGTACATAAAAACATCTCAATGCCTTAAAGAACAGTATTGCTGCCCGCAT
GTCCCACCTCCAGCCCTAAGGCGGTTTTCCCCTATCTTAGTAGATGGAATATACAATCAGGTTTTACACG
AGACATTCCATTGCCCAGGGACGGGCAGGAGACAGATGCCTTCCTCTTGTCTCAACTGCAAAGAGGCGTT
CCTTCCTCTTTTACTAATCCTCCTCAGCACAGACCCTTTACGGGTGTCGGCTGGGGACGGTCAGGTCT
TTCCCTTCCCACGAGGCTGTATTTCAGACTATCACATGGGGAGAAACCTTGGACAATACCTGGCTTTCCT
AGGCAGAGGTCCCTGCGGCCTTCCGCAGTGTTTGTGTCCCTGGGTACTTGAGATTAGGGAGTGGTGATGA
TTCTTAGGGAGGATGCTGCCTTCAAGCATCTGTTTAACAAAGCACATCCTGCACAGCCCTTAATCCATTT
AACCCTGAGTTGACACAGCACGTGTTTCAGGGAGCACAGGGTTGGCGGTAAGGTTACAGATTACAGAACA
AAATGGAGTCTCCTATGTCTACTTCTTTCTACACAGACACAGTAACAATCTGATCTCTCTTTCTTTTCCC
CACACCTCCACAATCAAGATACAGTTTCATCACCCCAAAACTTCTCTCATGCTGTCCTTTTGTAGTATCC
CTCCCCACCAACCCCTGGAAACCAGTGACCTCGTCTCTGTTCCTTTAATCTTGTGTTTTCAAGAATGTCA
TACAAATGGAATCAGAAAGTACGTCACCTCCAGTCCTATGTACCCATTTGACTATGGAAAATTTCCACTC
GAATGTCCCACAGGTACCTTAGCTCAACCTCATTGCTCTCCTTCCAATATGCCCCTCCTCCTATGTCTAG
ATTCTAGTCAAACACTATGCCATCATCCAGCAGTCCAAGCTAGGAGTGTCATCCTGGGTTCCTCTTTTTT
CCTTTCACCCTTCTTTCTAATTATTCTTTTTTTTTTTTTTTTTTTTTTTTGAGACAGAGTTTCTCT
CTTGTTGCCCAGGCTGGAGTGTAATGGCACGATCTCGGCTCACCACAACCTCTGCCTCCCGAGTTCAAGT
GATTCTCCTGCCTCAGCCTCCAGAGTAGCTGGGATTACAGGCATTCACCACCATGCCCAGCTAATTTGT
ATTTTTAGTAGAGACGGGGTTTCTCCATGTTGGTCAGGTGGTTTTGAACTCCCGACCTCTGGTGATCTGC
CTGCCTCGGCCTCCCAAAGTGCTGGGATTACAGGCATGAGCCACTGCACCCGGCTCTAATTACTCTCTTA
ATCTCATTGCTTATATGTTCTTTATATCTCTCAAAACAATCTATTTCTAAATCCACAACCATTTTACAAG
TGATTCTGGCAACCACCTCTCAACTGGATTATTCCAACAGCTTTCTGGGTTTTTTGCTGAGTCTTATCC
TTTTGAGTCTCTATCTACATCACAGTAAGCATGATCATCCTAAACAAACACAAATCTTGTTAAGTCATTC
CCCCAATCCCCCACTCCCTGCCACTTAAAACCCTTCACGGGTTGTCCCTTGCCCTCAGGACAAATTGTAA
GCTCCTTAGGTGACATTCAAGACTTCCTATAATTCAAGCCTTCCTCTCCTATCTCAACCCAAAACTCCTG
TTCTCACCCTACATGTCTCCCACACATACTCCCACTTGGGTTGCTTTTTAAAGTCTGGAATGTCTTTCT
CCTCGCCTTTGTTTTTTTTTCTTTCTTTTTTTTTTTTCTTTTTTGAGTTGGAGTCTCACTCTGTCACC
CAGGCTGGAGTGCAGTGGCGCAATCTCAGCTCACTGCAACCTCTGCCTCCCGGGTTCAAGCAATTCTCCT
GCTTCAGCCTCCTGAGTAGCTGGGATTACAGGGGTGCACCAGCATGCCCAGCTAATTTTCTGAATTTTTA
GTAGAGATGGGGGTTTTACCATGTTGGCCAGGATGGTCTCGATCTCCTGACCTCGTGATCCGCTCACCTC
AGCCTCCCAAAATGCTGGTATTACAGGCATGAGCCACCACGCCTGGCTCTCCTCACCTTTCTTAGCTAAT
TAGTACTTGTCCTTCAGGTCTCACCTTGGCTCTAACCTCCTGGCTGGACCAATGCTCTACCTTTCTAATT
CCTGCAGGAAAACACTGGACTTTTCTCTTTTTCCTTAGTAGAGAAGTTTTCAAAGTGGGACTGCAGACCC
TTGCATGTCCCTGATCCCTTCAGAGGGTCCCTGAGGTCAAAACTATTTTTATAATAATACTAAGATGTTA
TTCAAATTTTTCACTCTTAATATTTGCACTGATAGTGCAAAAACAATGGTAAGTAAGACTACTGGCCCTT
GCCCCAAATCAATTTAGCTAATAATCATCAGATTAATGGAATCTTCTTGTTTTAATATTACACCAAAACT
CTACAAGTGGAAGTATCTTAAAGGTTAGTTGCAATATGGTGTCTGAAACGATATCAGTGAATTATTTCCA
TGCTATTACAGTAAAATCCCTTGGTCTATATTGCACTTTGCATGGATCTTTTACCCATTCATAGTTTTAT
AGCATCATGCAACAGGAATTTGGAAAATATTGGTGCAGTGAGTTATACAGCTTTCCAAATGTTGAAACAT
TTGTTTATAAAATACTGAAAATTTATAGTCATAGATATCCACATCATTCTAATCTGAAAGGCAATAAGCAT
TTGGGAAGCTGTCAAGCTCATGGTGGCAGATTAAATATACTTCCATATTACCACTACTTATATATGTGTG
GCTACATTTTTTTTGGTATACGTTAACCGAAACAAACTATCACAGCACATTGAATGCAAAAGCAGACATT
GGCCAGGCGCAGTGGCTCACGCCTGTAATCCCAGCACTTTGGGAGGCCGAGGCAGGAGGATTGCCTGAAG
TCAGGAGTTCAAGACCAGCCCGGCCAAGATGGCGAAACCCCGTCTCCACTAAAAATACAAAACACTAGCC
GGGCGCAGTGGCTCGCACCTGTAATCCCAGCTACGTGGGAGGCTGAGGCAGGAGAATCACTTGAACCTGA
GAGGCAGAGGTTGCAGCAAGCCAAGATCGTGCCATTGCACTCCAGCCTGGGGACAGAGTGAGACTCTGT
CTCAAAAAAAAAAAAGCAGAAAAAAAGCAGACATTAAGATCCAGTTGTTTTCCATCAAGCTGGACATT
AAAGAGATTTGCAAAATGCAAAACAATGCTACTCTTCTCTGACCATAATAGAATTAAAGTAGAAATCAA
TTAACAGAAAGATGTCTAGGAGATGCCCAAATATTTGGAAATTAATCACTCACTTCTAAATAATCCAGGA
GTCAAAGAAGAAGTATTAAGAAGAAATAGAAAATATTTTTCACTTAATGAAAATAAAATATAACAAAATG
```

FIGURE 498 cont'd

```
TATGTAAGCAATTAAGGCAGTTTTTAGGGGGTAAATTTATATTAGCAAACACATATGTCATGAAAGAAAA
TCTCAAATCTAACCCTCCACGTTAATATTGTAGAAAAAGAAAAGTAAATGAAATCCAAAGCACTGAAGGA
AAAAGAAAATAAAGAGCAGAAATCAATGAAATTAAAAACAGGAAAAATCAATGAAACCAAAAATTTTCCT
TATGAAAGGTCAATACAACTAATAAACCTCTAACCAGACGAACCAAGAAAAAAACAGAGAAGACAAAAAT
TACCTATATTAGGAATGATAGAAGAGATATCACTACAGTATCTATAAATTTTACAACTTACATGTAATAG
ATCAGTCCCTTGAAAGATACAAACTACCACAATTCACCAAAGATGAACAAGATAAAGAGGTCTTAGAACT
ATTAAAGAAATTAAATTTATAGTTAAATATCTTCCCCCGAAAATCTCTAGGCCCAGTTTTATTGGAGAAT
GTTATCAAGTATTATTGAAAGAAATAACATGAATTCTAAAAAATTCTCTTTCAGAAAATATAAGAGGAGA
AATACTTTCCAATTTGTTTTATGAGGCTAGCATTGCCTTGATACCAGAAGCCAAAGCACTACAATGAAA
GAACACTATAAATCAGTATCCCTCATATTAGCAAATTGAATCTAGCAATATAAAAAGGACAATTCATCAT
GGTCAAGTAGGGCTTATCCTGGGAATACAAGGTCTGTTCAAAATTTTCTTGACAAAAGTGAACATCTAGC
AGGGCGTGGTGGCACACACCTGTAATCCCAGCACTTTGGGAGGCTGAGGCAGGCAGATCACCTGAGGTCA
GGAGTTTGAGACCAGCCTAACTAACATTGTGAAACCCTGTCTCTATACTAAAAATGCAAAACTAGCCGGG
TGTGGTAGGAGGCACCTGTAATCCCAGCTACTCAGGAGGCTGAGGCAGGAGAATTGCTTGAACCTAGGAG
GCGAAGGCTGCAGTTAGCCAAGATGGCACCACTGTACTCCATCCTAGGTGACAGAGCAAGGGTTCATTTC
AAAAAAAAAAAAGTGAACATCCATTCAGGGTTTAAAAAAAAAAAAACCAACTCAGCAAACTAAGAAGAGAA
AGAAACTTCCTTAATCTGCTAAAAGGGCATTTTGAAAGACACTTAATGTTAGAAGTCTAAATGCTTTCCA
CCAAAGATTGAGAACAAAGAAAAGAATGTTTGCATTCACCACTCCTAGTCAATATTGTACTGAAAGTCCT
GGCCGATGTAATAAGTAGGAAAAGGAAACAAAAGTAATGTCGATTGAAAAGGAAGAAAAATAAAACTGTC
TTTATTCACTAATGACATAGTTGTCACAAAAAAAAACTCCAGGAAATCTACAGAAACTCCTAAAACTAATA
AATGATTTTTACAAGATCACAGAATAATGTGCAAAAGTCAATCATATTTTTAAGCATAAGGAAACAAAAA
TCAGAAATTTAAAAAATTTTAATAACATTTATAATATCATAAAATATGAAATACATAGGGATAACCTGAC
AAAAGATTTACAAGACCTATACACTGAAAACTAAAAAACATTGCTGGTAGAAGTTAAGGAATGGCTAAAT
AAATTGGGAGATTGCCGGGCGTTGGTGGCTCACGCCTGTAATCCCAGCACTTTGGGAGGCCGAGGCAGGC
GGATCACGAGGTCAGGAGATCGAGACCATCCTGGCAAACACGGTGAAACCCCGTCTCTACTAAAAATACA
AAAAATTAGCCAGGTGCGGTGGTGGGCGCCTGTAGTCCCAGCTACTCGGGAGGCTGAGGCAGGAGAATGG
CGTGAACCTGGGAGGCAGAGCTTGCAGTGAGCCGAGATAGCGCCACTGCACTCTGGCTTGGGTGAAAGAG
CGAGACTCCCTCTCAAAATATAAATTAAATAAATAAATAAATAAATAAATAGGGAGATATACCAGG
TTCATAGATTATAAGATTTAATGCTGGCCGGGTGCGGTGGCTCACGCCTGTAATCCCAGCACTTTGGGAG
GCTCAGGTTGGGGATCACGAGGTCAGGAGATCAAGAACATCCTAGCCAACAGGCCTAGCCAATATGGTG
AAACCCCGTCTCTATTAAAAATACAAAAATTAGCCGGGTGTGGTGGCGCACGCCTATAGTCTCAGCTACT
CGGGAGCCTGAGGCTGGAGAATCTCTTGAAACCGGGAGGCGGAGGTTGCAGTGAGCCGAGATTGTGCCAC
TGCACTCCAGCCTGACAACAGAGTGAGACTCCATCTTTAAAAAAAAAAAAAAGAAAAAAGAAAGAAAAT
TAGATCAACAGAACAGAATCAAGAGTCCACAGATAGATGTACACACATGCATAATCAACTGATTTTTGAC
AAAGCTGCAGGGCATTTCAGTGGGAAAAGATAATGTTTTCAATAAATGGTACTGGAGCGACTGGGTATTC
ACATGCAAAAAGATGAAACTTCGGCCAGGCACAGTGGTTCAGGCCTGGAATCCCAGCACTTTGGGAAGCC
GAGGCAGGTAGGTGGATCACCTGAGGTCAGGTGTTCGAGACCACCCTGGCCAACATGGTGAAACTCCATC
TCTACTAAAAATACAAAAATTAGCCGAGCGTGGTGGCAGGCACCTGTGATCCCAGCCACTCCAGAGGCTG
AAGGAGGAGAATCGCTTGAACCTTGGAGGCAGAGGTGCAGTGGGCTGAGATCGCACCACTGCACTCCAGC
CTGGGCGGCCGAATGAGACTCTGTCTCAAAAACAACAACAACAAACTCGAAATGGAACATAGATGTAAAT
GTGAAATATCGAGCTATCAAACTTCTTCTTCGCCCCCCAAAGTGCTGGGAATACAGATGTGAGCCACCAC
ACCCAGCCAATCGAACTATCAAACTTCTGAAGAAAACATTTAAAAAAACTTTGTGAGTTTTCACCAGGCT
AAGGTTTTTAAAAATACAACACCAACAGCATGATTCATAAAAGAAAAATTGATAAATTGGACTTAGAAT
CCACAGTGGTACATGCCACCATGTCAGGCTAATTTTTGTATTTTTAACAGAGACGGGTTTCACCATGTTG
GCCAGGCTGGTCTCAAACTTCAGACCTCAAGTGATCCACCTGCCTCAGCCTCCCAAAGTACTAGGATTAC
AGATGTGAGCCATTACACCCGGCCTTTTTTTCAAATTTCTAAGAAAAGAGATTTTTTTTTTTGAGATGG
GAGTCTTGCTCTGTCTCCAGGCTGGAGTGCAATGGTGCCATCTTGGCTCACTGTAACCTCCGCCTCCCAG
GTTCCAGCAATTCTTCTGCCTCAGCCTCCCGAGTAGCTGGGATTACAGGCACACGCCACCACGCCCAGCT
AATTTTTGTATTTTTAGTAGAGACTGAGTTTTACCATGCTGGCCAGACTGGTCTCGAACTCCCGACTG
CAGGTGATCCACTCGCCTCGGCCTCCTAAAATGCTGGGATTACAGGCGTGAGCCACTGCACCCGGCCCAA
ATCACTGTATTTTGGAAAAGATAAGTTCAAAAATTAGCCGGGCGTGGTGGCAGACACCTGTAATCCTAGC
TACTTGGGAGGCTGAGGCAGGAGAATCACTGGAACCCAGGAGGCAGAGGTTGCAGTGAGCCAAGATTGTG
CTATTGCCCTCCAGCCTGGGTGACAGAGGGAGACTGGGTCTCAAAAAAAAAAAAAAAAAGAAAAAGAAA
AGAAAGTTCATTGATCCTAGCCCTTGCCTCTGCCCGTGTGTAGGAAAATATCGAAGAGGATTAATGATT
ATGTGTCACACCCAAACCTTGATGGGATTTGCTCTCATGTAACTTCTGAGAACATGAGCTGCAGCCACC
TGTATAAAACCGCAGGCTGAAACCCTCCGGAGCAGTCCAACGGTTACTTTGAAAGACTCTCCCAGGTTG
TGATCCTCAGTAAGACTTCTGAATCAAACTAACTTTAATTCTAAAAGTAGGTTTTCTCTTTCCTTTT
TTTTTTTTTTTTTTTTTGAGACAGGGTCTCTCACTCTGTCGCCCATGCTGGAGTGCAGTGGCACAAT
CTTGGCTCACTGGCAGCCTTGACCTCCTAGGCTCAAGTGATTCTCCCCCCTGAGCCTCCTGAGTGGCTGG
AACTACGGGCGCACGACCATGCTGGGTTAATTTTTATAAACATTTTTTGGTCTCACTATGTTGCCCAGGG
TGGTCTTGAGCTTCTGGGCTCAAGCAACCCTCCTGCCTGCACCTCCCAAAGTGCTGAGATGATTATAGGA
```

FIGURE 498 cont'd

```
GCAGGAATGAGCACTTGGCCTGATTTTTGTCTTAGTTGACAATAGTCAGTGTTCAGGAAATGGTTATTTA
TGATTATTATCCATAAAAATTCCAAAGGGATACACTGATTTGTCATTACCAAAGGGGCCAGAGAGAACCT
GGCAATTATTTGGGCTTAGGGGAATAAAGGCAAAGCTCTCAGATGAGTTTCAGTCTGAAGCCTGGAAACA
GGGAGGATGGGAGGCCAGGGGCAAGATGATGGATTCCATTTTAAGTAATAGATTCTAAGTCTCAAGTAAA
AATCAAGGTTGCCTTTTGGGTGTAAGGTAGAAACCTGGGATACAGAATTAAGAATTGCCCATGTTAGGCA
CGGTGGCTCACGCCTATAATCCCATCACTTTTCGAGGCTTGGGAGGGTAGATCACTTGAGGTTAGGCATT
TGAGACTAGCCTGGCCAGCATGGCGAAACTCCGTCTCTACTAAAAATACAAAAAATTACCCAGGTGTGGT
GGCCCACGCCTGTAGTCCCAGCTGCTCCAGAGGCTGAGGCATGAGAATCACTTGAACCTGGGAGGCAGAG
TTGCAGTGAGCCGAGACTGTGCCACTGCACTCCAGCCTGGGCGCCAGAGCAAGGCTCTGTCTCAAAAAAA
AAAAAAAAACTTACAGAATTAAGAGTTGCTCATGCAGAGGAAAACAAAAAGATTTATTGTCATTGTCGTT
TTCCTTTTTTTGTGGAAACACAGACACTAGGACTTTAAGAAAGGCAGGAGCCAGATCTAATGAATCTCT
GGGTTCTCCCAGCAGAGTGATCCTCCCTACTCAGTGATCTCCACTGAGCAGGAGCCACCAATTCTCTTTG
TAACTTAATGGAAGTGGCTTTCCCCTGTCTGCACCTCAGTTTCATTTGTAAAATGAGGAAAAGCAAACCT
ACCTCTGAGGGCTGTTATGAGATCATGGTTTGGAATTTTCCTGGCCAAAAGTGAATGCGCAAGTGGTGTC
TCGTGTGACAACCCATGATCCATCCACCAAATAGAAAACAATGTCCAAACACACAAAATATCAAGAGTAT
ACATACAAATGGTGGGAGTGTAAATTAATACAGTCTGACAGTGTCTACTAAAGCTAAACACATACCTGCC
CTACGACCAGCAATTCCACACTTGGGTCTATTTTGTTTTTGTTTTTGTTTTTCTTTGGGAGGGGGATCTA
TTTTCAGAAGAAATGAATACGTAAGTTTGTCCAAAGAAATGTACTAGAATATTCATAGTGAGAGACAGGA
CTAGCTGGATTTCCTAGGCCGACTAAGAATCCCTAAGCCAACTGGGAAGGTGACCGCATCCACCTTTAAA
CAAGGGGCTTGCCACTTAGGTCACACCCAACCAATCAGGTAGTAAAGAGAGCTCACTAAAATGCGAATTA
GGCAAAAACAGAAGGTAAAGAAATAGCCAATCATCTAACGCCTGAGAGCACAGAGAGAGGGACAATGATC
GGCGGGATATAACCCAGCACTGGAGCCGCAAGGCAATCCCCTTTGGGTCTCCTCCCATTTTATGGGAGC
TCTGTTTTCACTCTATTAAACCTTGCAACTGTACACTCTTCTGGTCTGTGTTTGTTATGGCTTGAGCTGA
GCTTTCGCTCACTGTCCACCGCTGCTGTCTGCTGCCATGGCAGCTGTGGCAGACCTGCCGCTGACTTCCA
CCCCTCCGGATCCGGGTGTCCACTGCACTTCTGATCCAGCGAGGCGGCACCCATTGCCGCTCCCAATTGG
GCTAGAGGCTCACCATTGTTCTTGCGCGGGCTAAGTGCCCGGGGTTCCTCCTAATCGAGCTGAATAGAGC
TATAACACTCACCGCATGGCCCAAGATTCCATTCCTTGGAATCCGTGAGGCCAAGAACCCCAGGTCAGAG
AACAAGAGACTTACTGCCATCTTGGAAGCGGCCCACCACCATCTTGGGAGCTCTAAGAACAAGGACCCCC
AGTAACAATAGCACTATAACACCCCTAAACTGGAAAATATCCAGTCTGAGGTATAGGGCATAGTCATAAA
ATGGAAACCATCCAGAATGAAAATGAAAGAACTATTTCTACACACGGTATGCATGAATCTCACAAAAACA
ACATTAACTAAAAGAAACCAAACACAGTACACAGAGTACTGGTCTAGAGAGAAGGAGAATTCAAAACAAA
CAAAAGTAACCCAGCTGTTACAAGTCAGGGCGAGTCCAGCCAGGCACAGTGGCTCATGTCTGTAATCCCA
GCACTTTGGAAGGCTGAAGTGGGAGGATCATCTGAGTCCAGGAGTTCGTGACCAGCCTGGGCAACACAGC
GAAACCCTATCTCTACAAAAAACATTTTAAAATTAGCAAGGCGTGGTGGCACACGCCTGTAGTTCCAGGT
GCTTGGGAAGCTGAGGTATAGGATTGCTTGAGTCTGGGAGGTTGAACCTGGAGTGAGTAGTGATCTCACC
ACTGCACTCCAGCCTGGGCAACAGAGCAAGAATCTCTTTCAAAAGATATATTTTTAAAGGCTACATGGGG
TGGGTCATGCCTGTAATCCCAGTGCTTTCAGAGGCTGAGGAGAGAGGATAGCTTGAGGCCAGCAGTTGGA
GACTCTAGTGAGCTATGATCGTGCCACTGCACTCCAGCCTGGGCGACAGAGACTCTAGCTCTTAAAAAAA
AAAGAAAAAAACAGATGAATGATAACCTTTAGAAGGGATCGGGAGGCCGGATGTGGTGGCTCACGCCTAT
AATCCCAGCACTTTGGGAGGCCAAGGCAGGCAGATCACTTGAGGTCAGGAGTTTGTGACCGGCCTGGCCA
ACATGGTGAAACCCTGTCTCTACTAAAAATACAAATATTAGCCTGGGCAACAGAGTGAGACTCCGTCTCG
GGGCGGGGAGTGGAGGGGGAGAAGAAGGGATGGGGAAAGGGGAGCACATGAGGCTTCTACTGTTTGGT
TTTGCGATCTGGATTCAGGTTGTATGGGCATGTTCACTTTGTGTAATTTTGTCGAGCTGTAATGATTTGT
GCTCTTCTCTTTATTTAACTTCAATAAAAGGTTTACTTAACAAAAATTGTAGCTGGTGTGAAGGGTAGCA
GTGTTTCCTGGGGCCAAGAGTACAGGCTTTGGGGACAGACAGACCTGGGTCCCAATCTATGCTTTGTCC
CTTCGGCACATTGTTGACTGTGGCTGGTGGCTTCGTGGCTCTGAGCTTGTCTCCTTCTCTATAAATGAGG
AAACATAATACTTGCGACGATGATGCCTGTAAAGCTTAAGCGCAGGACCTGGCATAGATCTGTAAGGCGG
AAACCTGGGATACAGAACTAAGGTCTATGGATCTCCTGTGCTACCCAACTTCTGGGCACTCGCTGCCTCC
TTTTCCCCAGCCCAGACGCGTGGGTTCTACTCGATTGGTTGCTCACTGCGGGCTCGGGGCTCCTCAATCC
CGGGGTAAAGCCCAGTATGAAATGTCACCTTCAGGGGCAGCTCGGATCTTCCCACGCCCGCGCGGCGCAC
AATCTTTGGATCAGCGCCACGTGGAGACCTTACCCGCCCGTACGATCAATCCCTTCTGTGGAACCCAGCT
CAAGGACCCTCCAGCCCAGACACTAGAAAGCGAAGAGCAGTTGGCCGCCAGACTGTCCGTGCCAGAGCTC
TGCGAACTTACTCCGTTGAAAGAGCAACGGGCTGCGCCACCTCCCGGAGAGAACCCCAGCCCTCCACG
GCAGGGCGAGATGGCGCCACCGCGTGATACTGCGCACGCCCACAGCTCCCGTCCGCCCTCGCGCCTGCG
GGTACGGACAGCGCATGAGCTTATGTTGAGGGCGGAGCCCAGACCAGCCCTTCGTCCTATCCTGCCCTTC
CAGCACCTCTCAGCCGTAACTTAAACTACACTTCCCAGAAGCCTCCTCAGCCAGGGACTTCCGTTGTCGT
CAGCGGAAGCGGTGACAGATCATCCCAGGCCACACAGAGGCCGGCTTGGTCACTATGGAGGAGATAGGCA
TCTTGGTGGAGAAGGCTCAGGTACAGTGGGACTTGGCTTTTTAGTCCGGGCCGGGCTCGCGGGGAGAG
GGTGAAGCCAGACCTGAGTGGGGGGAGGAATGGCTTCCAGGACCCCGGCCCAGGTTGGGGTTATTTTAGA
GGCCTCGGTGGAGAGCTTTGTGCCATTCGAAGGCCTGTCTGGGTGGCCGAGTGATGGTAGGAGGTAAGGC
TCAGAAAGCGGGGCTGGGGGAGTGAGTGACGTTAGTGGGTCTTTGAGACGGATTGATTTCGAACCCTGGC
```

FIGURE 498 cont'd

```
CGGTAGTGCTTAGTGAGGTCGGTGGCCCGGCGTTGGGATTGGGTCAGGCGGTGAGTGATATATGGGATCC
CGCCGTGCGGCCGAGTGATCCCCGGGTCTGGGCTGCGGGGCTGACTGATGTTCAGGGCTTTGCTGATGGG
GGTAATGGGGCGGGTAGTTAAGTATTATCTGTGGCTTGCCTGAGTGATATTTAGGTCTAAGGTGAGTTAG
GAGACTGTGACATAAGGGATCTTTGAGGGGAAACTGGGGAATGTTGGGACTCGTTGAAGGCGCAGTCACT
TTAACAGCCTATCTAGGAGAGCCATGTGACATTAGGAACCTCTTGAAGGGGATTGGGTGGCATTTGGGTC
TGATAAGGAGTTGATGTGACGTTTAGATCCTAGTTGGGGGTTGTGTGACACTGGGGACATGTTATGAGTG
GTATATGATAACATAAGATCTGTTTGAGGGGCAAGTTGACATAAAGAGCTTGTTTAGGTGGCCAAAAGGT
TTCCAGGATCTATTTAGAGGGTCTTAAGATATCAGGGGTCTGTTAGGGGCTAAGTGACATCAGGGTGAAG
TGGGGAGGGGAACAAACATTAGTGAAGTTGGGAAGCTTTCATGAGAGGACTGTCTTCTTCCAATGTGAGT
TATCCCCTTTCGTCTAGGATGAGATCCCAGCACTGTCCGTGTCCCGGCCCCAGACCGGCCTGTCCTTCCT
GGGCCCTGAGCCTGAGGACCTGGAGGACCTGTACAGCCGCTACAAGGTACATTCGACCCCCAACCCAGAC
CTTGCACAGGACCTGACATCTCATACTCTTCCCCACTTTCCACCACTCTCTGGATCAGCAAGTCTGGAGC
CATCCCCTTCTGTCCCTCTCTGCTCGCAGAAGCTGCAGCAAGAGCTGGAGTTCCTGGAGGTGCAGGAGG
AATACATCAAAGATGAGCAAAAGAACCTGAAAAAGGAATTTCTCCATGCCCAGGAGGAGGTGAAGCGAAT
CCAAAGCATCCCGCTGGTCATCGGACAATTTCTGGAGGCTGTGGATCAGAATACAGCCATCGTGGGCTCT
ACCACAGGTGTGCTAAGGACACCTCATTCATTCATCTGTCCACTTAACAACTATTTCCTACCATGTGCTA
GGCAGCAGCAAACAAGGCAGGGCAGTGCAGTGCAATGTTCTTCAGAGTATTTTGACTGATCGAAAGGTAG
AAATACATACATATATATATATACACATATATATATGTATATCTATGTTTTTTTGTTTGTTTGTTTT
TTGTTTTGAGACAGAGTTTTGCTCTTGTCCAGGCTGGAGTGCAATGGCATGATCTCGGCTCACTGCAACC
TCCACCTCCCAGGTTCACACGATTCTCCTGTCTCAGCCTCCCAAGTAGCTGGGATTACAGGCATGGACCA
CCAAGTCTGGCTAATTTTTGTATTATTAGTAGAGACAGGGTTTCACCATGTTGGCCAGTCTGGTCTTGAA
CTCCTGACCTCAGGCGATCCACCCGCCTCACCCTCCGAAAGTGTTGGGATTACAGGCCTGAGCCCCACTG
CACCTGGCCAGAAATGTATTTTACATTGTGATTATCTGTATCTGTCTCTTACTTTTTAGATAGATGTGTA
AAACATAAGTTTCACCATGAAATATTTAGCCTTACTAGGTGTGGTATATGCTGATGTTTTCTATCCTATT
CTAGTCTGTTTTGCTTTAAACACAGTTCTGGTCATGACCTTCCAAATTGATTTCACAACTACTACTGGTT
TGGGGCCTGCAGTTTGAAACGATGAGTAGGAGTGTTAAGAGATTGGGCTCTGAGGCCAGGCATGGTGCCT
CACACGTATAATCCCAGTACTTTGGGAGACTCAGGTGGGCAGATCACTTGAGGCCAGAAGTTTGAGACCA
GGCTGGGCAACATGGCAAAACCCCGTCTCTACTGAAAATATAAAAATTAGCTGGGTGTGGTGGCACACAC
TTGCCATCCCAGCTACGCAGGTGGTTGAGGCACAGGATCTGTTGAACCCAGGAGGTGGAGGTTGCAGTGA
GCCGAGATCGTGACACTGTACTACAGCCTGGGTGACAGAGCAACACTCTGTCTAAAAAAAAAAAAAAAAA
AAAAAATACTGGGCCCTGATAGGGACTCAGAGTCCTTATCAGAGTATATTGTAGCTGCTGCTGTTTATAT
AGGTCTAGGCCTTGCCCTCTTGATAGTCATTGTCACTGGCATCTTATCTGTTTTTTCTTGTTTCTGGGCT
CTGCTCCTCTGGACCAAGCCATGTTCTTGTAAAGGTTTTGGAGAAAGGTGTGCGATTGTGCCTGGAATTG
GACTGGTGGGCTATGAGGAAGTGAGGAGAGGGTGGTATCCAGGATGAGGCCTTTCTCTTTGACCTGTGGG
AGTTGGGATAGTGTGGCTTTCCCTGAGATGGCACCATGGGTAGAGGAGTAGGTTTGTGGGAAGACAGGGA
GGGCAGTCCAGAGCACATGGGAGGTGTCCAGGAGGCTGCTGGTCAGCCAGGTCTGACAATCAGGAGAGAG
ACTGAGCCTGGAAACAGAAGTGTGCCTCACTAGTATGAGATGCAGGGGGAGGCCTGCTGGACAGCCAGGG
CTGGATGTCAAGAGAGAATCAGGGCGGTAGACAAGGAGTTCGTGTGAATACTGGGACGGACAGCAGGAG
GGAAGGCTGGAGGCCGAGAGGGGACCCCTCAGGGTCTGAACCAGAGATGTTGGGGTGTGGAGATTAGGAG
GGAGGAAGGGGGAAGGGGCAGTTTCCAGGCTGACACTTCTCGTTTTCCTCTCTCCCTTCTCGCAGGCTCC
AACTATTATGTGCGCATCCTGAGCACCATCGATCGGGAGCTGCTCAAGCCCAACGCCTCAGTGGCCCTCC
ACAAGCACAGCAATGCACTGGTGGACGTGCTGCCCCCGAAGCCGACAGCAGCATCATGATGCTCACCTC
AGGTAAAGGGGGAGCCTGCAGCTGGGAGGGCCCCATGGGGACCTTGAGGACCTGGCCAGGAGCCCCAGCT
CTGCTCTCCCACCAGACCAGAAGCCAGATGTGATGTACGCGGACATCGGAGGCATGGACATCCAGAAGCA
GGAGGTGCGGGAGGCCGTGGAGCTCCCGCTCACGCATTTCGAGCTCTACAAGCAGGTGAGGCGGTGCAGG
TGGCAGGGAAGGGAGAGGCCCCATTGGGTCTGGGGTTGGAGGTGGAACCCCTGACTCCCACTTCTCTTCC
TTCCTCTGGGTTTCAGATCGGCATCGATCCCCCCGAGGCGTCCTCATGTATGGCCCACCTGGCTGTGGG
AAGACCATGTTGGCAAAGGCGGTGGCACATCACACAACAGGTGAGCCCTTTCGCCCCTGCCCCGAGCTCT
CATCTTCTGGCCTCTTCGCCTTGCTCCCTGCTCGCTCACTGGCACTGCACAGTAATTAGAAACAGACTCT
GGGGTCATAGCCCACGTGTGCATGTTACTGGCTGTGCTGACTTCACCTCCTTGGGCCTCTCCTAGTAGTT
GAAGACTCATTTCACCCGGTGATAGTGAGCAGTTAATGAAATAATGCAGTGTTTTCCTACAATGGGTTGT
GACCTATTAGTAATTATGAATTTCAATTTGTGGGTTGCAGCCAGTATTTTGAAACATGAAATAGAACAGA
AAGCGCCAGAGAACATCCACATGGTATTTATACCATGGTACAAGTATATATGGTGCAAGTTCATCTGTTT
CGTGAAACTTGTTTCATACAGATGTGCACACTCATGTATACTTGTGGTTCTTCAAAAATATATATATATA
TTTTAATTCTTAAATTTTTTTGTAGAGATAGGGTCTCACTCTGTTGCCCAGGCTGGTCTTGAACTCCTGG
GCTCAAGGGATCCTCCCACAGTGCTGGGATTACAGGCGTGAGCCATGTGCCTGGCCCAAAAATGTATTT
CTTATTGTAGGTGCCAGACAAAAATGTCTGAAAGTCACTCACTCTATAACTTTTTTTTTTTAAAGCCCT
AAAATCTTAAGCATATGTTCAGATCTTAACACATGTGAGCCAGGGAGCAGTAGGAGGTAGTAGTTAAGCA
GTATGTTTTCTGGGGCTAGACTGCCTGGCTTTGAAATCTTACTCCCCAGCAACTTCTTATGTGATCCTG
GGTAAATTAACCTCTCTGTGACTCAGTTTCCTCACCTGTCAGATGGAAACAATCATAGTACCTATTTTTC
TAGGGTGGGTGTTCAGAAGAGCAAATTGATACAAAGCATCTGGAATGGGCAATAAATGTTAGCTGTTGTC
```

FIGURE 498 cont'd

ATTGTTACTCATTTGCTTGGTACTTTATTGAACTTTTACTCTGTACCAAGCCTTGTGCTGGAATGCAAAG
ATGACAATCAGAGATGTCCCTTGCCTTGACTGGGAAAAAGAAAAAGACACCTAGAACTCAGTCATTCAG
TGACTGTTTATTGAACACCCACTATGTGCCAGGATGTGTTGTAGATGCTAGAGACATGGGCCAGGCGCGG
TGGCTCACGCCTGTAATCCCAGCACTTTGGGAGGCCGAGGTGGGAGGATCACGAGATCAGGAGATCGAGA
CCACAGTGAAACCCCGTCTCTATTAAAAATACAAAAAAATTAGCCAGGTGTGGTGGCGGTCGCCTGTAGT
CCCAGCTACTTGGGAGGCTGAGGCAGGAGAATGGTGTGAACCCAGGAGGCGGAGCTTGCAGTGAGCCCAG
ATCACGCCACTGTACTCCAGCCTGGGCGACAAAGCAAGACTCCATCTCCAAAAAAAATATATATATATAT
ATATATATATATTAATTAGCTGGGCGTGGTGGCCAGCGCCTGTAGTCCCAGCTACTCAGCGTGAACCCGG
GAGGCGGAGCTTGCAGTGAGCCGAGATGGCGCCACTGCACTTCAGCCTGGGTGACAGAGTGAGACTCCGT
CTCAAAAAAAAAAAAAAAAAAAAAGAATAGAGACGTGGCAGTAAACAGAACACCTCCTTATGGAGGTGA
TGTCTTAGTTGGAAATGTGGCCCGACACAGATTCGTAAAGTTTCTTTTTTTTTTTTTGAGATGGAGTCT
TGCTCTGTCATCCAGGCTGGAGTGCAGTGGTGCGATCTCGGCTTACTGCACGCTCTGCCTCCCAGGTTCA
CACCATTCTCCTGCCTCAGCCTCCTGAGTAGCTGAGACTACAGGCACCCGCCACCACGCCCGGCTAATTT
TTTGTATTTTTTAGTAGAGACGGGGTTTCACCGTGTTAGCCAGGATGGTCTAGATCTCCTGACCTCATGA
TCCGCCCGCCTGGGCCTTCCAAAGTGCTGTGATTACAGGCGTGAGCCACCGCACCCAGCCCGTAAACCTT
CTTAAAACATGAGATTTTTTGTGTGTGATTTTTTTTTTTTTTTTTTTGAGACAGAGTCTCACTCTGTA
GCCCAGGCTGGAGTGCAGTGGTGCTATCTTGGTTCACTGCAACCTCTGCCTTCTGGGTTCAAGCGATTCT
CCTACCTCAGCCTCCCGAGTGGCTGGAATTACAGGTACATGCCACCACATCTGGCTAATTTTTTTTGTAC
TTTTGGTAGAAATGGGGTTGCACCATGTTGGCCAGGCAGGTCTCGAACTCCTGGCCTCAGGTGATCCACC
CACCTTGGCCTCCCAAAATTCTGGGATTACAGGCGTGAGCCACTGCACCCGGCTGTGATTTTTTTTTTA
AGCTCATCACCTATCATTAGTGTTAGTGTATTTTATGTGTGGCCCAAGACAGATCTTCCAGTGTGGCCCT
GTGTACCCTTCACCCAGATTCCCTAATGTTACTATCTTATGTAACCATAGTATAATTAGGAAAACCAGGA
AATTAACAGTGGTACAATACAATGAACTAAAGTTTAGACCTCCTTCAAAGTTTACCAGCTTTTCCCACTA
GAGACCCTCACTTCAGGTTCTGTCGTTTTTCTGAGTGAATTGGGGTGGTTTGTCACTGGCAGAGGGAGGG
AAGAGAGAAGGTGTAGAAGGGATGTAGAAATGGGAAAAGCTGCTGACTGGGGTTGAGTTTTGTTTTGTTT
TCTAGAGACAGGGTCATGTCTGGCAAGGCGCGGTGGCTCACGGCTATAATCTCAGCACTTCAGGAGGCCG
AGGTGGGCAGATCACGAGGTCAGGAGTTCGAGACCAGCCTGGCAAACATAGTGAAACCCCATCTCTACTA
AAAATACAAAAAAATTAGCCAGGCATGGTGGTGGGCGCCTGTAATCCCAGCTACTCGGGAGGCTGAGGCA
GGAGAATTGCTTGAACCCAGGAGGCCAAGGTTGCAGTGAGCGAAGATCGCACCATTGCACTCCAGCCCGG
CCAATAGTGCGAGATTCTGTTTCCAAAAAAAAAAAGAGAGATAGGGTCTTGTTCTGTCACCCAGGCTGGA
GTGCAGTGGTGTGATCATAGCCCACTGCAACCTTAATCTCCTGGGCTCAAGCAATCCTCCCCACCTGTCT
CTCCTAAGTAGGTGGGACTACAGGCGTGTGCCACCATGCCCAACTAATTTTTGTATCTTCATTTTCAGTA
GAGACAGGGTCTTGCTATGTTGCCCAGGCTGGTCTTGAACTCCTGGGCTCAAGCCATCCTCCTGCCTCAG
CTCCCCAAAGTGTTGGGATCACAGGTGTGAGCCTTTTTTTCCTCTTGTTTTCGGGGGGAATTCATCTAT
TTGTTCCGGTGACAGCACAGCTTACTAAGAGTGAGTAACTGAAGCAGGAGCCCATTCCAGGATAGGTGGA
AGGAGTAGTAGAGCCCAGGGGGAGCTGAGAGATTGGGAGGACAGGGAAGGTTGGGGTAGGAAGGGGACTG
TAGTGATTGAGTAGGAAAGGCTGACGGACAGGCTCGGTCAGATAAGCAATTCCAGGGATGGGGGTTTCA
TGTGGAACTGGTTGGACATTTGCAGAACAGCCAAGTAAATGGCCAAAGTCAGGTGGTCAAGGTGTGTTTT
CTGTTTAGAGCAGAAAAAGTCAGAAATCTTGAGGTTAGGATGCTGAATGAGCCCCCAGCTGATGCAAGTA
TCAAGAAGAGGGACCCCTTGAGCCAGGTGTAAAGTCTGGATCTTAGGGAGTGAACAGGGCAGGGCTGAA
GCCTTGAACAGTTCCTAGCTTATGACATAAAACCACTCAGTCTATCTATGGACTGCATGTCTCCCTTCTC
TGGTGGCTGGAAGGAGAGTCCTGGGGGTATGCTTCATACAACACAAAGCATCTGATCCTTAAGAAACAAG
TGTAACTTTAAGAAACAAGGCCAGGTCAAGCATGGGGTGGCTCATGTCTATAATCCCAGCACTTTGGAA
GGCTAAGCCAGGAGGATCGCTTGAGGCCAGGAGTTTGAGACCAGCCTGAGCAATATAGCAAGACCCCATC
TCCTCAAAAATTTTAAAAAGCTAGGTGTGGGGACATGCCTATAGTCCTAGCTACTCGGGAGGCTGAAGAG
GGAGGATTGCTTGAGCCCAGGAGATTGAGGCTGCAGTAAGCTATGATGATACCACTGTACTCCAAGTCCA
AAGGGAGGGCCCAGAACAAATCTGTCTTCAACCCCATTGCCAATTGTCAGTTATATCAGAACATGCCCGT
GGTCCCTGATCTTTTTCAGGAAATTAAAAAGCTGGTCCTTATAGCAAACAGGAACTCAGAGCTCTTGGCG
AGGCAGTATGATGTCTTAGTGTATGGGCAGCATGCCTGTTTCTTGCTGATTTTGCAAGTGCTCCAGAAA
TGTAGACTGGTTTTTTTCTTTCTTATTTTAGTATTTCATATCCTGATTTTTAAATGTTGGGCCAAAAAAA
TGACACATCTGGCTGGACATGGTGGCTCATGCCTGTAATCCCAGAACTTTGGGAGGCTAAGGCGGGCAGA
TCACTTGAGGTCAAGAGTTCAAGACCAGCTTGGCCAACATGGTGAAACCTCGTCTCTACTAAAAATACAA
AAATTAGCTTGGCATGGCAGTGCACGCCTGTAATTCCAGCTACTCGGGAGGCTGAAGCAGGAGAATCACT
TGAACCCTGAAGGCAGAAGTTGTGGTGAGCCGAGATTGTGCTACTGCACTCCAGCCTGGGCACAGAGCA
AGACTCTGTCTCCAAAAAAAAAAAAAAAAGTGACACATTTGTAAGGATGATTCATGATTTAGGCCACTGGG
TCACTGTGGGGTACAAGTAGATGGCTATTCCTCAGGGCTGGATGTGGGCTCACCCTTGGGCATGAGGGA
ATGACACAACTACTAGGTATGGGTATCCAAGGAAAAGGATGTCTTCAAGGAATTCGCAGTTTCTGTTAAA
GCAGAATGGGCCCCTCAGGAGGCTCATTCCCGCCTAACTGTTGTCATCCTGTCATCAGCTGCATTCATCC
GGGTCGTGGGCTCGGAGTTTGTACAGAAGTATCTGGGTGAGGGCCCCGCATGGTCCGGGATGTGTTCCG
CCTGGCCAAGGAGAATGCACCTGCCATCATCTTCATAGACGAGATTGATGCCATCGCCACCAAGAGATTC
GATGCTCAGACAGGGGGTAAGTGATGCTGAAACAAGGCCCGGGGTCTTGGACAGGCTTGTCGCATGGGAT

FIGURE 498 cont'd

```
GCCTGGGACTGACTGTGCTGTGCACTCTCAGCCGACAGGGAGGTTCAGAGGATCCTGCTGGAGCTGCTGA
ATCAGATGGATGGATTTGATCAGAATGTCAATGTCAAGGTTTGGGGTTTGGGATGGACAAGGGGAGGTGT
GGTGTAGGAACTGGGGAAAGTTGGGGGCTGGCACCTAAGGGGTGGTTATCGTGACAGGAAGGAGGTAGGA
GTGCAGAGATCTGAGCTGGCCTGCCCCCCAATGTCAGGTAATCATGGCCACAAACAGAGCAGACACCCTG
GATCCGGCCCTGCTACGGCCAGGACGGCTGGACCGTAAAATTGAATTTCCACTTCCTGACCGCCGCCAGA
AGAGATTGATTTTCTCCACTATCACTAGCAAGATGAACCTCTCTGAGGAGGTTGACTTGGAAGACTGTAT
CCTGCTCCAGAAGTCAGGGAGGGGCCCTAGTTGGGAACGGGGATTAGATCTTCAGCTCAACTTCTGCCAG
CACCACAGCCCAGACTGTGCAGGTGGGACCAAGGTCCAGGGAGGAGGGAGGTGACAGAGATGGCCAAAG
ATGACTTCCAGCCCCAGGCATTTACCCCATCACACAGGGAATAGTTTCCTTAACTCGCTGCAGATGTGGC
CCGGCCAGATAAGATTTCAGGAGCTGATATTAACTCCATCTGTCAGGAGGTAAGTGGTGGTTTCTCTCTG
GATCCAGGCAGCGGGTGTGTGAGGACCCTTCTTCTCTGAACCACTCTGCTGCAGTCCTGTCCCCTCATGG
CTGCCCTGGGTCGTGGGCGCCATCTCTCTTCCTCTACCATCACTAGGGGTGGATAGTACAGGGGTAGT
GTTTTTGTGTTTTGCTTTGAGACAGGGACTCACTCTGTCGCCCAGGCTGGAGTGCAGTGGGGCAATCATG
ACTCACTGCAGTGATCCTCCCACCTCAGCCTCCCAAGTAGCTGGGATTACAGGCGCCCACCACCAGTCTG
GCTAATTTTTGTATTTTTTGTAGAGACAGGGTTTCACCATGTTGCCCAGGCTGGTCTCGAACTCTTGGGC
TCAAGTGATCTGTATACCTCAGCCTCCCAAAGTGTCGGGATTACAGGTGTGAGCCACTGTGCCCTGCCAC
AGGAAGTAGATTTTAACTCTCATCCTTCAACAGAGTGGAATGTTGGCTGTCCGTGAAAACCGCTACATTG
TCCTGGCCAAGGACTTCGAGAAAGCATACAAGACTGTCATCAAGAAGGACGAGCAGGAGCATGAGTTTTA
CAAGTGACCCTTCCCTTCCCTCCACCACACCACTCAGGGCTGGGGCTTCTCTCGCACCCCCAGCACCTC
TGTCCCAAAACCTCATTCCCTTTTTTCTTTACCCAGGATTGGTTTCTTCAATAAATAGATAAGATCGAAT
CCATTTAATTTCTTCTTAGAAGTTTAACTCCTTTGGAGAATGTGGGCCTTGAATAGGATCCTCTGGGTCC
CTCTTAATCTGACAGATGAGCAGACGAGGTGCATGGCCTGGGTTGCAGCTTGAGAGAACCAAAATATTCA
AACCAGATGACTTCCAAAATGTGGGGAAAGGGATGGAAAATGAACCTGAGATGGAGTCCTTAATCACGGG
ATAAAGCCCTGTGCATCTCCCTCATTTCCTACAGGTAAAAGACAGTAAAGAAATTCAGGTCACAGGCCTT
GGGAGTTCATAGGAAGGAGATGTCCAGTGCTGTCCAGTAGAACTTTGCACAATGATGGATATGTTCTGTG
TTCTCCAGTATGGTAGCTGCTCGCCACATGTGGCTAATAAGTACCTGAAATATGGCTAGCATGACTGAGA
AACTGAACTTTTTTTTTTTTTTTTTTTTTTTTTTTGAGATGGAGTCTTGCTCTGTCACCCAGGCTG
GAGTGCAGTGGTGAGATCTTGGCTCACTGCAGCCTCTGCCTCCCAGGTTCAAGTGATTCTCCTGCCTCAG
CCTCCCGAGTAGCTGGGACCACAGGCATCTGCCACCACACCCGGCTAAATTTTGTATTTCTAGTAGAGAC
AGGGTTTCACTATATTGGCTAGGCTGGTCTCGAACTCCTGACCTCAAATGATCTGCCTGCCTTGGCCTCC
CTAAGTTGTTGGGATTACAGGCGTGAGCCACTGTGCCTGGTCAAGAAATGGAACTCTTACACACTGCTGG
TGGGAATGTGAAATGGTAAGCCACTTCGGAAAACAGTTTGACAATTTCTTATGCTAAAAATACACCTATC
AGATGATTTAGCCACTTCTAGGTATTTACTTAAGAAAAAATAAGGCATACATCCATATGAAGACTTGTAA
ATAAATGTTCTCATTATTTTTATTTGAAATAGCTAAAACTGGAAACAACCCAAATATCCATCAGCAAGTG
AATGGATAAACAAATTGTAATATTTGTATGCAATATAACACCACTCAGTAATATGAAAATGAACTACTGA
TGTATGCAAAAACGTGAAATTCAAAATAATTATGCTGAGTGACAGAATCCAGACAACAAATAATACATAA
TGTATTATTCTATTTACATAAAGTTTTAGAAAATCCAAACTAATCTAAGTAACAAAGCATACCAATGGTA
TATGGGCTTGGGGCAGGTGAGACGGATTATAGAGAAAAAGTAGGAGGTGATAGACATGTTTAGTTTTT
TTGCTTGTTTGTTTTTACTGTGGTAATGGTTTTTCAAGTGTGTATGTCAAAACTTATCAAATTGTACCTA
ATTTATTGTAGTTTTATTGATACCTCAATAAAATTAATAGTTACATACATAAATGTACTTGAAGTTCCAC
CTAGCACAATAAGGTAAGAAAAAAAATTAAGGCGTGGGACTGGAAAAGAAATGAAACTCTTCATTATTCA
CAAATGTCATGATTGCATATATGGAAAATCTAAGTCTACACAAAACCTATTAAAATTAAATAGTGAATTT
AGCAATGTGGCTAAACAAAGGTCAATATAAAATATTAAATATAAGCCAGGCATGGTGACATGCATCCACA
GTCCCAGCTACTCAGGAGGCTGAGGCAGGAGAATTGCTTGAGCCCGGGAGTTCAAGTCCAGCCTGGGCAA
CACAGCAAGACCCACTGTCTCTGAAAAAAAATCAAATACATATATCAGCAATAAATAAATAGGAAATTAA
ATTTTAAATTATAACATTTATCAAATAAATTCTTAAGTGCCAAGAATAAATTTAAAATATGAGATATAAA
TAGTTAAAATTACAGAATATTGACAGAAATCAAAGAAGACAAATAAATGTTGGGATACAACATGTTAATG
TATTGGAAGATTACGAGTAAAAATATTAATTCTCCACAAATTGATCTATAAACAACGCAGCGCCAATCAG
AATCCCAGCAGTTTTGTCCTGCTGGAAACTGACAAACTGATTCTGAAATATATAAGTAAATGAAAGGCTC
AGAAATAGCCAAGAGAATATTTGAAGAAAAAGCAAAGCTGGAAGACTTACAATACCAAATATCCAGACT
GATGGTAAAGCTGTTGTAACTAATGTAGTGTGGTATGGCCTTACCAATGGACAAATCAATGGAACAAAAT
ATGGAGTCCAAAAAGAAAATAATATACTCACTTGATTTCTGACAAAGTTAATCCTGTGGTACACTGGAGT
ATGAGTGATCTTTTATTAAATGTTGCTTGTCAACTCTATGTAGATAAAATAAATCTGTGTTACCAGATG
AAGAGTTTTTAATTGGGTTGTTCAGGTTATTGGCATGTTGAACAAAGAACTGAACAAAATGCACAGACAA
AGAAAAAGCAACAAAAGCAGAGATTTATTGAAGTGAAAGTACACTCCACAGAGTTAGAGAGGGCTCAAAC
AAGTGGCTCAAAAGTCCAGATTATAATGTTCCTTGGGGATTTTATTAAACTAAAAGAGCATAGTAGCACG
CCTAAACGTCCTTTAGAAGCCTCTAACAGGTCATACTCTATAGGAATGAAGAATTCTGCCCAGGACCAAT
CAGAGGCACCCTGCAAATGAGGGATTCAGAATGAACCAATCACAGGCATTCCCATTGTGACACAGGGGAG
GGGAGGTTCAGAGAAGGAGGGCCTTTGGCCTCGTTATTTGGTCACGGAGAGGTGAGGTTTTCCTCTTAGT
CCAATTCCAAGAAGTCAGCAGGGGTTGGCCTTAGGTTCCCTGTCTCCAGACTCTATTCTCCTGCCTCATT
TGGACCCCTACAATCTAATTGTGAATGTAAAAGGTAAAAAAAGTTTCAAATAATTACGTAGAAGGATAGC
```

FIGURE 498 cont'd

TTCATGACCTTTGGTTTGGCAATATTAATCATTTTTTAAAATAGTTTTTTTGTTTGTTTGTTTGTTTTG
AAACAGAGTCTCACTCTGTGGCCCAGGCTGGAGTGCAGTGGCGCAATCTCGGTTCACTGCAACTTCCGCC
TCCCAGGTTCAAGCACTTCTCCTGCCTCAGCCTCCTAAGTAGCTGGGATAACAGGCGTGTGCCACCACAC
CCAGCTAATTTTTGTATTTTTAGTAGAGACGGGGTTTCACCTGACCTCATGATCCGACCACCTTGCCCTC
CCAAAGTGCTGGGATTACAGGCATAAGCCACTGCACCTGGCTGGTGGCACACATTCTTTTTTTTTTTTTT
TTTTTAAAGACGGAGTTTCACTCTTGTTGCCCAGGCTGGAGTGCAATGGCACGATCTCAGCTCACCACAA
CCTCCGCCTCCTGGGTTCAAGTGATTCTCCTGCCTCAACCTCCCGAGTAGCTGGGATTACAGGCAGGCGC
CACCACGCCCAACTAATTTTGTATTTTTAGTAGAGAGAGGGTTTCTCCATGTTGGTCAGGCCTGTCTCCA
ACTCCCAATCTCAGGTGATCCACCTGCCTCAGCCTCCTGAAGTGCTGGGATTACAGGCATTAGCCATCGC
GCCCAGCCACACATTCTTATACAAACAGTTTTAACTTGGTTGTAAATATCTCCACTCAAAGGATCTGGCC
CATGCAGAAACACAAGACTTGTCCCTCAATATAAATCGTAAGATAGGTGGTGTTTTGTACAGTCTAGAAA
ACCAGGCCAAGTTGCAGCAAACCCCTAGGTTTTAATGTTAATAAAGTCCTCTTGGACTTCATGGGCCCAA
AAGTTCCAGTGTTGTATTGCTTTTGTAAGAAAATTTCAAAACTGTAAAAAAGACAAATGGGTAGTTCTTG
GAATACCAAATAAGTAGTGGTTAAACTGGAGGTATCAGTGCATAGCTAAGGCACTAAATTTGTTATAGGT
CAGAATCAACTCCCTAAAATTTGATGCTCATAGCCATGAAATAAGGTGGTAGAGCAATGCAGGTTCCCTG
ATCAAACAGCCTTTCAAAAGGAGTCTTGATCTTATTCAAAGATCATGTCATTTAATTTGCACTATGGCCT
TTGCCACACATAAATTATGCAGTAATTCCAGTATTCCACTAAAAATCCATGACCTGAATCTCATTATGGG
AATACATCAAACTACAAAATTGAGAGACATTATATAAAGTAACAACTTTTTTCTTCAAAAATGTTGTCAT
AAGAAACAAAGAAAGGGTAGTAATATCACATGATATCAAAGTAGGGGATTCTTGCTCCCTTCCTCCCACA
AAAGTGGACAATTAGCTATCCATGAATAAAAATAGCTCTAGGAGAGCTCTGGAATCCAGTTAAGAAGCTG
CAGCAACACAGTGGAGCAAAAAAACACCTAGAATAACCAACATAAGGGGCAGGAAGAACAGTTTCATTTT
TAAAAATTGAAATCATATCAAGTATCTTCTGAGATCACAATAGAAAAAATCCCTAAAAATCAGTAAGAA
GCAGAACTTTGGAAACTGTATAAGTACATGGAAATTAAGCTCCTCAATGACCACTGGGTCAAGGAAGAAA
TAAAGGAGGAAGTAAATTTCTTGAAACAAATGAAAATAGAAACACAACATACCAAAATGTGCGGGATACA
GGAAAAGCAGTGCTAAGAAGAAAGTTTATAGCAATAAATGCCTACATCAAAAAGTAGAAAATTTTAAAC
TATCGAATCATGCACCTTAAGGAACTACAGAGCAAGAACAAACCACACCCAAATTAGTACAAAGAAAGAC
ATAATAAAGATCAGAAAATTACTAAACAAAATAGAGACTCAAAAAAATACAAAGGATTAACAAAATGAAA
AGTTGGTTCTTGGAAAAGATAAATAGAATTAATAAACCACTAGCTAGACTAACCAAGAAAAAATAAAAGA
ACCAAATAAACAAAACCAGAAGTGTATTATAACTGATACCACAGAAATACCAAAGATCATCAGAGACTAC
AGTGAATAACTATACACTAACAAACTGGAAAACCTAGGGGAAATGGATAAATTCCTGGATACATATAATT
TACTCAGATTAAATCAGGGAGAAATACAAAACCTGAACAGACCAATAATGTGTAAGACCAATAATGATTC
AAATATATTGAATCAGTAATTAAAAGTCTCCCAACAAAGAAAAGTCCAGGACTTGGTGCTTCACTGCAA
ATTCTACCAAACTTTCGAAGAACTAACACCAATTCTCAAACTATTCCCAAAAATTGAAGAGAAGGGATTC
TCCCTAGCTCATTCTAAGAGGCCAGCATTACCTTGAGACCAAAACCAGACAAGGATGCAACAACTACAAA
AAACTAGAAGCCAATATCCCTGATGAACATAGATGCAAAATTCTCAACAAATACTAGCCAAATCCAAC
AGCACATCAGAAAGGTAATACACCATGACCAAATGGGATTTATCCCAGGAATGCAAGGATAGTTCAACAT
ATTCAAATCAATAAATGTGATACATCACATAACAGAATGAAGGAAAAAGCCATATGATCACCTCAATAG
ATTTCAAAGCACTTGATGAAAATAAACATCCTTTCAAGATAAAAACTCTCATCAAACTAGGCATAGAAGG
AACAAACCTCAACAAAGTAAGGGCCATATATGACAAACCCACAGCTAATATACTGAATGAGGAAAAGCCA
AAAGGCTTTCCTCTAAGAATTGGAACAAGACAAACATGCCCACTTTCACCACTCCTATTCAGCACAGTAC
TGGAAGTCCTAGCCAGATTAATCAGGCAAGATAAATAAATAAAGACATCCAAATTGGAAAGGAGAAAAT
CAAACTGTCCCTCTTTACCAATGATATGCTCTTATTTCTAGGAAAAACTAAAGAATCCACAAAAAACTCT
TAGATCTGATGTAGCCAAAAAACCAATAGGAAAGCAATCCTGAACAAAAACAACAAAGCTGAAGGCATCA
CACTACCTGACTTCAAAATATATTACAAGGCTATGATAACCAAAACAGTATGGTGTTGGTATAAAACCAG
ACACACAGACCAGTGGAACAGAATAGAGAACCCAGAAATGAATCTGTGCATTTATAACCAACTGATTTC
AACAAGGGCACCAAGAACATGTACAGGGGAAAGGATACCCTCCTGAATACATGGTGCTAGGAATATTGGA
TATGCATATGCAGAAGATGAAATTGGACCCCAATCTACCATATACAAAAATCAACTGAAAATGGATTAA
ATGGATTAAAAACTTAAATGGCAGACCCAAACTATAAATGGAAGAGAAACAAGGGAAATACTTCAG
GACATTGGTCTAGGCAAAAATTTTATGGCTTAGAACTCAAAAGCATAGGTAACAAAAACAAAAATACACA
AATGGGACTATATTATGGTAAAAAGCTTGTGCATCACAAAGGAAACAACAGAGTAAAGAGGTAACCTGTT
GAATGGGAGAAAATTTTTGCAAACTATTAATCTGACAAGGGACTGATATCCAGAATAAAAAGGAACTTA
CACAACAGTAAAACAAAACAAAACAACCCAACCAAAAAAATCCTATTAAAAGCAGGCAAAGTACATGA
ATAGACATTTCTCAAAAGAAGACATAAAAATGGCCAACGGGAATAGAAAAAAAAAAAGCCCAACATTAA
TAATCATCAGGAAAATGCAAATCAAACCAGAATGAGATATCATCTTAGCCCAGTTAGAATGACCATTAC
TAAAAGATAAAAATAATAGATGCTGTTGAGGATGTAGAGAACAGGGAATTTTTTTTTTTTTTTTGA
GGCGGAGTCTCACTCTGTGGCCCATGCTGGAGTGCAGTGGCATGATCTCAGCTCACTGCAACCTCTGTCT
CCCATTTCAAGCAATTCTCCTGTATCAGCCTCTCCAGTAGCTGGGACTACAGGTGCACACCACCACGCCT
GGCTAATTTTTGTAATTTTAGTAGAGACAGGGTTTCACCACTCTTACACACTCTTGGTGGAGATTTAAAT
TAGTACATCTCCTGTGGAAAAGAATGTGGAAATTTTTCAAAAAACTAAAAACTACCATATGATCCAGCAA
TACCACTACTGGGTATCTACTCAAAGGAAAAAAAATCAGTATATTAAAGGGATACCTTAAATCCCATGTT
TATTGCAGCCCTATTCACAATAGCAAAATATGGAATCACCCTGCGTCCATCAATAGATGAATGAATAAAT

FIGURE 498 cont'd

```
GAAATGTGATAGCCGGGCACAGCTGCTCACACCTGTAATCCCAGCACTTTGGGAGGCCAAGGTGGGTGGA
TCACAAGGTCGGGAGTTCAAGACCAGCCTGACCAATATGTTGAAACCCCATCTCTACTAAAAATACAAAA
CTTAGCCGGGCGCAGTGGCAGGTGCCTGTAATCCCAGCTACTCAGGAGGCTGAGGCAGGAGAATCACTTG
AACCTGGGGGGCAGAGGTTGTAATGAGCCACCACTGTACTCCAGCCTGGGTAACAGAGGGAGACTCTGTC
TCATAAATAAATAAATAAAATGTGATATGTATACATAATGGAATACTATTTGACCATAAAAAGAA
TGAAATAATGTTATTTGCAGCAATGTAGAGGGAACTGGAGGTCATTAAGTGAAATAAGCCAGGCACAGAA
AGACACATATCACATATTCTCACTCACATTTGGGAGATGTAAAAAAAAGTCACTCATGGAGGTATACAG
TAGAACAATAATACTAGATGCTAGGAGGAGTGTTTGTGAGGGGATGAAGAAAGACTGGGTACACAACACA
CAGTTAGAAGGAATAAGCTCTAATGTTCAATAGCAGAGTAGAGAGATCACAATTAACAATGTATATTTCA
AAATAGCTAGAAGAGAGGACTTGAAATGTTCCCAATACACATAAATGATAAATACTCGAGGTGATGGATA
CCCCAAATACCCTGACTTGAGCATCCCACAGTCTATGAATGTAAGAAAATGTCACATCTGGCTGGATGCA
GTGGCTCATGCCTGTAATCCCAACACTTTGGGAGGCTGAGCGGGGAGGATCACTTGAGCCCAGGAGTTTG
AGACCAGCCTGGGCAACAAAATGAGACCCCGTTTCTATTTACATTTTTTAAAAAGAAAATATCACATG
TTCCCCATGAATATGTATAAACATTATCAATATAAAAATATTTAAAAAAATTTTAAAGACACATAGGCTA
AAAGTGAAGGGATGGAAGAAATTATTCTATGCAACTGGTAACCAAAGAGAGCAGGGTGGCTATAATTATA
TCAGACAAAATAGACTTTATGTTGAAACTGTTATTAGAGACAGAAAAGGTCATTATATAATAATAAAAGG
GTCTATTCAACAGGAAGACATAAAGATTGTAAATATATACGCACCCAACATCAGAGCACTGAAATACATA
AAACAAATATTGACAGAGCTAAAGGGAGAAATTGACAGCAATGCTATCATAGGAGGAAACTTTAATGCCT
CAATTTCAATAATGAATAGAGCACTCAAGCAGAAAATCAATTTTTAAAAACCCGACTTGTGCACTCTAGC
CTAATGGACCCCACAAACATATCTATAACTTTCCACCCAGCAGAAGAAGAATTAGCCCATGCAACAAATT
CTTTTCAAACACACTTGGAATATCCTCCAGGACAGATCACATGTTGGGTCACAAAACAAGTCTTAAGAAT
TTAAGAAGATTGAAATCATACCAATTATCTCCTCAGACCATGTGGAATCAAACTAGAAATAATAACAGCA
ATAAATAAGGAAAATCCACAAACACATAGTAACTAAACAACACACTTTTGAACACCAGTTGGGTGAAAGA
GGAAATCAAAAGGAATTTAAAAAATACCTTGAGACAAATGAAAACAAGAATACAACATACCAAAATTTA
TGGGATGCAGCAAAAGCAGTCCTAAGAGAAATGTTTATAGGGATAAATGTCTACATTTAAAAAGAAGAAA
TATCTCAAACAACCTAAGTTTACAACTCGAGGAAGTAGAAAAAAAAACTAAAAGCAAAGCTAGCAGAAAG
AAAAAAAATAATAAAGATTAGAATGGAAATAAATGGAATAGGCTGGGCACAGTGGCTCACTCCTGTAATC
CCGACAGTTTGGGAGGCCGAGGTGGGCAGATCACTTGAGGTCAGGAGTTCAAGACCAGCCCGGCCAACAT
GGTGAAACCCTGTCTTTACTAAAAATACAAAAATTAGCTGGTTGTGGTGGTGGGCGACTGTAATCCCAGC
TACTCAGGAGGCTGAGGAAGAACTGCTTGAACCCAGGAGGTGGAGGTTGCAGTGAGCCAATCTCGCCATG
CACTCCAGCCTCAGCGATAGAGCAAGACTCCATCTCAAAAAAAAGAAATAAAATAGAGAGCAGAAAAC
CATAAAGAAAAATCAGCAAAACTAACAGTTGTGTTTTGTTAAAGATAAGCAAAATCAACAATCCCTTAC
GTAGACTAAGAAAAAAAAATAGAGAAGACTCAAAGAAAATCAGAAATGAAATAGGAGACATTACCTTGAAT
GACAAAGAAATAAAAATGATCATAAGTGACTATTATAAACAAGTATACATCAACAAATTAGAAAATATAG
TACAGTGGCCCCCAACCTTTTTGGCACCAGGGACTGGTTTCATGGAAGACAATTTTTCCACAGACCAGGG
TGATAAGGGGACAGGGGAGGATGGTTTCAGGATGAAACTGTTCCACCTCAGATCATCAGATTCTCATAAG
GAGCGGGCAACCTAGATCCCTTGCATGCAGAGTTCACTATAGGGTTCATGCTCCTGAGAATCTAATGCTG
CCACTGATCTGACAGGAAGTGGAGCTCAGGCAGTAATGTTCGCTCTCCTCCTGCTGTGCAGCCCAGTTCC
TAACAGGCCATGGACTGGTACTGGTCCATGGCCCAGGGATTGTGAACCCGGATATAGGAGAAATAGATAA
ATTCCTAGAAACATACAACTTTCCAAGATGGAATCCGGAAGAAATAAAAAGTCTTACTTCTCCTGGGACC
CCTGGAATCATGGCATATTCTGAACAAGGGGAGAAACATATTGAGCAGAGGCTCTTAGAGGAGAAACCAC
CTGGAATGACTCATGAAGATGGCATCTGGAGTAGAGGCTATTACTGGCCCAATACAGAACACTGTTCA
CTGGGACTTCCCTTACACCAGCATCCAGTATGCTCCCACCCCCATGCACCCTTCGGAGGTGCATGCTCAG
CAAGGGGTATAAGAGTACCACTGGCAAAACAATGCTTAATCCATCTGGCAGTCATCCTGGCCCTGTGTTT
TCCTACATCAGGGCTAAAGGAGGCCAAGGGGTGGCAGAGTGTCAGAACTGATTCATTATTCCAAAGTGCA
CTTTTGCCTCACTTTCGAGGCATTGAGACTTTGCTGTGGACAGTCTTATACTGTCTCCTCGCAGGGCATG
GCCTTCTCTGTGCCTTGTCCTTGTTATGCATCCTCCTGTATCCCTCACAAAGGAAGAGATGGAGCTGTTT
GCTAATCCACTTTCTTCTTGAGCAGTTCATGTTGTATGAATAATAGCAAAACCTCTAGGTCACATGTGAC
TTGTTTAAATACTGTACATACATACCTTGGTGTGTGTGTATATATATATACACACACACACACACACA
CACATATATACATATACATATATATATATATATATATATATAAAATACACACTTGTACATGAAACTCG
TAGAATTCAAACCACATCCCATATGGGCTCTGAATATCCTAGGTAGTGCTTGGTGCAAGAGAGAAGTTTG
TTGGCATATAATTCACCTTATCACCCCTGTCTCTTTGTCATAATTCTGCTAAATTATTGAGCCTCCATCA
CATCCAGTTTCTTATGGACATTCTAGTCTCACTCAGAACTGACTCAAAGTTCGACACACACTTTTAAAA
ATTCCTCCTAATTGAAACTGTATATCCTTTGACCAACATCTCTCCAACCAACACCACCCCTGACAGGCCC
TGGTAACCACAATTCTACGCTCTACTTCTATGAGTTCAACTTTTTTAGATTCCACATATAAGTGAGATTA
CACAGTATTTGTCTTTCTATGCCTGGCTTACTTCACTTAACATAATGTTCTCCAGGTTCATCCTTGTTGC
AAACAACATGATTTCCTCCTTTTTAAAGTCTGAATACTATTCCATTATATATGCCATTTCCTTTCTCC
ACTCATCCTTTGATGAACACTTAGATTGCTTCCACATCTTGACTATTGTGAATAGCGCTGCATTAAACAT
GGGAGCATAGATATCTCTTAAACATATTGATTTTATTTCCTTTGGATATTGATATAGTTTAAATGTGTGT
CCCTGCCCAAATCTCATATTGAAATGTAATCCCCAATGTTGGAGGTGGGGCCTGGTGGGAGGTGATTGGA
TCATGAGGGTGGAGTCCTCATGAATGATTTAGCACCATCCCTCTTAGTACCATCCTCCCAATAGTGAGTT
```

FIGURE 498 cont'd

```
CTCATGAGATCTGGTTGTTTAAAAGTGTATAGCACCTCCCCCTCACTCTCTTGCTCCCGCTTTTGACATA
TGACATGCCTACTCCCCCTCTGCCTTCCACTATGACTGGAAACTTCCTGAGGCCTCCCCAGAAGCAGGTG
CCATTATACTTCCTGTACAGCCTGCAGAACTGTGAGCCAATTAAACCTCTTTACTTAGAAATTGCCTAGT
CTCAGGTATTTCTTTATAGCAATTCGAGAATGGACTAACAGAAAATTGGTACCGAGAAGTTGGGCATTGC
TGTAAAGATGCCTGAAAATGTGGAAGCAGCTTTGGAATTGGATAACAGGCAAAGGTTGGAAGAGAGTTGA
GTGCTCAGAAGATAGGAAGATGAAGGAAAGTTTGGAGCTTCTTAGAGACTGGTTAAATGGTTGTGACTAA
AATGCTGATAGTGATAACGGACAATGAAGTCCAGGCTGCCAAGGTCTCAGATAGAAATTAGGAACTTATT
GGGAACTGGAGAAAAGGTCCCTTTTGCTATGCCTTAGCAAAGAGCTTGGCTGCATTGTGTCCACACCCTA
GGGATCTACGGAAGTTTGAACTTGAGAGTGATGACCTAGGGTATCTGGCAGAAGAAATGCCTAAATAACA
AAGCATTCAAGATATGGCCTGGCTGCTTGTAACCACCTATGCTAAGATGTGGGAGCAAAGAAATGACTTA
AAGCTGGAACTTATATGTAAAAGGTAAGCAGAGTGTAAAAGTTTGGAAACTTTGCACTGGCCATGTGGTA
GAAAAGAAAAGTTCATTTTCAGAAGAATTCAAGAAAGTTTCTGAGCAACCATTTGCTAGAGAAATTTGCC
TAACTAAAAATGAGGCAAGTGCAGATAGCCAAGAAATGGGAAACAGGCCTCTAAGGCATTTCAGAGATCT
AAGAGGCAGCCCCTCCCATCACAAGCCCCGAGGCCTAGGAGGACAGAATGGTTTCATGGGCCAGAATTGA
CCTGTGCAGCCTCAGGACATGTCTCCCTGCATCCTGGCTTCTCCAACTCCAGCTGTGACTTAAAAGGGCC
CAGGTACAGCTCAGACTGCAGCTCCAAAGGTTGCAAGCCATAAGTCTTGGTGGTTTCCACATGGTCTTAA
GCCTGCAGGTGCACAGAGTGTGAATAAGGCTTGGGAGCCTCCATCTAGATTTCAGAGGATATGTGGAAAA
GCCAAGGTGTCCAGGCAGAAGCCTGCTGCAGGGGCTAAGCCTTGACAGAAAACCTCTACTAGAGCAGTGC
AAAAAGGAAATGTGGGGTTGGAACCCTCACACAGAGTACACACTGGGGCACTGACTAGTGGAGCTATGAG
AAGAGGGCCACCATCTTCCAGATCCCAGAATGGTAGATCAGAGCAGCCTCTGAGCCTGAACCCGGCAAAG
CCACAGGGGAAGAAATACCCAAGGCTGGAAGCCCACCTCTTAAATTGGTGTGCCCTGGACATGGGACATG
GAATCAAAGATTATTCTGGAGCTTTAAGATGTAATGATTGCCCTACTGGGTTCTGATCTTGCATAGGGCC
TGTAGCCTCTTTCTTTTAGCCAATTTCTCCCTTTTGGAACAGGAATGTCTATCTAATGCTTGTACCCCCA
TTTTATCTTGGAAGTAACTAACTTGTTTTTGATCTTACAGGCTCATAGGAGGAAAGAACTTGCCTTGTCT
CAGATGAGACTTCAGACTTTGGACTTTTGAGTTAATGCTGGAATTAGTTAAGACTCTGGGGGACTGCTGG
GAAGGCAAGATTGTATTTTGAAATGTGAGAAGGCCAGGAGATTTGAGAGGGGCCAGAGGCAGAATGACAT
TGTTTAGATGTGTATCCCAACCCAAATCTCATACTGAAATGTAATCCCCAATATAAGAAGTGGGACTGG
TGGGAGGTGATTGGATCATGGGCGCAGATTCCTCATGAATGGCTTAGCAGCCCTTTGTTTCCATCCTCAT
AATAGTGAGTTCTTATGAGATCTGGACATTTAAACGTGTGTACCATCTCCCTCCTCACTCTCTTGCTCCT
GCTTTCACCATGTGATGTGCCTGCTCCCATTTTGCCTTCCACCATGATTGGAAACTTCCTGAGGCCTGCT
CAAAAGCAGATGCCACTATGCTTCCCGTACAGCCTGCAGAACTGTGAGCCAATTCAACATCTTTTCTTAT
AAGTTACCGAGTCTCGGGTTTTCTTTATAGCAATGCAAGAATGGACTGATACGGATATATACAGATATAT
ACAGATATATATAGTGGGATGACTGGGTCATATAGTGGTTATATTTTTAATTTGAGAAAACTCCGGATAT
TTTCTATGTTTGTACTAATTTACATTTCCACAAATAGTGTACAAGTGTTCCCTTATATCCATACCCTCAC
CAACCCTTGTCGTCTTTTGTCTCTTTGATTACAGCTATTCTAACACTGTGAGGTGGTATCTCAGTGTGGT
TTTAATTTGCATTTCTCTGATGATTAGTAATGTTGAGCATTTTTTCATATGGACACTTTTTTTTTTTTTT
TTTAAAGATGGAGTCTCACTCTGTCACCCAGGCTGGAGTGCAGTGGCGCGATCTAGGCTCACTGCAACCT
TCGCCTCCTGGGTTCAAGCAATTCTCCTGCCTCAGCCTCCTGAGTGGCTGGGATTACAGGACCCACCACG
CACCACCACACCCAGCTAATTTTTGTATTTTTTAGTAGAGACAGGGTTTCACCACGTTGGTCAGGCTGG
TCTCAAACTCCTGACCTCACGATCCGCCCACCTCGGCCTCCCAAAGTGCTGGGATTATAGGCATAAGCCA
CCGTGCCCAGCCTTATATTGACACATTTTTAAGGGATTTGGGGGGGGCAGGGGTTCTTTGCAACAATGT
AAACATCCAGTCCCTCATCAAACTTTCAATTTTTTTCACGTACTAATTTATATCAGTTTGGAATTATGA
TTCCCTCTGTTATTTAATGGGTTTTAATCTATAACTAGCATTATTTATTTGATGCTCAAACCATGTCAA
GTTTGGTCAGTGGAAGTCCCTTCAATCTGGTTTCCATGTCCTTTGAACACGTCCCCACCATTCTTTGAGC
ACTGCCTTACTTTCAAGCACAAGATGTTCCAAGTTCATTCTGAACTTTCCCTTCCCCAGCTCTGGAATCT
GCCATTTCTCCATGGAGCCTTGCTCCTTTCAGTGGAGCATGGTATTTAGGAACCAAGGGCTGACTGCCTA
ATGTGCTTTCCAAGTATAATTTCCTCAGTCCAAGCTTTTCAAATTGATCTGCCAAAGACCCATTGCCAAA
GATCCATTGCCAGAATATAAGAGTGGAAGGAAATTCTTAATATTTTTTGAAAGTTACTATTATTTTCATT
TTTCTCTTTGTAAAAAATTCATTTAATTCAATATAAAAAGACAAAATCTTTGGCACATAAATCGCAACT
CTCTGATGCAAATGTTTAAATAAAGCTGATACTCCAAGAAGACGCAACATATTCTCTTTATCCCACAGAC
ATATAGGCCTATGGTTGCAAACTTTTATACACACACAGAGTCACAATTCCACTGGCACCCGTGATGTTCC
ACATCCAGATTTTCCAAATCACACATTCTCATCTTCACATAGCCTTGCCGGCAACCACACGGCATAGTAC
CACATTGTTACGTCAAGCACAGCCAGTCTACCACAGAGCCTGTCGTCCCATTGACCAAAGTCACAAAAT
CACAGCCCCGGGTATTTACTGTGGTTTTCTCCAGTCAGATCCCTTCACTCACTACACACTGACTCACACT
CAAATTACACACACGCGGAAACACAACCCGCCAGAGCCAGAGAGGTTCCGTCGGTCCCGCAACCCTCACA
GTGCCACACACACGCGCTCACAAGGCAAATACAAATGGCCAGGCACTCATTCTTTACAATACACATATTA
AGCGCCTATTATGTACTACACGCCGGGACTACCTCAAGAGGTGAAACAAACAAATCCTGCCTGGCGGAG
CTATCGCCCAGTCCCGCACGCACTCGGCCTCAGGGTCACACTCGGCGGTCCCACGCTCAAGTGGCCCGGC
CAGTGGCCCAGAGGCGTCTGTTCTCCTCCTCAGCTTCCTGCGTGGGTTCCTGGTAAGTGAGTCGAACCCG
CCGGATGCGCGCGCGCCTGCGCCTCCGCCCAAAAGGATCAGTTTCCGGCTGTGGACTACATTTCCCAGAA
GCCCCTTGGGCAGTGTTGCCTGGACCCCAAGGGCCCTTTACATTGCGTTCTTAACGGTTCAGTCACCTTA
```

FIGURE 498 cont'd

ACCGTTATTATTCACTTGCGGGCGAGAAGTCCGAGCTAGGTGAGGCGGAACGGGACTCTTACGAGTAGGA
CTGGGGATAGAACTGCCGCCCAAAGTGAGGCGCTCCAGGGCCCAGACCTGGCGTGTCGTGCCCGCAGGGA
GCCTCAGGCCTGTGCGTGCTTGGGGAGCGGAGAAGGGAAATTGTGTGACAAAATGTGGCAGACGGTGTAT
GTGTGTGTGTGCGCGCGACGGGGCGCCTGTCAGGACCGGGTTGGGCGGGTGTGGGTGCGGGTGTGAGGCT
GAGACAGGTGCCTGGCTCTCTGGTGTGTGTCACTGACCCTCTACCCTCCTCACGGCCTCGGTGTTTGCAC
ACAGCAGTGTCCCCAAGAGGGAAGTCAAATATCGAGCTCTGGGATGAAGGTTCCCAGCAAGAAGGTACAG
ACCTGGGTTGGCGATTGGACTTTTGAATTAGAAGTGTCCCTAAAACAGACTCCTGGGACGACAGGTTGGA
AGACTGCGCAGTTGGAGCCGCTGTGTGGGCAGCTGCATGTTTCAGAACCACTGCATTCCCATACCTTTGA
TCTAGAAACCTGGTGTGAGTTCAGAGACAGATCCCAGCCTCACTCTCACACAGCTGTTATGTGCGTGAGG
TCAGCACAGATGTGGCGCTGGAGGGGATATTCTAGGTCGGTCTGTGCTCTTAAGAAAGGCCTGCTGTCTC
ATGATTATTTTTCTTCCCCATTCTGCTATTCATCAAAACAGGGATCCTGAAAAGGAGGGAACAATTGTT
GTAGCAGGTCTAAAAGTTCAGGTCCAGGTAAGTTTATATTTCCTTTTTATTCATAAAATGGAAATCACAC
ATTCTAATCCTCACACAGCCTTGCCTGCACCCAGTCATACGGCGTGGTACCACACTGCTATGTCAAGCAC
AGCCACAATCTACCACAGAGCCTGTCACCTCATTGCTCACAGTCACAAAAATCACATCCCCAGGTACTTT
CTGTAGCTTTCATTTGCATTTTTCCCTTTGAAGAAGTTCATTTGATTCAATCTAAAAAGACTAAATTATT
TGTCACATAAATTGCAACTCTCTGGTCTATATCTTTAAGTAAATCTTTAAATAAATGCATAAATGTTTT
TGTTTTTAGGAAATGGAAACATTGCTTTGCTTTTCCTGAATTGTCCAGTGACCTATCCCAGGCCTTCCTT
TCCAGTGAACAATGGACCATGCAGGTGGACCCTCCTCTTCACGGGCCTCCAAATGACTTTCTCATTTTC
AAATCATTCCTCTGCACTCACTTTCTATAATGGTAGAGAAATGCATATCCTGGAGTCTAAAGTTAAAACT
TTGTTTTATTGAGATTAATGTTTAGGTAGAATCACATCATCCATCTTCTCCAATCTTCTCCAAAGACCTC
AGTTTTAAAATATGACAGGATTAGAGATGACCTGACTAGTGTCAGTAAGCAAGTGATAATGGTCGCCTGC
TTTTAAGGCTTTTAGAAGTGGGAATGTGATTGGAAGTCCAAGCATAGAAATCTGTGTGAACATGAGCAGG
GATTTTTTTCCAAGGAATCCATGAGTTGAGATTTATTTTTATACAGAGTTAGTCATAAGAATAAAAAGTA
CATATGAGTAAAGTAATAGTCATAGTGATGAAGAATAATACGCAATTTTTTTTTCTTTTTTTGAGAAGGA
GTCTCGCTGTGTCACCCAGGCTGGAGTGCAATGGCATGAACTCGGCTTACTGCAGCCTCTGCCTCCTGGG
TTCAAGTGATTCTCCTGCCTCAGCCTCCCAGGTAGCTGGGATTACAGGCGCCTGCCACCATGCCTGGCTA
ATTTTTGTATTTTTAGTCGAGACAGGGTTTCACCACGTTGGCCACGCTGGTCTGGAACTCCTGACCTCAG
GTGATTCACTTGCCTTGGCCTCCCAAAGTGCTGGGATTACAGGCATGAACCACCGCACCCAGCCGCAAAT
TTTAAATTTTATATGAATCTCACTAATATTAGGATTTAAAGACATTTAACAAGCATTATATCTAAATTAA
CATTTCAACTGATTATTTGCTGGAGAAGTAGAGGAGAACCAAACACTCTTCTGTCTGCTTTGTTCAAATT
TTCTTATTCAGTCTGCAGACACTGTTCACCTGGCTTGTGTATTAAGAGAAGAATCTTAACAGTGAAAAGG
TCTTGTTGAATTGAAGAAGAATGTTCAAGAACTGGCAGGCATTTATTTATAATGGTCATGCTGTTTTCCT
ATTGTTTGCATACATGTCAAACCAATTTGCTTCTGATGTGTTAAAACATTTTATTTTATAATTGGATATA
GATCTATTGTATACTTCTGGTTATAGAATTAATATTCACCTTTTATAAATTATTTAGTTACTCATTATAT
TACATAAGGCACTTATAAAGAAGAAAGTTAAAATAGCCCCAGCATCACTATTAACACTTTGGGGAGCTAT
ATTTTAGCAAGATTTTTTTTTTTTTTGACAGAGTCTCGTTCTGTTGCCCAGGCTGGAGTGCAGTGATGT
GATCTTGGCTTACTGCAACCTCCATCTCCCAGGTTCAAGAAATTCTCCTGCCTCAGCCTCCCGAGTAGCT
GGGATTACAGGCGCCTGCTACCACGCCCAGCTAATTTTTGTATTTTTAATAGAGATGGGGTTTCGCCAT
GTTGGCCAAGCTGGTCTCAAACTCCTGACCTCAGGTGATCCACCCACCTCGGCCTCCCAAAGTGCTGGGA
TTACAGGTGTGAGCCACCATGCCCGACCTATTTCAGCAAGATTTTTCAGCACACTTGTATGTATGTGTGT
GTGTATGTGTGTGCGCACAGCACCTGCACTTTTCTTCCTGCAGAATAGAAATTGCACTAACTGATTATTC
AAAGGACACAAGACTTTCCAGCTTCTAGTTAGAAAAACTAATTCTCCCTAACCATAGCTTTCTTATAACT
CTGTGCACATAGGGAGAAGAGGAAAACACCAATGAATCCTGCTAAGTTTGATTAACCTTTGAGAAATTTA
CACCTTTTAGGGTTATATAAACCAATCAAGGATAATTAATATGACATAATTTATCAAGTAAGATAGTTCT
TCAGGATTATACTCTTTTTTTAGATTTTTAAGGTTGCTTTTACAGGACATAGCAATACTCTTATCTTGGT
TAGGTTTTTTTCAGGGTTCCATTATGCAAATAACATTTTCTAGGACAGATTTATAACAGTAGAAAACAGA
ATAAGGGTGGGCATGGTGGCTCAAGCCTGTAATCCCAGCACTTTGGGAGGCCCAGGCAGGTGGATCACGA
GGTCAGGAGTTCAAGACCAGCCTGGACAAGATGGTGGAACCCCATCTCTACTAAAAATACGAAAATTAGC
CGGCTGTGGTGGCATGCGCTTGTAATCCCAGCTGCTTGGGAGGCTGAGGCAGAGAATTGCTTGAACCCAG
GAGGTTGCAGTGAGCCGAGATAGCACCACTGCCCTCCAGGCTGGGCGACAGAGTGAGACTCTGTCTCAAA
AAAAAAAAAAAAAAGAAAAAGAAAAAGAAAACAGAATAAGATAGTAACAGCTACAAATATTCATGTAAA
TCTTTCCATATAGAACAGGAGAACAAGATTGAACCTCATATTAAAATTATCTATTGAATGCCTTATTACA
GCAGTTCCCAACCTTTTTGGCACCAGGACTGGTTTCATGGAGGACCGTTTTTTCACAGACAGGGAGAGGG
AGATGGTTTCAGGATGATTCAAGCACATTACATTTATTGTGCATTTTATTCCCATTATTATTACATTATA
ACACGTAATTAAATAATTATACAACTCACCCTAATGTGGAATCAGTGGGAGACCTGAGCTTGTTTTCCTG
CAACTAGATGGTCTCATCTTGGGGTGATGGGAGGCAATGACAGATCATCAGGCATTAGATTCTCATAAGG
AGCACGCAGCCTAGATCCCTCACATGGTCAGTTCATAATAGGGTTCGCACTCCTATGAAAATCTAATGCT
GCAGCTGATCTGACAGGAGGCAGAGATCAAGCGGTTAATGCTAGCAATGGGGAGTAGCTGTAAATACAGA
TGAAGCTTCCCTTGCTGGCCTGCTGCTCACCTTCTGCTGTGTGGCACAGTTCCTAACAGGCCGTGGTCCA
GTGTCAGTCAGTGACCTGGGGGTTGGGGACCCCTGCCTTAATTAGATTATTTTAGCTAGTTTTATGTTGA
AGAATGATGTCCCCCCTTTGGTAGTTGCAAGAACAAAAGAGGATATTTCTTTTTTTTTTTTTAAATGAA

FIGURE 498 cont'd

GTCTCACTCTGTTGCCCTGGCTGGAGTGCTGTGGCTCAATCTCAGCTCATTGCAACCTCTGCCTCCCAGG
TTCAAGTAATTCTTCTGCCCAGCCTCCAGAGTAGCTGGGATTACAGGTACCCACTACCACACCTGGCTAA
TTTTTGTATTTTTAGTAGAGACGGGGTTTCACCATGTTGGTCAGGCTGGTCTTGAACTCCTGACCTCAGG
TGATCCACCCACCTCAGCCTCCCAAAGTGCTGGGATTACAAGTGTGAGCCACCGCGCTCTACCAAGAAGA
GATTTCTTGATTATCTTTCTGGGAGTCTGTTTTACGAATGTTGTTAATTAAAAATAATTGCATCTTCAAG
GCTCAGCTCTGAAATACTTAAAATATCATTATTAAAAAATGGGCATGAGACTCAAACTTTACTAGAAAAA
ATGAAATAATATAAAATGATTTTATTTAATAGCAGTGGAACAAAGGACATAATATCCTCTATTTTAATAA
TACTGGCTAACTTTTATTACGTAATTATGTATCATTAAGTGGGATGTATGTATTATCTCAATCTTCGTGA
CAACCCTATGAGATAGGTGCTGTTTTATCCCTAATTTACCAACAAACTAACTGAAAAGTATGTAGCTGT
CAGACTAAGATTCACATTCTGAAAATCTGACAACAGAGTTTGTGTTATTAATGACAACGTTATAACCCTG
CCCATAATGGCATATGCTCCTTTAATTTGCCTGTATCAGTCAGTAACTCATCATTGATGTCTTCCTCCAA
AAATAAATATGGACCAATATAGTTAGTATTAGTAAGGCCTTAGTGTGCCATCATAACTGACCATAGTTTA
TTTAACCTGCTGCCTACTATAGCTATTAGTATTTTTAATATTTGATTATTATAAGTTGTTATATGATAAA
TGTCTTATGTATATGTCTTAATATGCTTTAATAGCCACTTGCAAGAAAAAAATGCCAAAAATTGGAATTT
TAGTCAAATATCAGACATAAGGGCTCACAGTATACTGAATCTTGTGTTAGTAATCAGAGGAATACAAGAA
CTGAAAACACATAGGTGTTACTGTACAGCAGAGAGTCTAAAATCAGAATAGACTGAATAAGTATAAGGTA
GAAGATAATAAAAAACAGTAAAGAAATTCAGGTCACAGGCCTTGGGAGTTCATAGGAAGGAGATGTCCAG
TGCTGTCCAATAGAACTTTCCATGATGATGGATTTGTTCTATGTTTTCCAGTGTGGTAGCTGCTCACCAC
ATGTGGCTAATAAGCACCTGAAATATGGCTAGTGTGACTGGGAAACTAACTTTTTTTTTTTTTTGTCG
AGATAGAGTCTCACTCTGTCGCCCAGGCTGGAGTACAGTGGCGAGATCTCAGCTCACAGCAGCCTCTGCC
TCCCGGGTGGAAGCGATTTTCCTGCCTCAGCTTCCTGATTAGCTGGGACCACAGGCATCAGCCACCATGC
CCAGCTAATTTTTGTATTTTTAGTAGAGACAGGGGTTCACTATATTGGCCAGGCTGGTCTCAAACTCCTG
ACCTCAAAAGATCCGCCCACCTTGGCCTCCCAAAGTCCTGGGATTGCAGGCGTGAGCCGCCGTGCCCGGC
CTGAACTTTTAATTTTATTTAAAATTTGATTTAACTTTTTTTTTTTTTTTTTGAGACAGAGTCTCGC
TCTGTCGCCCAGGCTGGAGTGCAGTGGTGCAATCTCGGCTCACTGCAAGCTCTGCCTCCCAGGTTCACAC
CATTCTCCTACCTCAGCCTCCCGAGTAGCTGGGACTACAGGCGCCTGCCACCACGCCTGGCTAATTTTTT
TTGTATTTTTAGTAGAGACGGGGTTTCACGTTGTTAGCCAGGATGATCTTGATCTACTGACCTCGTGATC
TGCCTGCCTCGGCCTCCCAAAGTGCTGGGATTACAGGCGTGAGCCACCGTGCCCAGCTTAAAATTTGATT
TAAATAACCATATTTGTATTGAACAGCACAATTTCATACCTTAAGTTTTTATTGTAATGATTCAAAGTGA
GGCTAATGGGTTTTTATTGTTAGATTCAAAACAAAGTTTTTATTGTTAGATTCAAAGTGAGGCTAATGG
GACAAGATTATTCAGCAGCAGTTTGGAGGATATTGTGGCTGAAAGGAAAATTTCAGAGCACAAACTGTCA
ATACGTTTGTCAGGAGTACATGAAAAGCCACTTCACTGTGACCAGCATTCATATGTATAAGACATTGCAA
TATATTAGCATACATGGACATATGTGAAAAATCAAAAGAATTGCTTCCAATGTTATGAGCTAAAGGGAAA
AAAGACATTCAGTAAAAATATAACAGCTGTTGGCCAGGCACAGTGGCTCATGCCTGCAATACCAGCACTT
TGGGAGGCTGAAGAGGGCAGATCACCTGAGGTCAGGAGTTCGAAACCAGCCTGGCCAACATGGCGAAACC
CTGTCTCTACTAAAAATACCAAAATTAGCCGGGCGCAGTGGTGGGCGCCTGTAATCCCAGCGACTCGGGA
GCCTGAGGCAGGAGAATCACTTGAACCTAGGAGGCGGAGTCTACAGTGAGCTGAGATTGTGTCATTACAC
TCCAGCCTGGGTGACAGAGTGAGACTCTATCTCAAAAAAATATATATATATAAATATATAAATATATTTA
TATGTATTTATATATAATATATAAATATATATAACTATATTAATATATAAATATATATTATATATATA
ACTATATTAATATATATATATCAGCTGTTTTTAGATTATCTTAAGCTTTTCCTTCAAGTTGAAGAGAA
GATCGTTCAACAAAGGAAAGGCTTTCTCTTATCAAAATGAAAAATAAGTACATATGTATGCCGGTGTGTA
TATTTTAAATTTTTATTTTATTTTTTGAGATGAGTCTCACTCCCGTCGCACAGGCTGGACTACAGTGGC
ACAGTCTCGGCTCACTGCAACCTCCACCTCCTGGGTTCAAGTGATTCTCCTTCCTCAGCCTCCCAAGTAG
CTGGGATTACAGGCATGTGCCACCACACCCAGCTAATTTTTGTATTTTTAGTGGAGATGGGGTTTTGCC
ATGTTGCCAGGCTGGTCTCGCACTCCTAACCTCAGGTGATCCAGCCACCTCGGCCTCCCAGCGTGCTAG
GATTACAGGCGTGAGCCACCGTGCCCAGCCTAAATTAATTTTTAAAGTTACAGATTATACTTTAAAATA
TATCAAGTAATGTCATGCAGCTTGGCAGTGCTGACATATAGATATATACATTTTTAAACTTTTTTCTCTC
TCTCAGTTTCTGCCTGTCCTTCGTTCTTTCTTTATGTATGTGTGTGTGTGTATGTTTTCACAAATGTA
ATTATATTGTACATTCTGGGTTTTAACCTTATTTTTAATTTAGAACATATCTTGGATATTTCCCAAATC
CTTTAAATATTTTCTCCAATTTAGTATAGTATTTAATATCTACTTAATATTCTGTTTCATAGATGATCTG
TAACTTATCTAACCAGTCAGCTATTGCTGGACTCAGAATGCTGAATTCTACCTCCCTGCATGCATCTTTT
TTATTTTGCTTTTTCCAGTAAGCCTTTTGCACCCCTAACCTGCATGCATCTTTTTTTTTTTTTTTTTTT
TTTTTTTTGAGACAGAGTCTTGCTCTGTCGCCCAGGTTGGAGTGCAGTGGCGCGATTTCAGCTCACTGCA
ACCTCTGCCTCCCGGGTTCAAGCGATTCTCCTGCCTTAGGCTCCTAAGCAGCTGGGATTACAGGCATGTG
CCACCATGCCTAGCTAATTTTTTTGTATTTTTAGTAGAGATGGTTTCACCATGTTGGCCAGGCTGGTTT
CGAACTCCTGACCTCAAATGATCTGCCCGCCTTGGTCTCTCAAAGTGCTAGGATTACAGGTGTGAGCCAC
CGCGCCCGGCCTAACCTGCATGCATCTTAATACACATCATTTGCTTTGGGTAGAGTCCCAAAATTAGGTT
TGGATGGTAAAAGTCTCTCACATCCTTCTACATGCCATGTTTTAAGGTCCTACAAATCTGTAGCATTTAC
ACAGTATTCATTTCCCTGTGATGTTGCTCATCTGGCATATTATTAATCTTTTAAGTCTGCCATTCTAATA
ATTGTCAACTGGTATTTCCTTAATTAGGATCTGCTTCATTGTATTGAAATTTAATAAGTTCGGTGGATGA
TATGCTGCTATTTTAGTGAATTGCTCATGCTTAAGTTTCATTTGAAAACATTCTGGGCTTCAGAGGCAA

FIGURE 498 cont'd

AAGCCAGAGTTGAGAGCAAGACCCTGTCTCCAAAAAAAAAAAAAAGATAGTTTGCTTTATAATTAGAGAA
ATGTGGATTCAGAACACAGCTCTGCCTCTTACTAACTGTGAATTTGGGCAAGTTACATTATTTTAAGCCC
TCATTACCTCATCTGTTGGATGGAGATAAATGCATTGCATGGTTAAATGTTAATATGATAAAGGACCCAT
CATGCAGAAGATCCTAAAAATAGCTACTTTTGTTGTCATCACCTGGCAACCGTGGGCATGAATTTACACC
ACCCCAGCCTTGATATTGAGATATCTTCCCCAGTTTATATGCGCAGAATGGTGGGGTTGGAAGTAGAAAT
GATGGCATAACAGGATCTTATTAACTTAAGTCATTTTAGGAGTTTTGACACACATCTGGTCTCAGAGTCA
CTTGTTCTTCCCCCCAGCCCCGGTTTCTCTGGATTCTGTGCTTCTCCATGGAGGAAACTCAAGGAGAACT
GACAAGTTCTTGTGGTTCTAAAACCATGGCCAATGTAAGTTTGTGTTTTCTTCCTTGAAATACTGTGTT
TTTAAATTCATGTGATCATTGAAGTCTCGTTATCTTGAGACTTCCTTCCTAAGACAACCCTGTTGTGGAA
CCTGCTCCCTAGTTACTCCCTAGTTACAGTGAAGGATAGTGCCAAATAGCCTAGTGTCTTCCTCATTTGC
TCCTGTTTTCTCTTATCTGTGCTCAAACATTGTCTTCCATGTCAGCCTCAGAGGCAGAGGTCAGATCCCA
TGCATTGAGAGGCTTAGAGGACTAGGCTGGAGTATGATTGGGGCCTGCATATGGTAGTTTCAGGCATCTA
GCCAGGGAATTTCCAAGGGATGAATAAGAAAACAAAAGTCAATTTTGTGGTTGAGGAGGTTGTGCTGGTC
TCCAGTGACATCAGTGTCATTGTGGATACGTCAGCATCCTCTGGCTTAGGAACAAAGCAAGTATTCCTGA
GGTATGGCAGGGGTAGCAGGTAGGAAGATCCTCCAATCCCTAATGATGGCTGGAAATAGGCTCTGATCCC
TAATGATGGGTGGAAACAGAACTGGGGAAGACCTTAAACATTTTGGCCAACCTAAATGCCTAAGAATAAA
AGAAGAATTAGTCTGCTGTATCTTTAAGATGGATGATATTATTAGCTAGCCAATAAATATACTAACTGAA
GACTTTTCTTATGAGGTTATTTTGCATCATGATGAACCAGAGTTTTAACGAAATCACGTAATGTCAGTCA
AATCCTGTTTTCTAAGAGAGATTTTAGAGTACTTTTTGGTGAAAAAATTCTTTTTCCAAAAATTTTTTGA
AGGGAAGAGAGGATGATGGAACTTGCATTTATTCAGAACTTTAACTGCAGGCACATAATGGGCAATGTGC
TTATTTATGCTATTTCACTTAATTTGCATCAACAATATTCTTTAAAAGCGTATGAACACTTTATTTCAGA
AATATTAATTTCTTTATTCTTTTACACACATTGCAGGCTTGAGCCCCAGTTTATTTGCTTACTATGTTGC
TTCTTTCCTGCAAAGCAGTTTTCCATCTTGAAAATACATTTAATTTTTTTTAATACATAGGCTTGTCAT
TTCAGGTATCTTTGGCATTTAGGGATGTGTCCATAGACCTCTCCCAAGAGGAGTGGGAGTGCCTGGACGC
TGTGCAGAGGGACTTGTACAAGGATGTGATGTTGGAGAACTACAGCAACCTGGTCTCACTGGGTAAGGTA
TCTTTCGAAATCGTTTACAATCTGTTTTCTGGAGTATCAGCTTTCTCCACTGTCAAACTTTAGAACTCTG
TTTTAAGAGGCTGACTGACACCCTATTTCTAAAGTCATAGTTTCAGCAGTGTTGGGGTGGAAATGGGCA
CCTGTGTTAAGCAACTTCACCTTTCTGACCCTCAGTGACATTCACTCCTCCCTCTGACTTTTCCTGTCAT
TGCTTGCTTTTCTAAATAATTTCCAGGTTTGAGTTGTGACATCAGATTTCATATAATGCATATACTCA
GAATTCCTATAGCTGTTCTGTGTTAATATCTGACCTTCCTACAAGACAACAGCTAGTCTCAGAATTCTAG
TTTTCCTTGATTATCAAAAGAACCTCCATGGATTATACAGTGGTGGATTGAGTTAACAATAGTCATTTAA
AACTCAAGCCAACACACCCCATCCTAAAGGAGACATATTCTCCTTAACCTGCTTTGCGGTTGAAAGTTAA
AGTCTGTGAATTGACATTTTCTGTTGAAGGAATATCTGAGGAAGAACCTGGAAATATTTTAGGAAACTTA
GTATATTTCTCCTAGGAAAATAGTACCAACAACAAAATAATACTATATACTGGGCATATTATATGCCTTT
GCATATATTAATTCATTTAATTCTCACCACAGCCCTAAGAAGTCGGTAATATCAGCCCCATTTTGCATTT
GATAAAAGTGAATATGTGCAGGGTAACTTTGAAGGTCACACAGCTGGTAGGTGGCAGAAGATTTGAACCC
AGGCCATAGGGCTCCAGAGGGTGTGCTCACTGGTCCCCTTTCTATACTGCCGTTAACAGCAAAGCAGACC
TTTTCGCTCTCTCACCTTGTCTCTTTAGTCCTGTAATTGTGAGTCCATGTTAACGTGAATATTCTTAGAT
GGCCTTTTCTTCTTTACTGTCATGGCATTGTCTAGTACCATTTTCACCTGCAGTTTCTTACAAATGTAA
CCAAGTCTGAATTGTCATTTCAAGGTTATGGTTGTTTTGTTTTTTCTATAACATGTGTCATTTCTTTT
CTCATGAGCAGGATATACCATTCCTAAGCCAGATGTGATTACTTTATTGGAGCAAGAGAAAGAGCCCTGG
ATAGTAATGAGGGAAGGGACAAGGAATTGGTTCACAGGTGAGTGACAGCAAATTAGGCGGGAGGGTGCTA
TCACAAGTTATGACCCATGATGTCAGGGAGGAGGCACAGCACTGAGTTGTTTGGAAAGCTCCCTTCAAAG
GCCTGAGGCCTGTGGAAAAAGGACTGATACCTGGAAGCATTCAGATTCTCTCTACATTAGCTACCAAAG
GAACTTTACCCAATTTGCCATACTCCTTGTTTCTCTTCTCTCGTATTTCTCTCCTCTTTCAAAGTGGGGC
TGCTTTCTTTCTTCCCCATTGATGACCATTTTACGTGTGTTTCCAGGCCTCCTTTAACATTTTGATTTAT
ATTCATTTCTCCATTGTCCAAGTTTTATTCATCAAATATTTCCCATTTACCTAACCTAAGCCAGGCACTG
TGCTAGAGTTTAGGCACTACTGATAGACACTCTTGTCACAGAGATGTTGATATTATAGTAAGGGAAACAT
GTTGTCAATACGTAAACAGATAATAATCAAGTTTTCATATGTGTTGTGAAGAAAGTTAAGTAGAGTAAGG
AGCTAGAGTGTTGGGGAGTTAGTAGGGCTAATTTAGATAAGATCAGGAAAAGGCCATTTTGAGGTGATGA
TATTTGAACCAGAGACATAAAGTAAGGTCTCAGGCCATGTGAGTATTGAGGAAGAACATTACAAGCAGAA
AAAGCTGCAAGTGCAAAGGTTCTGAGATGAAGAACCATCTGTGTTTATTCCCAAAGTAAATTATGCCACC
TGATGTGAACATTCTTGTACAATTGTTTTTGTGTTCAGATGTTTTCATTTCTCTTGGGTTTTCATTTTTC
TTGGGAATATATGGAAGTGGAATTTCTGGGTCATAGGACAAGTGTATTTTCTTAATCATATTTATTGAGG
TATAATTTATATAGTATAAAATGTACTCATTTTAAGTGTCAATTTTATAACATTTTAAAACAGTTTTAT
TGACATATAATTAGCATACAATAAACTGCACACATTTAAAGTATAAAATTTGCTAAGTTGCCCTGTATAT
TGTGAAACCATTTCAAAATCAAAATAATAAACATATCCATCACCTCCAAAAGAAATCCCTCCTCATGTC
CCTCTCTACCCACTGCCCAGGTAAGCACTGATCATCTCTCTGTCACTATAACTTAGTTTTCATTTCTAG
AATTTTGTATAATGGAATTATATGGTGATTTTTTCTTCCTTTTTAAAAATATGGTGATTTTTAAAATT
TAGCTTCATTCACTCAGCAAAATTATTTTGAGATTCATCCATGTTGCTATATGTATCAGTACTTCATTTC
TTTTCATTGTTGAGTAGTATTCCATTGTATGGATGTACCACAATTTACTTATCCATTTATGTATAAGGAT

FIGURE 498 cont'd

```
GGACATTGAGTTATTTCCAGTGTTTGGCTATTACAGATAAAGCTACTGGAAACTTTCATGTAAAATTCTT
GGTATAGACTTATGCTTTCATTTATCTTGGGTAACTGTCTGGGGTAGAATGGGTAGATCATATGATAAAT
ATATGTCTATTTTTTAAGAAACTGCCACACTGTGTTTGAAAGTGGTTGTATCAGCCAGTAGCAGTGGCTT
ATGCCTGTAATCCCAGCACTTTGGGAGGCCGAGACAGGTGGATCACTGGAGGTCAGGAGTTCAAGACCAG
CCTGGCCAACAAGGTGAAACTTCATCTTTACTAAAAATACAAAAATTAGCCAGGCATAGTGACAGGCATC
TGTAATCCCAGCTACTTGGGAGGCTGAGGCAGGAGAATCACTTGAACCCTGGAGGCAGAGGTTGCAGTGA
GCCGAGATTGTGCCACTGCACTCCAGCCTGGGTGACAGACCAAGATAATGTCTGAAAAAAAAAAAAAAG
AAGAAGAAAGTGGTTGTATCTTTTTACTTTCCCAGCAGAAGTTTATGAAAATTCCAGTTCTTCGACATTC
TTGTTAGCACTTTGGTATGGTCAGTCTTTTAAATTTTAGCTTTGCTAATAGGTGAGTAATGGTATCTCAC
TGTGGTTTTAATTTTCATTTTCCTAATGCCTAATAATCCTGAGCAACTTTTTATTCTTAATTTATCATCC
ATATATCTTCTTTGGTGAAGCATCTATTACAGTCTTCTGCTCATTCTCTTTGCTTCTTTCTTTCTTTTTT
TTGAAACAGAGTCTTGCTCTGTTGCCCAGGCTGGAATGCAGTGGTGCGACCTCGGCTCACTGCAACCTCC
GCCTCCTGGGTACAAGCAATTCTCCTGCCTTAGCCTCCTGAGTAGCTGGGACCACAGGCATGTGCCACCA
TGCCCAGCTAATTTTTGTATTTTTAGTAGAGATGGGGTTTCACCACATTGGCCAGGCTGGTCTCGAACTC
CTGACCTCAGATCCACCTGCCTCAGCCTCCCAAAGTGCTGGGCTTACAGGCGTGAGCCACTATACCTGGC
CTTCTGCCCATTTTCTAATTGCATTGGTTGTTTGCTAATTATTGGGTTTTGAGAGTCCCTTATATATTCT
GGATGTAAGTCCTTTATCAAATGTATGATCTGTAAACTCTTAACAGTGTCTTCTGAATAGCATAAGCTCT
TAATTTGATTAAGTTAATTTATCACATTTTTCTCTTATGGATTGTCCTTTCAGTCATATTTAAGAAATCT
TTGCCCAATATAAAAGTACAAAAATTTTCTGTTTTCTTCTAATTTTTTTTTTTTGACAGAGTCTCGC
TCTGTCACCCAGGCTGGAGTGCAGTGGCACAATCTCGGCTCACTGCAACCTCCACCTCCGGGTTCAAGC
AATTCTTCTGCCTCAGCCTCCCGAGTAGCTAGGACTACAGGTACACGCCACCACACCCAGCTAATTTTG
TATTTTTAGTAGAGACAGGGTTTCACCATATTGGCCAGGCTGGTCTCAAACTCCTGACCTCATGATCTGC
CCACCTTAGCTTTTCAAAGTGCTGGGATTACAGGCGTGAGCCACTGCCCCAGCTTTTCTAGAAATTTTA
TGGTTTTAGATTTTTACATTTGTATACCTATTGTACACAAACTCTTCCAGAAACTTTAAGATAAGGGAAT
ACTTCCAAACTCACTCTTCAAGTCCAGCATTACCCTGATACCAAAACCAGACAAAGGCATTATAAGAAAA
GAAATCTATAAGTCAGTATCTTTCATGTACACAAATGCAAAAATTCTAGACTAAGTTTTAGCCATTTGAA
TCCAACAATTTATGAAAAGAATAGTAGTTACTGGCCATTCTTGGCATTCCTTGGCTTGCAGACGCATCAC
TGCAGTCTCTGCCTCCATCTTCATGGCACCCTCTCTTGATCTCCCTATGCCTCGCTCTTATAAGTACACC
TGTTATTGGATTTAGGGCCCACCCTTTTTCCATATTAGGTCACATTCACAGGCACTGGGAGTTAGGAACA
TGTCTTTTCTGGGGGCCACAATTCAACCTACTACATCTGAGAATAAAGGCGTTTATTTTTCTCCTTTCTA
AAGCCTGTGTTCTTCACCTTGCCTTACTCTACTAGCCAGGACCTGCAGTGTAATTCTTGACTAGCAATGA
GTTTGAGGATCTGTGAATGAGTAATGATAAAACAACTGATGCTCACCAAATAAAATATCTCAGTACTTGA
GTTGGGACAGAGACAAAGAGAAGGAACAGTAGCCACACACACAGGGCAAATGTAAACAGTTTTGGAGATG
CCTAATGTTCAAGGTAACAATAGGTAATTGGAAAATGATGAAATACAAAAATGACTTTTCCATTTATACT
TTTGATTGAGCAATTTTGGATGTATCTTTGTTCCCTTTCAGAAGGGAAGTGATCCAGGAAAGAGCATATT
TAATTGCTGTACTAGGATGAGATTGGAATCAGGGAGATATATTCATAACTATGTTGTAATTTGGGGAAAT
TAAGTTATTATACTTAGCTGCCCTCTCAGTGACTTGTTTGTAATATTTACAGAGGTGGTTTGCAGAGGTC
TTCCAAATAAGAAAGGGGTTTTTATCAATGGTAATATGTTTGGGTTTTATTCTAGGGGAACGAGAAACT
CTATTCTAAAGGGAAAAGAATTAGGTACAGATTTTCAAAATGATCTCCATCAAAGCCATTTGATGAAAAA
GATTTTAAATGCACATATCCAGGACTTGCTCCTATAGATTTTGATTTTGTCTGGTTTGGTGCCTGAAGAA
CAGTATATGTAAGAAATTTCCCTAAATCCATCCTAAATAAGCGGATCACTGATTTACCCTATTATCCTAT
TCACCTATTTTACCATTCTTTTTTTTTTTTTTGAGACAGAGTCTCGCTTTGTCACCCAGCCTGGAGTGC
AGTGGCACAATCTTGGCTCACTGCAAGCTCCACCTCCTGGGTTCACGCCATTCTCCTGCCTCAGCCTCCC
GAGTAGCTGGGACTACAGGCACCCGCCACCACGCCTGGCTAATTTTTGTATTTTTAGTAGAGACGGGGT
TTCACCATGTTAGCCGGGATGGTCTCGATCTCCTGACTTCATGATCCACCTGCCTCAGCCTCCCAAAGTG
CTGGGATTACAGGCACGAGCCACCGCACCCGGCCTATTTTACAATTCTTAAAAGTCACATCATTTTCTGA
GGTATTTTGCCTTCTTTTAAATTGCACTACAATAATTTAGAGTTCTCTAAGCCAGGAACCAGCAAACTAT
AGCCCATGAGCCAAATAGCTCACTGCCTGTTTTGCATGGCTCTTAAGTTACAACTGTTTTTCCATTTT
TTTAATGGTTGAAAAAATCAAGATTTTGTTTCATGTAAACACTTTTGAAATTTAAATTTCAGTGTCCAT
AAGTCAAGTGTTATTATAACACAGCCACACTTATTATCATCTGTGGCTACTTTTGTGCTGTAATAACAGA
GCTAAGTAATTGTGACAGAGACCATATGCCTCCCAAGGCCTAACACCTTCACTATCTGGTCTTTTAAAGA
AGAAGTTTGTTGAATCCTGCTCTAAACCATTTATTTCTAATGTATGTTATTTCTGTTTATCTTTTATTTC
TACTATGAGGTACAACCCCCATCCCTGCCCAACACAGAAAATAGCATTATAGCATTTGTTTACTCTTT
GCTTTTTTTTTTTTTTTTTGCAGATTTGGAATACAAGTATATTACCAAGAATTTGCTTTCAGAAAAG
AATGTTTGCAAAATCTATTTATCTCAATTGCAGACAGGGGAAAAAGTAAAAACACCATCCATGAGGACA
CCATTTTCAGAAATGGTTTGCAGTGTAAACATGAATTTGAGAGACAAGAGAGACATCAGATGGGATGCGT
TAGTCAAATGCTAATCCAAAAACAAATATCTCATCCTCTACATCCAAAAATTCATGCTAGAGAGAAATCA
TATGAATGTAAGGAATGTAGAAAGGCCTTTAGCAACAGTCATACCTTATTCAACATCTGAGAATTCACA
CTGGTGAGAGACCCTATAAATGTATGGAATGTGGAAAGGCCTTTTGTCGAGTGGGAGACCTTAGAGTACA
TCACACAATCCATGCTGGGGAGAGACCCTATGAATGTAAGAATGTGGGAAGGCCTTTAGACTTCATTAT
CACCTTACTGAACATCAGAGAATACATTCTGGTGTGAAACCCTACGAGTGTAAGGAATGTGGGAAAGCCT
```

FIGURE 498 cont'd

```
TTAGTCGTGTTAGAGACCTTAGAGTACATCAGACAATTCATGCTGGAGAGAGACCTTATGAATGTAAAGA
ATGTGGGAAGGCCTTTAGACTTCATTATCAACTAACTGAACATCAAAGAATTCATACTGGTGAGAGGCCT
TATGAATGTAAGGTTTGTGGCAAGACCTTTAGGGTACAACGACATATTAGTCAACATCAGAAAATTCATA
CTGGTGTCAAACCCTATAAATGTAATGAATGTGGGAAGGCCTTTAGTCATGGCTCATACCTTGTTCAACA
TCAGAAAATTCATACTGGTGAAAAACCCTACGAATGTAAAGAATGTGGTAAGTCCTTTAGTTTTCATGCA
GAACTTGCTCGACATCGTAGAATTCATACTGGTGAGAAACCCTATGAATGTAGAGAATGTGGAAAAGCCT
TTCGTCTTCAAACGGAACTTACTCGGCATCATAGAACTCATACTGGTGAGAAACCCTATGAATGTAAGGA
ATGTGGGAAGGCCTTTATTTGTGGTTATCAACTTACTTTACATCTGAGAACTCACACCGGTGAGATTCCC
TATGAATGTAAGGAATGTGGAAAAACCTTCAGTAGTCGCTATCATCTCACTCAACACTACAGAATTCATA
CTGGTGAGAAACCCTACATATGTAACGAATGTGGAAAAGCCTTTCGTCTTCAAGGAGAACTTACCCGACA
TCACAGAATTCATACATGTGAGAAACCCTATGAATGTAAGGAATGTGGGAAGGCTTTTATTCATAGCAAT
CAATTTATTTCACACCAGCGAATTCACACCAGTGAGAGCACCTACATATGTAAAGAATGTGGGAAGATTT
TTAGTCGTCGCTATAATCTTACTCAACATTTTAAAATTCATACTGGTGAAAAACCCTACATATGTAATGA
ATGTGGGAAAGCCTTTCGATTTCAAACAGAACTTACTCAGCATCACAGAATTCATACTGGTGAAAAACCC
TATAAATGTACAGAATGTGGGAAGGCCTTTATTCGTAGCACTCATCTCACGCAACATCACAGAATTCATA
CTGGTGAGAAACCCTACGAATGTACGGAATGTGGGAAGACGTTTAGTCGGCACTATCATCTTACTCAACA
TCACAGAGGCCATACTGGTGAGAAGCCCTACATATGTAATGAATGTGGGAATGCTTTTATTTGCAGTTAT
CGACTTACATTACATCAAAGAATTCACACTGGTGAGCTTCCATATGAATGTAAGGAATGTGGAAAGACCT
TTAGTCGTCGGTATCATCTTACTCAACATTTTAGACTTCATACTGGTGAGAAACCTTATAGCTGTAAAGA
ATGTGGGAATGCCTTTCGTCTTCAAGCAGAACTTACTCGACATCACATAGTTCACACGGGTGAGAAACCC
TATAAATGTAAAGAATGTGGGAAAGCCTTCAGTGTTAATTCAGAACTTACTCGACATCACAGAATTCATA
CTGGTGAAAAACCCTATCAATGTAAAGAATGTGGAAAAGCCTTTATTCGTAGTGATCAACTTACTTTACA
TCAGAGAAATCATATTAGTGAGGAAGTCCTATGCATAATGTAAAGAGAATACGATGGCCTTTAGAAAATG
CCCTTTAGCAGAGAATTTGTAATTTAAGAAATTTTCTGTTTGTTACGGAACATGTGGGAATCCCTTTTAC
TTCATGCTCACAATTTATCAGAAATTATTTCGTATGTTAAAGAGTCGAAAGACTATAGCATCACTCAGTC
CCTGTTAGACTTTAGAAGATTGATACTGATGCACTGCATCCCAAACCATCAAGGGCCTTTTCCCCTACAA
ACTGTTGTTGAACAGTGCTTCTCTAAAATGCAATAATAATGGGCCAGGTGAAGTGGCTCACACCTGTAAT
CCCAGCACTGTGGAAAGACAGGAGTTCGAAACCAGCCTGGGCAACATAGTGAGACCCTGCCTCATGGCTT
TAGTGAGCCATGATTGTGCCACTGCACTCCAGCTTGGTGACAGAGTGAGATCCTGTCTCTAAATAAATAA
ATAAAATGCGGGCCAGGCACAGTGGCTCACACCTGTAATCCCAGCACTATGGGAGGCCCAGGTGAGCAGA
TCACCTGAGGTCAGGAGTTCAAGACCAGCCTGGCCAACATGGTGAAACCCCTTCTCTACTAAAATACACA
AATTAGCTAGGCATTGTGGGGGGTGCCTGTAATCCCAGCTACTCAGGAGGCTGAGGCAGGAAAATTGCAT
GAACCTAAGTGGCAGAGGTTGCAGTGAGCTGAGATCGCACCACTGCACTCTAGCTTGGGCAACAGAGCAA
GACTCTGTCTCTTAAATAAATAAATAAATAGATTACCAGAAAAATGAAAAGAAAAAAACAGACATACAAA
ATAAAAGCCCCAGTTTTTTATTATGGTATTTAACTGAGTTAACTCTGTCAGATTGCTGCAAACATTTCTA
AATACTTGCTCTTGGTATCTATAACTTTTGCAGAGACCAGAAGCAAACAATTTGTGGGCCAGTGTCAACA
CATGGACCACACTTTATATAGCACTGTAACGGAAATGATTCTGTTAATGTAATGAACATGGGAAAGACC
AGCCTTGGCCTATCTTTATGATATATATAAATAATATAATTCTCATAATTCCACCTCTGCCTATGTGGTG
TTTGGCAAAACATGCCCCTGTGCCTTGGTTTTTAAAATGGTAATAACAGTACCACCTAATAGTATTTTTG
TGAGGATGAAATGCTAATAAAAGATAAAACCTTTAAAAGAGTATTTGGCACACAGCATTTTATCAATAAA
TATTGCTTTATTTTTTTCATTGGGGATACATTTAGTACATTCATGTGAGAGGAAGGCCCTGTGGGTGTAA
GAAATTTGTAAAAACTGTCCATTACCTTTCACTCCTTATTTAGATTGGAATAATTAACTGGAGATAATAT
CCAGTAAAATAGATTAAACTTCCATTTATAAAGTCAGAACCTATCTCTGAAAATTAATGTGAGAAAGAAA
TCTCTAGATTTGATGGGTGTGAAGATTATGAGAGTAAAGTTTTGAAGACTCAGGGATAGCTGTAATGCTT
TTTTCTTTTTATAACCCAAAAAGCAGGTATGTCAGTCGCTTTTTCTGCCCACAATGATAAATTAAAAACA
GCCACTATCCATTTGGAAAACTTAAAAGAATAATGAACAGTTATGTTCTATCTAGATTCAGCAATTGTTA
ATATGTTGTCACATTTGGTTTGCTTATACATAATATTTACATATTTTGCTGTAGTATTTGAGTATAAATT
GCAGATACTATAACACATCACATCTAAGAATAAAGGCTGCCTCCTACTTAATTGCTATATAACAATTGTC
CAACCTGTCTGTGCCCCAGGGCAGCTTTGAATGCAGTCCAACAGAAATTTGTAAGCTGTCTTAAAACATG
AGATTTTTTTTGTGATTTTTTTAAGCTCATCCGCCATTGTTAGCACATTTTATGTGTAGCCCAAGATAA
TTCTTCTTCCAGTGTAACCCAGGGAAGCCAAAAGATTTGACCCCCAGTAACTTCACACCTAAGGAGATTA
GCAATAATTCCATAATCTGTAATATTCAGTCTGTGTTCATATTCTCAGTTGTGTTCATTCTTTTCATTTG
TGTAAACAATGCTTTTCATAGGTTATTTTAAATTCAGGAACCAAATTCATGAATTACATTTGTGCATTG
TTCGTCTCTTTTAAAGTAAGAATGGCCCTTCCCCCACAACTTTATTGCAACATTGACTTTTTTTTTTT
TTTTTTTTTTTTTTGAGATGGAGTCTCTGTCGCCCAGGCTGGAGTGCAGTGGTGCGATCTTGGCTCA
CTGCAAGCTCCGCCTCCCGGGTTCAGGCAATTCTGCCTCAGCCTCCCCAGTAGCTGGGACTACAGGCGCC
TTCAACCATGCCCGGCTAATTTTTTGTATTTTTAGTAGAGACGGGGTTTCACCATGTTAGCCAGGACGGT
CTCGATCTCCTGACCTGGTGATCTGCCCGCCTCAGCCTCCCAAAGTGCTGGGATTACAGGCATGAGCCAC
CGCACCCGGCCTTCCCAAAGTATTTTTAAATGTGCTTTTTTATCCCCAGTATTTCCCATTAACTGGAATT
TGGGATTAGAGACCCAATTAGGGACAGATTAAATATTTTGGCAAGAATACTTAATGGGAGAAATTTTGTA
TTTCAATTTGTAACCCATTAGGTGGCATACAATGTCATTATACCACTATGGTATCCTTAGTTCATTCACT
```

FIGURE 498 cont'd

```
TGGTGTAGCAGAACATACATTCCAAAGATGGCCACACCAATATATCCCATTCTGCATGTTCATCTTACAA
TGTGATACCAACACTCCCCAAGAGGTAGAGCTCATGGTCCTTCCTTTTGAATCTGGCCAGGTGGGCCTGT
GTTTATGGCAGGAATAACACTGTGATTTCCACGACTAAGTCATAAAAGGCAATACAGCTTCTGCCTGACC
CACTTGGGATGAAGCCCAGCCACCATGCTATGAAGATGCCAAGTAATCACATAGAAAAGCTAAGTAAAGC
TGTCCTGATTACAGCTGTAATTGAGGTAACAGCCGGGATCCAGCACCAAGTGTATGAGGGTATGAGCCTT
CAGATGATTCTAACCCTTAGCCTTCAGGCTATCCTAGCTGGTGCTAAGTGGAGCAGAGAAAAGCTTTCCC
CCATGAGCCTGCCCAAATTGCAGATTTACGTTTAAAATATGGCCTGTTTTAAGCCACTAAGTTTTGGAGT
AGTTTGCCACACAGCGATAGGTAACTGAAATACTTGCTTCATATGGTAATCACCAGGTTTCTCTGTTGTA
GAGCTAAATATTTCTTTTAATTTAGTAAACGATCTGTAGAGTAGTACTTTGGCATTTCGGAAATTTAAAA
TCTCCAATAATATAATGACACTAGATCAAAAGAAAATGAAACCATAAAGGACAATTTAGAAATGAATGG
TAAGATCAGAATTTGTGAATGTGGCCAAACCTGTGCTCAGTGAAAAATCAGTAACCTGTTAATATATTCA
GGAAACAAATATTGAGGGCCAGCACTTTGTTTCTCCTGCTCACCACTCTACTCCCAGTGACTTAATACTG
TCTCTTTAACATAGTAATCACTTATAAAACTGTTAAAAGAATGAAGAAGCATTAAACTCAAGAAACTAAG
GGAAAATAAGTCAATATAAGAAAGAAGGGAGGATCATTAAAAGGAGTTAATGAATTTGAAAATAAAATA
GACTTATTAAGGCTTTGTGAAAAAATATTAATACTTGATTTTAGTATAGCTAATCAAAGGAAAAAGATAA
TTACAGCATTGTGAATGAGAATTGGATGTAAGTACAGATGGAGGAGATATTTTTTGTTTTATTGAAAATT
TCAAGGAGGAAGTAATATCAAAATTTCACTAGCTCTTTCTACACTGATATTATAATCCTGATAATACAAC
AGATGAGGATAGTTCTTAAAAGGCAAAAATGTAGGTGAGTCATTACGAAGAAAGCAGAAATTCTAAACCA
TCAGCACATTCATTCAAAAACCTAGTAAAGCAATTAAGCAAAATAATTTGTTTACTTGGACTGTCCAGGG
ATAGATCTGTTCTAGTTTTCCAAATTAATGATGGGAAAGGAAGAGCTGATCCAGTCCAAGTATCTTCAAG
ATCCATGTTCTCAGTTTTTCTTAGCTTTAAATGGCCAAATTGTGGCTTAGATTGGATATGATAATTTCCT
CAATGCTTAACACTGAGCACAATTTTTCACATATTTGAAATCAAGGTGTATCTTACAATTTATGGCATCT
GACAATACTTCCAACCAGGTGGCAGTCATCAAGCAGTTTTGTGAAAAGCCTTCCCGGTAAGAATACAAAA
GCATCTGCACCAAAATATATAGATTTAATGGCATGTAGGGGTTTGCGTGAATATATACAGTTGAAATTCA
ATTCTTCCTTAAAAATAATTGTAACTCATTTCTTTAAGACTACCATACTACCACTTTCCTCAACTTGGAC
TAATGTCCATTGTCAACCAAAATGTCTGTGATCTCATGGATCCATTATGATTTGCAACTCCAGGTCCATT
TTATGCAAATAAGACAGCCATAATATATCATTGTACAAGTCATTTACTATCTAATTATATCATTGCTCAA
CATTTGCAAATTATTTTTACAAATAACAATAATTGGATGTAACAAAAAGCAGAGTATTTTGAGACGTATA
TTAATGCAAAATATTGTTAATGTATCAGTGGATTGTTCCTCCAAAGTACCAGTGCCTTAACACAACATAT
CTAAAAGAACATCTCTGGGAACAGTAGTACTTAATGGCAACTTGAGAATTGGTTTGTGGGCACACAGCCT
TGTGAAGTTTTGAATACTAAATCCCTTTTTTAAAAAAGTGCTTATTATCAGGCTATCAATCAAAAGATTT
GAGTCTTTCAGTAAAGAAAATTTGCTTAATTTTATCTAGTGCATGATAAACTTTACTAAGGAAGTCTCAT
TCAGAATATCTAATATTTTGGATGTGAGCCCACACTGGAAATGCCATAACCAAAAAGAGTGACCCTAAA
GATAGAATATTCAGATCTAATGGCAGATGCTTAGCTATGCTGGGAAAGGAAGTGAATTGTATATTGCTCT
GCTGCTCACATATTCCTCTGCAATAAATTGCTGGCCCAGTTTAGTTTTTATATACTCACTACTATACTAA
TGAGGATGGCTCAATTTTTTATTTGAACGTACTATAATGAATTTAAACTTTCATTGGTATTTATGTTTTA
ACAGGTTTTCACTATTTCAAATATACTTCAATAAATATCCTTGTCTGTGATCATTGGTTTATGTGAATTG
GAATTTCAGTAGCTGTATATACATGGAAGTACAATTGCTCATACATCATACACTCTTTCAGTTATGTTAG
ATAATACTAAATCAACCATGGGTTCTGTATACCCTACTAGATATTTCCAAATTGTTCTCTTAGACTCCTG
AGAACTGGTAAATTGAGTGCTATAGCTTCAGTTTAGGTATGTTTTGTATGTATTCCTAAATTTTGACTT
AAGCCATTTTTCAAATGTATTTCTTGGCCTATCATCATTCCTTTACTTTGACTTTCATATTCTTGGCTTT
CTCCATTATTTTTGTCTTGTTTTTTTCTTCCCTCTAATTGACTTGAATGTCATTCTGGATACTTTGCTAT
GTTGATGCAGTATTTTCCACCACATGCATATAGTCTGACCATGCATTCTATCTTTATGAGACATTTTAAG
ATTTATAGGTTATCAGTTATGTAATCTTTGCAGATTACACAAATAAAATTTTATTTTCCAGTATTTATAT
TTATTTTTCTTATTGCAATAGCTAGAATCTTCAGAACACAGTTGAATATTATGGTAGTAGGTATCTTTTG
TTTCCAAATTTAATGGAATATTTCCCAACATTTTTTTCTTTGGTCCTATGTTTCCTCAAGAACCTACATT
TAATCATTTACTATAATATTCACTCTTCATTTGGGGATAAATTCTCTGCTGACTTTAAATTTCCTTCAAT
ATATGTAGGGGTAGAGGGAGGATGCCTACTTTGTAGTGATTGTTAATTTAAAAACTGCTGAATTTTTC
CAAGGCCATTTTGTTATCTATTTTAATTTTATGTTTTTCTCCTTAAATTTATTGATGTATTGATTTGTAC
TTATGACTTTATTAAATTTTAAACATTTCTTGTAATATGCTACAATTTTTGTCATACTGCTAGAGTCCAT
TTGGTGATATTTTAATTAGAACTTTTTCATCTATAGTCAAGGCAGTATTATAGTTTCTTTTTATTTTATT
GATAAGATTTTAGAGTTGTAATGATCTGTTCTTTAACACCTAGAAACAATTTGTCCTTAAAGTATTTACA
TTTTTGTATCTTGATATTACATTTTATGATTTGCTAAATTCACTTAGCTTTAGCAGGGTTTTTTGTTTTT
TTTTTTTGAGACGGAGTCTTGGTCTGTCGCCCAGGCTGGAGTGCAGTGGCGCAATCTCGGCTCACTGCAA
GCTCCGCCTCCCGGGTTCACGCCATTCTCCTGCCTCAGCCTCCCGAGTAGCTGGGACTACAGGCACGTGC
CACCACGCCTGGCTAATTTTTTGTATTTTTAGTGGAGACGGGGTTTCACTGTGTTAGCCAGGATGATCTC
GATCTCCTGACCTCGTGACCCACCCGCCTCAGCCTCCCAAAGTGCTGAGATTACAGGCGTGAGCCACCGC
GCCTGGCCTAGCAGGGTTTATTTTTATAAATTACTTAGAATTTTCTATAAACGCAATCAGGACATCTGT
CAAGACAGTTCCTTTTAATTTATATTTCCTTTATTTGCCATACTGCACAGGCTAGGGCATTCTGTAGAGT
GTTGAATGGAAATGTTCAAAGCAAGGCTGGGCGCAGTGGCTCACGCCTGTTATCCCAACACTTTGGGAGT
CTGAGGCAGTTGGATCACCTGAGGTCAGGAGTTCGAGACAAACCTGGCCAACATGGCGAAACCCCATCTC
```

FIGURE 498 cont'd

```
TACTAAAAATACAAAAATTAGCTGGGTGTGGTGGTGCACCTGTGATCCCAGCTACTCGGGAGGCTGAGGC
AGGAGAATCACTTGAACCCTGGAGGTGGAGGTTACAGTGAGCCAAGATCGTGCCACTGCACTCCAGCCTG
GGCAACAGAGCAAGACGCTGTCTTAAAAAAAAAAATTATCAGAGCAGACATCCTTACCTTGAGTCTGACT
TTAGTGAAAAAGCAGTCAATAATTTATCATAAAGTTCTATGTTAGCTGTTTATTTTCCCTAGATATTCTT
TTTGGTTTTTTGACAAATCTTGGGGCAATTTGCCATTGAAGTCATCTGAGTCAACCTTTCTTTGCGGAAA
GGATTTTTAGTGGTAGTTTCAAGGACAATATACCAAAAATATTGATTTTTCTATCATAGCAAACAATTG
AAAATGAAATCAAAAAAATTTTCATTGATAAAGAACATAAAATACTTAGGAATATATTTAACAAAACACA
TGCAAGACTACTACCTAAAAATTACACAATTTTGTTGAGAGAAGCTAGGGAAGGCCTTAATAAATTGAAA
CATCTTCCATAATTACAGATGAGAAGACCCAATGTTTAGAAGTCATTTCTCAAATTGATCTAGGGATTCA
GTGGAATCCAGTCAGAATTTGTTCTGGAGCACAGCAGTGAAGTGAGGATTGGAGGGAGCTGGTGTAGCTG
CACTTTGAGGTAGGTTCATTAGCTGTTGCAAAAGGCTGGTGATAGTCACTGTTGGAAGATGATAGAGGAG
GAGAGAGAAGGGACTCAGTAAGCATGGCAGCACCTCATCTTGTGCATCTTTCTTGATAAGGAAAGGGAGG
TCCCTGGCTGTTGTCATGAAAATGTCAGCTGCTTGCTCTGTGGAGAGGAAAGGAAGAATACGGGCAACCA
CTGTCTTCCCTTTTTGGATACACATGATCTGTACAAAGCGGTCATCACTAGGCCTCTCTTGTCCAGGCTG
TTTCCCTCTTAAGTTGTCATACATGCTACAAATTCCGTACTTTCGCTCATCCATTAGAGCAGGTCGCTGT
CTTAGACTTAGGAGATAATGTCTTTCATAGTCCTCCACATCAAGGAGTAAACTGTAGGTTTTCTTAATTA
TGACGGGTTTTTCTCCTCTTGTCTCGAATTTGTTTTTCTTTTATCTCATCATCCTCACTCCAAGATGTCA
CAACAGCATCAATCATTTTTCAGGGATTATTCACACTAGAAACAGTAAGCTTTCCCAAAGAGCCCACAAA
TTGTACTGGCTTATAGGTGCGCTCCAGTTTGGCCACTTGAGGGGTAATAAGCTTGTTATGCTCCTTTTTA
GGGCCATCACCTCGTATTTCTTCAGCAGCTGATGGTTTCTCCAGTTTTTCAAAGTAATTCTGGTAATAAA
AATCATCCAGGTGGGGACCATTGCTTTGCAGTTGCATCATCTGAATTTTAGAGGCCCAATCCTTTTCCCA
CAGCAACATGAGATTGGCATATGGATCCTTTCGGAGATGATCTTGATGACTGCTCCAGTGACTTCCTCTA
TCTCCTGCACCACTGAGATTCTGATGCTGATTTCTATTCTGTTGCTGTCTCTGATGCAAGAGTCAATGGT
GCTGTGGATGGAGGGGAGTTGCGTCCAGTCTAAACACTGGGACTTGAGATCTTAAGTTTTGCAAGTGAGG
TCCTGGGCCAGGAGGGCGCTGCTGTGGAGGTGGTGTAGCGGAGGGTGGAGCACTAAAGAAGGCATGGAAG
CCTGGTGCTGGGGAAGCATCTGCCCAACTTGCCCTTGTAGCAACTTGGGATTCATAGCAGCATGCAGAC
TACCAACAAATCCAGGGACCCATGCAAACTGGCTGGGAGACATCTGTCCAGGCTGTAGCTGTGCTCCTCC
AAGAAGCTGTGCTCTCTGAAAGGGGCTGAGAACAGGAGGAACACTAGGAGGAAAAGGGTGACCCAGGAGG
GAAGAGTTCAGGACACTGTAGAGCTGATTTGGAGGCATCCTCTCATCATAGGGACCAGGATAACACGGTG
GCATTGGGGGCCGAACATGGACAGGCTTTGAACGCAGAATCTTCCAAATTGGCTTTCGTTTTCAGTTGCT
GGTTTCAGGCGGAGGAAAGTCTATGGAATAGGACTGCACAGGCTCTGTTGGGTAAAGCTGGGTACGGCCA
TCTGCTTAGGTGGGGTGCCTATGGGACAGCTCTAACAGGAGGACTGCCAATGACAGGTGAAGTTGACCA.
CCTTGGTAATGCATGTTCAGAAAGGTCCCAATCATTTTCTGGACCCTGGGGGGCCTCTGAGGCAAGGCAT
ATTCTAATACAGACACTGTAGACATTTCCTAAGTGAGCAGTGGTCCTCAGATTTGCCTCATAACTTTGA
TCCATCCCAGATACTGGAATTCAGATTTCCTGGTTGGGGTTATAAAACTGGCCTGGTCTGCACTGCCCTC
ATGATAGCTGGATCTTCTAGTTCATTTTCAATCACCATCTTACTGAGCCTTTCTGCCAGATTTTCCTCAT
GGTCACCCAACAAGTCCATTTCTTCCCTTTCTCCATTGCCTGTTTGTTCATTAACTGCCACTGGTAGCTT
TTCTTCCAATTCAGCCAGGCACTCATGTGCTTCCTGCCAATCATCATCAACTGCACCTGACCCAAAAATA
TCATCATTGAATTGATCAATCTCTTCATCTTCTTCTCTCAGTCCCTGAAATTCATCTTCATCTTCATCCA
GAAGACAATCCTCCCAAGACTCATAGTGGAACATTCTTGGGGAGGTGGGGGGGAGTGGGGAGGGGAGTGG
GGGAGGGAGGGAAGAAGCACTGACTCCCTGGGCTCCTCCATGGGCAGGTCCTCCACCAGCTTGCGACCCC
TGGCCACCTATTTCTGTTTCTTTTTTTGTTCCTATGAATTCTAGTTACTATCATGTATCATTTCCTTACT
CCAATACAACTCTGCTGTCATTTACTTCCTTTATGCTGTTATTGTCAAATATATTACATTTCCATGTTAT
AGGCCCAACAATATAATTATGTACATACTGTATTATACAACTGCCTTTTAAATTTATTAAGAGAAGTAAA
AAGAAATGTGCATTTGTGCTGCTTTTTGTAATTTTAATTATATTAATTTTGTTCTTTTTAAAAATGTGGT
TTTGAATTTCCATGTAGATTTACTTGCTTTGTTTGAATAACCTTTACAATTTCTTATGTGGTAGGTCTGG
GAAGGGCTTTATTTCACCTTCATTTTTGAAAGACAGTGTGTTACTGCTTGACAGAGCTTTTGTCGTTTGA
GTACTTTGAATATATCATCCCACTACCTTCATCCCCTCCATTGCTTTGGATAAGAAGTCAGCTGTCAATC
GATTGGTGTTCCATTGTAAGCGACACATCATTTTTCTCTTATATTTTTCAACATTTTCTTTCACTTTTAG
CATTTCTACTATGATAGGTCTGTTCATGGATATCTTCGCATTCATTCTGATTACAGTTTGTTGAGATGCT
TGTGGGTATTGATTAATGTTTATTCAACAAATTGTGGATGTATTTGCCATTATTTCTTTGAATATTTTT
GTGCTCATTTCTCTTTCTCCTTTCCTTCTGGTATTCTCATTACATGTATGTTCATGCACTTAAAAGTGCT
CTGTTCATATTTCTTGTTCTTCAAGGCTCTGTTCATATTTCTTGTTCTATTTTCTCATTCTATTTCA
TTTTATTTTCTTATTCTTTTTCTAGTGGGAAGATGGAATTGAGGTTGCATAATTTCCATTGATCTGTTT
GAAAGTTTTCTATTTACTTGCTGATCAAATTTGTTAGCCCTTCTAATGAATTTTTTATTTTGGTTACTG
TAGTCTTCAACTCCAGAACTTACATTTGGTTCATTTTGTCATTTCTCCTTATTGATTTTCTTTATTTGAT
GAGACGTTATCTTTATATTTTCCTTTACTGCTGTGAATATATAATGGCTACATCGAAGTTTTTGTCTATT
AAATATGACATCTGTTCCCTGTCATAGGCCAACCTGTTGCCGTTTTTTTTGTTGTTGTTGTTTTGT
TTTGTTTTTTTTAAGAGTCTTGCTCTGTTGCCCAGGCTGGAGTGTAGTGGTGTGATCTTGGCTCACTGC
AACCTCTCCCTCCTGAATTCAAGCGATTCTCGTGTCTTAGCCTAGTTATAGGCATGTGCTACCATGCCTG
CCTAATTTTTGTATTTTTAGTAGAGATGGGATTTCATCATGTAGTCCAGGCTGGTCTCAAAACTCCTGAG
```

FIGURE 498 cont'd

```
CTCAAGTGATCTGCCAACCTTGGTCTCCAAAAGTGCTGGGATTACAGGTGTGACCCACTGCACCTGGCCT
GCTTGCTGTTCTCCTGTGTATAGGTCCAACTTTCCCATTTGTTTGCATGTCTTAATTTACTTTTTATTAT
TTTCCTAATAAGTAGACATATTAGGAAACATACTGTAGTGATTTGCCTGTCCCCTCTCCAGAGCTTGTTC
TTGTTGTTGTTTGCTTGGCTATGTATTTTGTGTTTTGGCTAAGCTATTTTAGTAAAATCGATTTCCCTTT
CCCCTTGCAGTGTGAAGTATTTTGTGTTGTTCCTCAGCCTTAAACATATGCAGTTACCCTGCTGTGACAA
TGGTTTTAAACAGGAGTCTTTTTGACTATCTTTCCCTATCTCTCTGTTAAGATAACTGCCCCCTTGGTAT
TATTTCCAGCCCACTAAGCTCCGCTGCCGTCTATCTGGTCACTCCATTGTTTTCAACATTTCCTTGGAGC
CTAAATTATTAAGCAGTTTAATATAATTTAAGTCAGGCAGGGCTAATTTTTGAGGCCAGTTTTTAAGGTT
TCTTTTGACCTTTGGAGGGCTCCTTAGCTGTCTCTTCCCATGAATTATCTGATTAACTACCTGGCCTAT
GGTTTATGTTGTTGTGTTTACTTTAGGGGAGCTATTTGTTTGACACTGTTTCAGATAAAGTCCATTCCTT
TGGAGAGAGCTTCAGAGCTCTATTCTTATGGACTGCCACTCCCTCTGGACAAAATCTCTGAACCACCATT
CTGGGTAATGGGCTGGGTTGTAGCCATCTTGTTTTTTATGTTATGAAACCTCTGCCTTAGAAGCAAGTGG
AGGCAAGGGCAATCTGGGTGCAAATGAGTTCACTCTGCCTGGGTAGAGTTTCCAAACTCTGGGTGGGGCT
GGGGGAAGCAAAGGAGCCCCAAACCTCCTAGTTGCGTTCACCAGGAATTTAGCCACTTTAACCAAGAGCT
GGTGGGGATAAGAAACCCTGGAGGCATGCCCCTCCTGTTGATATATGACAAACCTTGATTGACAGCTGCA
GCCCCATCATCTTGGCAGCATCCACCCACAGAGAAGCTTCTATCAAATTGAGCTGTGAAGAGTAAAAGGG
AGTTGTGTCTTAAATGCCACAAATTCTCTTACCAAGTTCTTGGTTCTTACCAAGTTTTAGTAGAATTTCT
TGATATTTCACTTCCTATATACTGTTTGGACACTTTCAGACCTCAAATGGCAAGGTTTTTATACATTTTT
TTTTGCCAGTTTTATTAGAAAATGAGTTTGCAGAGCCCCCCCATCTACCATCCAGAAGTGGAACTACATA
TAGTCATTTAACAATAGTTTAGCATTTTCTGTCATCTCATTCTGGAGAATCATAGATGTGGCAGAAATAC
ATATTCTTGAAGAAAAAAATGTCTCCCTTATGGGTACTGTGATTTCAATAGGGTGTGGGATAAGTACAT
GACAACATGCATGGGATAGACACTCTGTTCTCTACAGATCCGTGCTTTGGAATTACAGAACATAAAAGAT
ATAATGATGGTTATTACTTTTTACATGTGACAATCTAGTTGTAGCGTTTAAGATTAAATTTGGTTGTGAG
TAAAATAGTAAAACTGCCCCAAATTAAAGTGGATAAAATATAATAAAAGTTAATTTCTCTGTCATATAAT
ATGGATGTAAGCCTGATACTGTGGCCTTGCTCTAAACCAATCATGAATTTTACCATTCTGGCATCAGAAT
GGAATGAGCACTCAGACTTATACAGAACTTGGAAGAATAGTAAATAATTCTGGTTACCCTTCACCCAGAT
TTCTCAAATATTAATATATTAAGCTAGTTTGTTTTAAGAGGTTTCCAGAATTGCCAAAATATTCACTTAC
ATCCTACTTGCCATAAGTTATGTCACATGACAACACCTTGGAGAAATAACTGCAGTCCTTATTCTAGATA
GTCACAGCCAACTATCAATAAAAATTACTGGTTCTATAATCATGAAAGCAGGGTAGAATGGATATGCGGG
CCTAATAAATAACAGATCCTGACCCACTGAGGAATCCTGGAGATGGTTTCATTTTGATCAATTACAAATG
AAGACAGTGAATCCCTGAGACCACAACTTGTGCAGAAGACTCATTGAAATGGAATGGTATTCTGGAAATT
AAGACACACAGGTCCGTTATCCCTCATACCCCAAGCTGGATGATCACAATACCCTGTAAAGGATGACAG
AAATCTTGTGTCTACTTTTTCTTCTTTTCTGGGGAGTCTATGAACATTCAAGATAACATCCATGACTGAA
TATTCTAAAACAAGTTTCTTTACAACGCTGCTCAGAAACACCATGACAAATTTAAATCAGAGCAATATCT
CCAAAAATGGGAGGCAGATTAATGTATCATTTCAGCCAGGCCTTAAAAGGAGATAAACTTCTCAGCTATC
ACCATACATAAAACATAATTCAATAAAATACCAAATGCAAACAAGAGCAGATCATAGAAATGTAAGTTGA
GAAAATTCAGAGGGAACTTCTGACCTTAGGATGACATTTTCAACTCTGAAACTATTAAAAGAATTCTAAC
AAAAGCAGCATCTTTTTTTCCATACCTGTAACTGCCATGTGCACTCACAGCAGCCAGATTTTTTGGTCTC
TAATTCTTTTTTCCTCTAAAAGGAACCAGGACTCCCTAAGATAAGAGGGTATTAAATCATGAGTTGATTC
CATGACTCAGGACAAGAGGCATGGGGACATGAACCAACAAACAGGGTCAGTCTTAAACATCCTCTTACG
GCCTGAAAACAATATTCCTTTAAAACATCAAAAGAAAAAATAAGTAGTAAAAAAAAAATGTAAATGGAT
TCCTACTGGCCACATTATGTCAATTTGAGCATAAATAATAATAATTACTACAGGTGCTTCTCAACTTACG
GGGAGTTATGTCCAAATAAACCCATCATAAATTGAAAACATCATACACCATATGTGCATTTATGGTCTAC
AATATTTTCAATTTAACAATGGGTTTATCTAGATATAGCCCCATTTTAAGTCAAGGAGCATACTCTGACT
GAGTATGTCTTAGTTTTGTGTTGCTATAAAGGAATGTCTGAGGTTGGGTTATTAATAAAGAAAGAGGTTT
ATTTGGCTCAGTGTTCTGTAGGATTTACAAGAATCATGGTGCAACATCTGCTTCTGGTAAGGGCCTCAGG
CTGCTTCCACTCATGGCAGATGAAAGGGGGCAGTGTATGCAGACATCACATGGCAAGAGAGGAAGCAAGA
GGGTGAGGAAGGAGGTGCCAGGCTCTTTTGTACAACCAGCTCTCATAGGAACTAACAGAGTGATAATTCA
CCCCCCAATCCAGAGAGGACATTAATTTATTCATGAGGGATCTTCTCCCATGACCCACACACCTCCCATT
AGGCCCCACCTCCAACATTGGGATCAAACTTCAATATGAGATTTGGAGGGATAAATATCCAAACTATAG
CAGCATATCACTTTTGTACTATTATAAAGCTGAAAATTATAAGTCAAACCATTTTAAGTTGGGGATTACA
GGCGTGAGCCACCGTGCCTGGCCGTGATTTTAAATTTGTACATACTTGGTTTGTAACTTTAACAAATAT
ATTAAAGTGTTTTATTATGTTTGCAAAGGGACTCTGACTTCCAACATAGTACTGCCATGATTGCATGATG
ATAGAGTTTCACCGAAAGGCTGCCAGGGATCTTTCTGACAACTCTTAATGATACTACCGGGATGTGCAAT
GACCCAGAAAGGAGTTGTGCTAGGTTAATACCCAGGGACTCTGCTGATTTCAAAGAAGAAAGTTCAAGAG
AATGGATAGAAAAAGATGAAACTGGAAATAAAAAATAGGAACATAAGATTTGAAAGCCAAGTTTTATAT
AATCTTGTTTTATAAGTTGTATAACATCATTGCAATATCAATACCTGAAAAATACTTGGAAAATTATAAC
TTTACTTATGATTATAGATGCAATTAAATGGTAAAAGATAGAATTAAGTAGTCTATTGAAAGAATAATCA
TCTGACCAGGGTATATTCATAAAAAGAAGAAAGCTATCAATATAAATTATCACTTTATAGATTTTTCAAC
ACAATGGAATAAAATCACAAAGGATTATTCTTAATCTTAAAAAAAATTTAATCTAATTCATGATGCCACA
TCGGTATCATGTTTTGTTTTGGGGTTTTTTTGAGATGAAGTCTCACTTTGTCGCCCAGGCTGGAGTGCAG
```

FIGURE 498 cont'd

```
TGGCACGATCTTGGCTCACTGCCACCTCCACCTTCCAATTTCGAGTGATTCTCCTGCCTCAGCCTCCCAA
GTAGCTGGGATTACAGGAATGCACCACCATGTCCAGCTAATTTTTTATTTTTAGGAGAGATGGAGTTTT
GCCATGTTGGCCAAGTTGGTCTCAAACTCCTGACCTCAGGTGATCTGCCCACCTTGGCCTCCCAAAGTGC
TGGGATTACAGGCATGAGGCCACTGCTCCCGGCTTAATGGTATCATGTTTTACAGCTTGATTTAAAGGGT
TAATATTTTTTCAAATTTTTATCAACAGCTCATGTACCAGCCATGGTATAGGTGCTGGTGATAAATGCTG
AACAAAAAGAGGTTCCGGACAATCTTGGCTCCCTATACAATCCAAAGGGTGCCAGTTTTGTACTGAGTA
CAGTGTCAGCCATATCACACAAGTTGAATTATGTTGACGCTTTAATGGCATTCATTTCTAATAGTCTAT
TTCAATTTTCATTTTGTATTCAATCCAGGGCTTAAGTACACGTGACTATAACTTTTCAGAGATGACAACG
TCTCTCCATAGATTACTTACCCACTACAAACTAAATCTTTACAATGGACTTACGGCGGTTACCAGCTTAC
CCAAATGATCATCCTTAGTTTCACTAATGCAAGGACCTGTACTTAAATGTTTTCTGACAGTACAATATGA
CATAGAAATAACCTACAAAGTATTCTTCCCCAAAACGTTTAATCTAGACCTAAGAAAGCCTCTGGACTTA
CTTTCCCTTGTAAAGAAAATACAACCAAGAACAAGGCTAAATGACACTATAAAGAAAGAAATCTAAACAC
ATAGCCAACAACATTTCTGGGCTACTCAAAATTCAATGTCATTTTTTAAAATGAGAAATGTTCTAGACC
AGTGGCTCTCTAACTCTGGTTGGTATCACAGACACAAAACCTGGAGAAATAATAAAAAACAGAGGCCCAG
GCTTATAAACTAGGGCTACACTTCTGTAGGTTTACTAAGTTCCACAGGGGATTCTGATACCCACCATAAT
TTGAGAGCATACTTTCATGGGGTTTCCATGCTACAATACACTAAAGAGAGATAACCAAATGCAATGCAGA
ATCTGCAATGGACTCTCCTTAGAAAATGAATAGCTGTAGGCCAGGCATGCTGGCTCATGCCTGTAATCCC
AGCACTTTGGGAGGCCAAGGCGGGTGGATCACGAGGTCAGGAGATCGAGACCATCCTGGCTAACAGAGTG
AAACCCTGTCTCTACTAAAAATACAAAAAATTAGCTGGGCATGGTGGCGGGTGCCTCTAGTCCCAGCTAC
TCAGGAGGCTGAGGCGGGAGAATGGCGTGAACCCAGGAGGCAGAGCTTGCAGTGAGCCCAGATCGCACCA
CTGCACTCCAGTCTGGGCGACAGAGCGAGACTCCATCTCAAAAAAAAAAAAAAAAAAGAGAAATGAAT
AGCTGTAAAAGATGGTTTGCAGGCCAAGGAAGAAATCTGAAGATGGAATGATATTACAGAATTATGAATA
TTTTCCTTAAGGGTAATTATGGTACTATGGTTATATGATATTGTCTTTATGTTTGGGTAACACACATGCT
GATGTAACAAGGAGTAAAGTGTCATGATATCTAAAACTTATTCTCAATGGTCTAAAACTTATTCTCAATG
GTACAACAAATATACAAAAAATAAATGTGGCAAATTGTTAACAATTTTGAATCTAGGTGGGGGGGATATG
TGTATATATTTTACTATTCTTTCAAAACCCACAACAATTATCAACTAGGTTCACCATCTTTTATGGGCAG
GATTTGTGGTATCCCCAAACAATTACACTAGTAACAATTACACTAGTAATCAAAAAACACTGGTCACAGA
TCACCATAACAGATTTAACAATGAAAAGTTTGAAATATTATGAAAACTAGCAAAGTGTGACACAAAGAC
ATGAAATGTGCATATGCTGTTTGGAAAATGGTGCTGATAGACTTATTCACTGCAAGGTTGCTGCAAACCT
TCAGTGTGTATAAAATGCAGTAACTGCAATGCACAATTAAGCAAGGTACGCCTGTATCCAGTAAAATATT
TCACGGGCAGTAAACTGTGAACATGGCAGCTACTCTACATTCCTCACATCAGTAACTTTCTCACCAAAAT
TATCTTCTCTGAACTCTAAGGCATTTAGTGTGGCTATAAAATATCCCACATTCTTTACACTCAAAGGAGT
TCTCAGCAGTATGAATACTCTGATGTTGAGCAAATCCCAGGCCACGATGAAAGTTCTTCACACATTCTTT
TATGTTCACAGGATTTCTCATCAATATGAATTCTCTGGTGTTGAGTAAATTTTTCATACACAGTGAAGGC
TTGTCTACACTCCTTATATTCATAAAACTTCTAACTATAATGAATTTTCTGATGTTGCGTAAGCAGATCA
TTCACAGTAAGGGTTTGCTCACATTCTTTACATTCATAGGGTTTCATGCCAGTATGAATTCTGTGATGTG
CAGAAAGGACTGAACTAAGTCTAAAGGTCTTCCCACATCCTTTACATTCACAGGGTTGCTCACCAGTATG
AATTTTAACATGTTGAACAAGGCTCGAGCTACAAGTAAAGGTCTTTCCACATTCTTTACATTCATACGGT
TCATACCAGTATGAATTCTTTGATGTGCAGTAAAGACTAAGCTAAATCCAAAAGTTTTCCACATTCTTTA
CACTCACAGGGTTTCTCAGCAGTACGGATTCTCAGATGTACAGTAAGATCATAATTACTGCTAAAGGCCT
TTTCACATTCCTTACATTCATAGGGTTTCTCATCAGTATGAATTTTAACATGTTTAACAGGTTTGAACTA
TGACTAAAGGCTTTCCCACATTCTTCACATTGATATGGTTTCTCACCAGTATGAATTCTCTGATGTACTC
TAAGGTTTCTACCACTGGTAAAGCATTTCCCACATCCTTGACATTCATAAGGGTTCTCACGAATATGAAA
TCTATAATGTCCATGAAATTGGTAATGATATTGAAAGGCCTTCCCACATTCCTTACATTCAAAGGTTTTC
ACCCAAGTATGAATTTTCTGATGTTCAGTAAGTTGCTACTGATGTCTGAAGGCTGTCCCACATTTCTTAC
ATTCAAAGGGTTTCTCACCTGTACAAGTTTTTGATGCAGAGAAAGTTGTAGGTGAAGTCTAAAAGCCTTC
CCACACTCCTTACATTCATAGGGTTTCTCACCAGTATGAATACTCTGAGGTTGAACAAGGTTTGAGCCAC
GATTAAAGGCCTTCCCACACTCCTTACATTTAAATGGCTTCTCACCAGTATGAATGATCTGATGTTGAGC
AAGCTGTGTCAGAAGACCAAAGGCCTTTCCGCATTCTTTACATTCAAAGGGTTTCTCACCAGTATGAATT
CGGTAATGTTCAGTAAGCTGGTAATGATATCTAAAGGTCTTCCTACACTCCTTACATACAAAGGGTTTCG
CACTGGAATGAGTTTTCTGATGCTGAATAAGGTTTGAAACACGACTAAAGCCTTTCCCACACTCCTTACA
TTCATATGGTTTTACACCAGCATGAATACTCTGATGTTGAACAAGGTTTGAGACACGATTAAAGGACTTC
CCACATTCTTTACATTTAAATGGCTTCTCACCTGTGTGAATGTTCTTATGGTGATTAAGCTGGGTGTGAA
GACTGAAGGCCTTGCCACATTCCTTACATTCAAAGGCTTCTCACCAGTATGAAATTTCTGATGTCGAAT
AAGGTGCATATGTCGAAAGGCTTTCCCACATTCCTTACATTCAAAGGGTTTCTTTCCGGTATGAATA
CTTCGATGTTGATTAAGATTTGAACCACGACGAAAGAATTTCCCACATTCCTTACATTCAAAGGGTTTCT
CACCTGTATGAGTTTTCTCATGTTGAGAAAGTTGTAGGTGAAGTCTAAAAGCCTTCCCACACTCCTTACA
TTCATAGGGCTTCTCACCAGTGTGAATACTCTGATGTTGAACAAGGTTCGAGCCACGATTGAAGGCCTTC
CCACAGTCTTTACATTCAAATGGTTTCTCACCAGTATGAATGTTCTTATGTCGAGCAAGCTGTGTCAGAA
GACTAAAGGCCTTTCCACATTCTTTACATTCAAAGGGTTTCCCACCAGTATGAATTTGGCAATGTTGAAT
AAGTTGGTAATGATATCGAAAGGCCATCTCACATTCCCTACATACAAAGGGTTTCTCATTGGAATGAATT
```

FIGURE 498 cont'd

```
TTTTGATGCTGAATAAGATTTGCACCACGATTAAAGCCTTTCCCACACTCCTTACATTCATATGGTTTTA
CATCAGCATGAATACTCTGGTGTTGAATAAGGTTTGAACTACGATTAAAGGACTTCCCACATTCTTTACA
TTCAAATGGTTTTTCACCTGTGTGAATATTCTTATGGCGATTAAGCTGATTGAGGAGACTAAAGGCCTTC
CCGCATTCCCTGCATTCAAAGGGCTTCTCACCCATATGAATCTTCTGATGTCGAACAAGCTTTGTCAGAA
GAGTAAAGGCCTTTCTGCATTCTTTACATTCAAAGGGTTTCTCGCCAGTATGAATTCGGCAATGTTCAAT
GAGTTGGTAATGATATCGAAAGGCCATCTCACATTCCCTACATACAAAGGGTTTCTCATTGGAATGAATT
TTTTGATGCTGAATAAGATTTGAACCACGATTAAAGGCTTTCCCACACTCCTTACATTGATATGGTTTTA
CACCAGCATGAATACTTTGATGCTGAGTAAGGTTTGAGCTACGATTAAAAGACTTCCCACATTCCTTACA
TTCAAACAGTTTCTTAACTGTGTGAATGTTCTTATGGCGATTAAGCTGGGTGGGAAGATTAAAGGCTTTT
CCACATTCCTTACATTCAAAAGTTTTCTCACCAGTATGAAATTTCTGATGTCGAGTAAGTTGTATGTGAA
GTTGAAAGGCTTTCCCACATTCTTTGCATTTATAGGGTTTCTCTCCAGTATGAATACTCTGATGCTGAAT
AAGATTTGAACCACAACTAAAGTATTTCCCACATTCCTTACATTCATATGGTTTATGTGTATTATGAATA
GGAGAAGCATGAGTATAAGCAGGCATTTCTTCATAGCTGATGATCTTCTGGTTGATATATCCTTCTTGAT
GTCCCTGTCGTCCCTCAAATCTACTTCTATATTCTGAGTCATTTCTAAAATAAAAGGCCTCGAGGCCAAG
TGTTTTACTTATTTGCTTTATAACATGTTTGGGTAAATTTATTTCAAAAATATCATTTTCTGGAGATATT
TTCTCAGGTCCATATTTTGACTCCAAATCTGAAAGAAATGAAGAAGGCAAACCTATTTTATTTTCCTATA
ACATACATGCATACAAAATCCATTAAACAAATGGCCTAAGTATAAAATATAATACTTTCAGGGAAGGGAT
CTGAAAAAGGAAAAGGGTGCCAATAATGAATTTATGTAAGATGGTGGTGTGCATAAGGGAACAGGTTAAC
TTTGTCAAATTTAGGTGTGAATCAAAACCATTTGGTAAGATTAAATATATTGATATTCAAGCAACTCAGA
TGTACAGAATCAGAATTTTTAGTGAAGAAAGCTTTTTTTTTTTTTAAGACGAAGTTTCACTCTTGTCG
CCCAGGCTGCAGTGCAATGGCACAATCTCAGCTCACTGCACCCTCTACCTCCTGGGTTCAAGTGATTCTC
TGGCCTCAGCCTCAGCCTCCAGAGTAGCTGGGATTACAAACATCTGCCACCGTGCCTGGCTAATTTTGGT
ATTTTTAGTAGAGACGAGGTTTCACAATGTTGGCCAGGCTGGTCTGGAATGCCTAACATCAGGTGATCCA
CCCACCCTGGCCTCCCAAAGTGCTGGGATTACAGGTGTGAGCCATTGTGCCTGGCCTCTATTTTTTTTTT
TTTTTTTAAGAGACAGGGTCTCTCTCTGTTGCATAGGCTATAGTGCAATGGCATGATCACAGCTCACTG
CAGCCTCAAACTCCCAGGCTCAAGCAATCCTCCTGCCTAAGCCTCCCAAGTGGCTACAGCTACAGGCACA
TGCCACTAAGTCTGGACAATTTCTTTTTCTTTAGTCTTCCTGCAGTCCAAAGTCTGGCTAATTTTTACTT
TATTTTTATTTTTACTTTGTAGAGATGGTGTCCCACCATGTTACCCAAGCTGGTCTTGAACTCCTGGCAT
CAAGCAATCCTCCTGCCTTGATCTCCCAACATGCTGTGATCACCAGTGGGAGCCATCACACCCAGCCAAA
GCTGTATTTTTAATATCTCTACCAGATGATTCTGATTCAGATCAAAGTTTACAGATCATACTTAAAACTG
GTTTTGAATGGTTTATCTTTAGTCTTAGCACAAAATCCAAAAACCTTAACACAGAGAACAAAACTTCCTA
TCAGGGCACTGTCCTCCTTTGTGGCTGATCTCTAACCACTCCCTCCTTTTAGCAACCAGAACATGATATA
ACCTTTCTCTTATCTTCTTGCTTGCTTAGACTGCTTCATCTTCCAAGAATCGTCTGGCTTTGCTCTTTGT
AACAAACATCCAACTCCTCTCTTTTTTTTTTTCTGTTTTATATATATATATTTTTTTAATTTTTATTATTATT
ATACTTTAAATTTTAGGGTACATGTGCACAATGTGCAGGTTTGTTACATATGTATACATGTGCCATGTTG
GTGTGCTGCACCCATTAACTCGTCATTTAGCATTAGGTATATCTCCTAATGCTATCCCTCCCCACCTCCT
CCCACCCCACAACATTCCCCGGAGTGTGATGTTCCCCTTCCTGTGTCCATATGTTCTCATTGTTCAATTC
CCACCTATGAGTCAGAACATGTGGTGTTTGGTTTTTTGTCCTTGTGATAGTTTGCTGAGAATGATGGTTT
CCAGTTTCATCCATGTCCCTACAAAGGACATGAACTCATCATTTTTTATGGCTGCATAGTATTCCATGGT
GTATATGTGCCACATTTTCTTAATCCAGTCTATCATTGTTGGACATTTGGGTTGGTTCCAAGACTTTGCT
ATTGTGAATAGTGCCGCAATAAACATACGTGTGCATGTCTTTATAGCAGCATGATTTATAATCCTTTA
GGTATATACACAGTAATGGGATGGCTGGGTCAAATGGTATTTCTAGTTCTAGATCCCTGAGGAATCGCCA
CACTGCCTTCCACAATGGTTGAACTAGTTTACAGTCCCACCAACAGTGTAAAAGTGTTCCTATTTCTCCA
CATCCTCTCCAGCACCTGTTGTTTCCTGACTTTTTAATGATCGCCATTCTAACTGGTGTGAGATGGTATC
TCATTGTGGTTTTGATTTGCATTTCTCTGATGGCCAGTGATGATGAGCATTTTTTCATGTGTTTTTTGGC
TGCATAAATGTCTTCTTTTGAGAAGCGTCTGTTCACATCCTTCGCCCACTTTTTGATGGGGTTGTTTTTT
TCTTGTAAATTTGTTTGAGTTCATTGTAGATTCTGGATATTAGCCCTTTGTCAGATGAGTAGGTTGTGAA
AATTTTCTCCCATTTTGTAGGTTGCCTGTTCACTCTGATGGTAGTTTCTTTTGCTGTGCAGAAGCTCTTT
AGTTTAATTAGATCCCATTTGTCAATTTTGGCTTTTGTTGCCATTGCTTTGGTGTTTTAGACATAAAGT
CCTTGCCCATGCCTATGTCCTGAATGGTATTGCCCAGGTTTTCTTCTAGGGTTTTATGGTTTTAGGTCT
AACATGTAAGTCTTTAATCCATCTTGAATTAATTTTTGTATAAGGTGTAAGGAAGGGATCCAGTTTCAGC
TTTCTACATATGGCTAGCCAGTTTTCCCAGCACCATTTATTAAATAGGGAATCCTTTCCCCATTGCTTGT
TTTTGTCAGGTTTGTCAAAGATCAGATAGTTGTAGATAGGCAGCATTATTTCTGAGGGCTCTGCTCTGTT
CCATTGATCTATATCTCTGTTTTGGTAACAGTACCATGCTGTTTTGGTTACTGTAGCCTTGTAGTATAGT
TTGAAGTCAGGTAGTGTGATGCCTCCGGCTTTGTTCTTTTGGCTTAGGATTGACTTGGTGATGCGGGCTC
TTTTTTGGTTCCATATGAACTTTAAAGTAGTTTTTTCCAATTCTGTGAAGAAAGTCATTGGTAGCTTGAT
GGGGATGGCATTGAATCTATAAATTACCTTGGGCAGTATGGCCATTTTCATGATATTGATTCTTCCTACC
CATGAGCATGGAATGTTCTTCCATTTGTTTGTATCCTCTTTATTTCCTTGAGCAGTGGTTTGTAGTTCT
CCTTGAAGAGGTCCTTCACATCCCTTGTAAGTTGGATTCCCAGGTATTTTATTCTCTGAAGCAATTGTGA
ATGGGAGTTCACTCATAATTTGGCTCTCTGTTGGTCTGTTATTGGTGTATAAGAATGCTTGTGATTTTTG
TACATTGATTTTGTATCCTGAAACTTTGCTGAAGTTGCTTATCAGCTTAAGGAGATTTTGGGCTGAGACA
```

FIGURE 498 cont'd

```
ATGGGGTTTTCTAGATATACAATCATGTCATCTGCAAACAGGGACAATTTGACTTCCTCTTTTCCTAATT
GAATACCCTTTATTTCCTTCTCCTGCCTAATTGCCCTGGCCAGAACTTCCAACACTATGTTGAACAGGAG
TGGTGAGAGAGGGCATCCCTGTCTTGTGCCAGTTTTCAAAGGGAATGCTTCCAGTTTTTGCCCATTCAGT
ATGATATTGGCTGTGGGTTTGTCATAGATAGCTCTTATTATTTTGAGATACATCCCATCAATACCTCATT
TATTGAGAGTTTTTAGCATGAATTTTGTTGAATTTTGTCAAAGGCCTTTTCTGCATCTATTGAGATAATC
ATGTGGTTTTTGTCTTTGGTTCTGTTTATATGCTGGATTACATTTATTGATTTGCATATGTTGAACCAGC
CTTGCATCCCAGGGATGAAGCCCACTTGATCATGGTGGAAAAGCTTTTTGATGTGCTGCTGGATTCGGTT
TGCCAGTATTTTATTGAGGATTTTTGCATCAATGTTCATGAAGGATATTCGTCTAAAATTCTCTTTTTTC
GTTGTGTCTCTGCCCAGCTTTGGTATCAGGATGATGCTGGCCTCAAAAAATGAGTTAGGGAGGATTCCCT
CTTTTTCTATTGATTGGAATAGTTTCAGAAGGAATGGTACCAGCTCCTCCTTTTACCTCTGGTAGAATTC
GGCTGTGAATCCATCTGGTCCTGGATCTTTTTTGGTTGGTAAGCTATTGATTATTGCCACAATTTCAGAG
CCTGTTATTGGTCTATTCAGAGATTCAACTTCTTCCTGGTTTAGTCTTGGGAGGGTGTATGTGTCGAGGA
ATTTATCCATTTCTTCTAGATTTTCTAGTTTATTTGTGTAGAGGTGTTTGTAGTATTCTCTGATGGTAGT
TTGTATTTCTGTGGGATTGGTGGTGATATCCCCTTTATCATTTTTATTGCATCTATTTGATTCTTCTCT
CTTTTCTTCTTTATTAGTCTTGCTAATGGTCTTTCAATTTTGTTGATCTTTTCAAAAGACCAGCTCCTGG
ATTCATTAATTTTTGAAGGGTTTTTTGTGTCTCTATTTCCTTCAGTTCTGCTCTGATTTTAGTTATTTC
TTGCCTTCTGCTAGCTTTTGAATGTGCTTGCTCTTGCTTTTCTAGTTAATTGTGATGTTAGGGTGTCAAT
TTTGGATCTTTCCTGCTTTCTCTTGTGAGCATTTAGTACCATAAATTTCCCTCTACATACTGCTTTGAAT
GTGTCCCAGAGATTCTGGTATGTTGTGTCTTTGTTCTTGTTGGTTTCAAAGAACATCTTTATTTCTGCCT
TCATTTCGTTATGTACCCAGTAGTCACTCAGGAGCAGGTTGTTCAGTTTCCATGTAGTTGAGTGGTTTTG
AGTGAGTTTCTTAATCCTGAGTTCTGGTTTGATTGCCCTGTGGTCTGAGAGACAGTTTGTTATAATTTCT
GTTCTTTTACATTTGCTGAGGAGTGCTTTACTTCCAACTATGTGGTCAATTTTGGAATAGGTGTGGTGTG
GTGCTGAAAAGAATGTATATTCTGTTGATTTGGGGTGGAGAGTTCTGTAGATATCTATTAGGTCTGCTTG
GTGCAGAGCTGAGTTCAATTTCTGGGTATCCTTGTTAACTTTCTGTCTCGTTGATCTGTCTGATGTTGAC
AGTGGGGTGTTAAAGTCTCCCATTATTATTGTGTGGCAGTCTAAGTCTCTTTGTAGGTCACTCAGGACTT
GCTTTATGAATCTGGGTGCTCCTGTATTGGGTGCATATATATTTAGGATAGTTAGCGCTTCTTGTTGAAT
TGATCCCTTTACCATTATGTAATGGCCTTCTTTGTCTCTTTTGATCTTTGTTGGTTTAAAGTCTGTTTTA
TCAGAGACTAGGATTGCAACCCCTGCCTTTTTTGTTTTCCATTTTCTTGGTAGATCTTCCTCCATCCCT
TTATTTTGAGCCTATGTGTGTCTCTGCATGTGAGGTGGGTTTCCTGAATACAGCACACTGATGGGTCTTG
ACTCTTTATCCAATTTGCCAGTCTGTGTCTTTAATTGGAGAATTTAGCCCATTTACATTTAAAGTTAAT
ATTGTTATGTGTGAATTTGGTCCTGTAATTATGATGTTAGCTGGTTATTTTGCTCATTACTTGATGCAGT
TTCTTCCTAGCCTTGATGGTCTTTACATTTGGCATGTTTTTGCAGTGGCTGGCACCGGTTGTTCCTTTC
CATGTTTAGTGCTTCCTTCAGGAGCTCTTTTAGGGCAGGCCTGGTGGTGACAAAATCCCTCAACATTTGC
TTGTCTATAAAGGATTTTATTTCTCCTTCACTTATGAAACTTAGTTTGGCTGGAATGAAATTCTGGGTTG
AAAATTCTTTCAAGAATGTTGAATATTGGCCCCCACTCTCTTCTGGCTTGTAGAGTTTCTGCCAAGAGAT
CCGCTGTTAGTTTGATGGGCTTCCCTTTGTGGGTAACCCGACCTTACTCTCTGGCTGCCCTTAACGTTTT
TTCCTTCATTTCAACTTTGGTGAATCTGACAATTATGTGTCTTGGAGTTGCTCTTCTCGAGGAGTATCTT
TGTGGCATTCTCTGTATTTCCTGAATCTGAATGTTGGCCTGCCTTGCTGGATTGGGGAAGTTCTCCTGGA
TAATATCCTGCAGAGTGTTTTCCAACTTGGTTCCATTCTCTCCGTCACTTTCAGGTACACCAATGAGACG
TAGATTTGGTCTTTTCACATAGTCCCATATTTCTTGGAGGCTTTGTTCATTTCTTTTTATTCTTTTTTCT
CTAAACTTCTCTTCTCACTTCATTTCATTCATTTTGTCTTCCATCACTGATACCCTTTCTTCCAGTTGAT
CGCATCAGCTCCTGAGGCTTCTGCATTCTTCATGTAGTTCTCGAGCCTTGGCTTTCAGCTCCATCAGCTC
CTTTAAGGACTTCTCTGCATTGGTTATTCTAGTTATCCATTCGTCTAATTTTTTTCATAGTTTTTAACT
TTTTTGCCATTGGTTTGAATTTCCTCCTGTAGCTCGGAGTAGTTTGATTGTCTGAAGACTTCTTCTCTCA
ACTTGTCAAAGTCATTCTCTGTCCAGCTTTGTTCCATTGCTGGTGAGGAGCTGCATTCCTTTGGAGGAGG
AGAGGCACTCTGCTTTTTAGAGTTTCCAGTTTTTCTGCTCTGTTTTTTCCCCATCTTTGTGGTTTTATCT
ACTTTTGGTCTTTGATGATGGTGACGTACAGATGGGTTTTGGTGTGGATGTCCTTTCTGTTTGTTAGTT
TTCCTTCTAACAGACAGGACCCTCAGCTGCAGGTCTGTTGGAGTTTGCTAGAGGTCCACTCCAGACCCTG
TTTGCCTGGGTATCAGCAGCAGTGGCTGCAGAACAGTGGTGGCTGTAGAACAGTGGATATTGGTGACCCG
CAAATGCTGCTGCCTGATCGTTCCTCTGGAAGTTTTGTCTCAGAGGAGTACCCGGCCGTGTGAGGTGTCA
GTCTGCCCCTACTGGGGGTTGCCTCCCAGTTAGGCTGCTCGGGGGTCAGGGAAACACTTGAGGAGGCAGT
CTGCCTGTTCTCAGATCTCCAGCTGCGTGCTGGGAGAACCACTCCTCTCTTCAAAGCTGTCAGACAGGGA
CATTTAAGTCTGCAGAGGTTACTGCTGTCTTTTGCCCTGCCCCAGAGGTGGAGCCTACAGAGGCAGGC
AGTCCTCCTTGAGCTGTGGTGGGCTCCACCCAGTTTGAGCTCCCGGCTGCTTTGTTTACCTAATCCTGG
GCAATGGCAGGCGCCCCTCCTCCAGCCTTGCTGCCACCTTGCAGTTTGATCTCAAGACAGTTGTGCTAGC
AATCAGTGAGACTCTGTGGGCATAGGACCCTCCGAGCCATGTGCGGGATATAATCTCCTGGTGTGCCGTT
TTTTAAGCCCATTGGAAAAGCACAATATTAGAGTGGGAGTGACCCGATTTTCCAGGTGCCATCTGTCACC
CCTTTCTTTGACTAGGAAAGGGAACTCCCTGACCCCTTGCACTTCCCGAGTGAGGCAATGCCTCGCCCTG
CTTTGGCTTGCACACAGTGCGCTGCACCCACTGTCCTGCATGCACTGTCTGGCACTCCCTAGTGAGATGA
ACCCGGTACCTCAGATGGAAATGCAGAAATCACCCATCTTCTGCATCGCTCATGCTGGGAGCTGTACACC
GGAGCTGTTCCTATTCGGCCATCTTGGTTCCACCCCTCTAACTCATCTTTTAAGCCTTAGGATAAATGTT
```

FIGURE 498 cont'd

```
TTCCTCAGAACATCTGAATGAATGAATAAAGCCACCGTAACATATGGGACATCATAAAACAACAAAATAT
TTGAATTTTTGAGGTCCTAGAGACAAAGAGAAAACATAAAGGATAGAAAATCTATTTAATGAAATAATAG
CAGGAAACTTTCCAACTCTAGTAAGAGATGCAGACATCTTGATACAGGAAGCTCAGAGATACCCAAATAG
ATACAATACAAAAAGGTCTTCTCCATGGCATATTATGGTCAAAATATAAAAGTCAAAGACAAAAGAGAAT
ACTAAAAACAGCAAGAGAAAAGCATCTAGTCACTTACAAGGAAACTCTCATCAGCCTAACAGCAGATTTC
TCAACAGAGAGAAATGAGAGAGAATGTGATTATACATTCAGTGTTGAAAGAAAAAAATCACCAGTCAAGG
ACACTATCCTCAGCAAAGTATTCTACAAAAATGAAAAGAAATAGTCTTTCCCAGACAGCAAAAGGTGAC
AGAATTCATCACCACTGGACCAACCCTACAAGATATGTTCAAGAGTCCTACACCTAGAAGTGAAGGACA
ATATCTACCATTGTGAAAACACACAAAAGTATAAAACCTACTGACACAGCAAACATACAAATAAGGACAA
AGGACTCAAATGTTACCCCTAAAGAAAACAACCAAACCACCAATGATAAAAAATAAAAGAGAAAGGAACAA
AGGATAAACAAAACAACTAGAAATCAATTAATAAAATGATAAGAATCAGCCCTCACATATCAGTAATCAC
ACTGAACGTCAATGGATTAAACTTCATTTAAAAGATACAGACGGGCTGAATGGATGAAAAACATGATCC
AACTATAAGCTGCCTACAAGAAACTCTTCTCACTGGTAAAGACACATATGGATTGAAAGTAAAAGAACAG
GAAAAGATATTCCATACAAATGGAAACCAAAAGTGAGTAGAAATAGCTACGTTTATATCAGAAAAAAACA
GATTTTAAGTAAAAAACAGCAAAAAGAGACAAAGAAGGTCATCATATAATGATAAAGGGATCAATTCAGC
AAGAGAATATAACAATTCTAAACATATAACACCAACACCAGAACACCCAGATATATAAGGCAAATATTAT
TAGAGCAAAAGGGAGAGAGATACTACAGTATAATAATCACTGGGGACGTCACTGTGCCACTCTCAGAATT
AGATCATCTAGAGAGAAATTAACAAAGAAACATTGGGTTTAAACATACCTGAGAGGATGAGGGAAAAAG
GGAACTCTTATATACTGTTGGTGGGATATAAATTAGTACAATCACTATGGAAAACAGCATGCAGATTTCT
CAAAAACCTGAAAATAGAACTACCATATGATCCAACAATCCCACTACTGGGTATTAATCCAAAGGAAGAT
AAAATCAGTATATCAAATGATACCTGCACTTGTATGATTACTGTAGCATTATTCAAAATACCAAAGGTA
TGGAATCAACCTAAGTGTCCCCCAACAGACAAACAGATAAAGAAAATGTGATATATACACATGGAATACT
ATTCAGGCATTTAAAAAATGAAATCATGTCATTTGCAGCAACATGGAGGGAATCGGAGGTCAGAAAGACA
AATATCAGACTGGGCGCAGTGGCTCACACCTGTAATCCCAGCACTTTGGGAAGCCGAGGTGGGTGAATCA
CCTGAGGTCAGGAATTTGAGACCAGCCTGGCCAATGTGGTGAAACCCTGTCTCTATTAAAAATACAAAAA
TTAGCCAGGCGTGGTGGCAGGCACCTGTAATCCCAGTTACTCTAGAGGCTGAGGCAGGAGAATTGCTTGA
ACCCAGGAGGTGGAGGTTGCAGTGGGCCAAGATCGCACCACTGCACTCCAGCCTGGGCGACAAGAATGAG
ACTCCAACTCAAAAAAAGAAAGACAAATATCATATGTTCTCATTCATATCTGGAGGCTAAAAAAGATC
TCACAGAGGTAAAGAATAGAATGATAGAAACCAGAGGCTGGGAAGGGTGTGTGGGTGAGGGGTGGGGAT
GAAGAGGAGTTGGTTAATGTTACAAACATACAGTTAAATATGAGGAATGACTTCTAATGTTCATAAGCAG
AGTAGAGTGACTCTAATTAACAACAATGTATTGTATATTTCAAAATAGCTAGAAGACTTGAAATGTTCCT
ATCAGAAAGAAATGATAAACCCTCCTCTGGTGGATCTGATGGATACCTCAAATACCCTGACACTTGTTCA
TTACACCTTCTATGCATGGAACAAAACATAACATGTATCCCATAAATATGTACAAATATTGGGTATCAAT
TAAAAATGAATAAATAACTCTTGAAGAACTTCCCACATTCCTCACAACGACAGTCAAAACCCTGTATGAT
ACGACTCCGACGTAACTCTCAGACCTTTCTTCCCGCTGTTCCATTACTTACTCCACCTTTGTGTTTCCTG
CTCAGTCTGACTAGAGTACTTGAACACTTACTTCACATCTCTATGCAAGCAAGCCCACTTCCAGACAGGT
ACCCTAAGCACCCAAGTGCTGCCATTCTCACCCCATCACTCCTATTTCCTTGTCTCTATAGCATGATTAT
TTGGTATTCCTTATCTATTCATTTGCTTACTTGTTTGAGGCATGTCTCACCAACTGCTGGTAAAGTCCAT
GACAGCAGTGACTTTCTCAGTCTTGTTCATTACCTGTACATTACAGTATTGACCAGAGCCAAGCATATGC
CTTCTAGGAATGCGCACTCTATACATATTTACTGAACATGAATACATTTCTTAGTGAAAACACATGTAGA
AATCTAAATGCAAAAGCAGAGTTGGAAAGTAGCTGGATCCAAAATACGTGTTAAAAGTTTACACTGGGGG
CCAGAAGCATTGGCTCATGCCTGTAATTTCAGCTACTTAGGAGGTTGAGGCAGGAAGACTACTTGAGGCC
AAGAGTTCAAGATCAGCTGGGCAACATAGCAAGATGCTGCCTCTTAAAAAATAATTTTAAAAACTGTTT
AAAGTTTACACTGGGAAAGAAAGAGGAAGCTCACTTCATTAAAAGAGGAAGAAAATAACAGAAATTAGGT
GATTAGTAAATGATGAAGTTCCTTGGGGACAGCTCCTACAGTGATCTTATTTCCTTCCCAGGTCTTGGGC
ATTTTTGTCCAGTGGGGGACCTTGGGTTATTGAAGAAAGTTTTCCAAACCACATCTCAGGGGTGTGACTC
CTCTCTGAGCACATGGCTGTCCGGACAATGATGGCTTCCCCCTGCCTGCTTTACTCTCACTTACCTGG
ATACCATCTGCTTGTTTCTTTACTTACAACAATCCAGGGCTCTTTCTCTTGCTCTAGTAATGTAATCACA
TCTGGCTTAGAAATGGAACTTCCTGCTTAAAAGAAATAACACATGTAGAATTTTTTAATATAAAATTT
TTTTTAAACCCTGAGACCTAGTTAAACTTATAATAAATTACAAGCCAAAACAATATTGAGAAGAGACTCC
AGATAAGAGAGGATTGAGTAAGGGATCAACTATGTTTAAAAAAAAAAAAAAGCACTTTCATTTAAACTCAT
AATAGAAACTTATCCCTCAAGAGGAGGTATAATTTAGTGGTTAACAGCAGGAAACTTCAAGCCAGATTAC
CTGGTTGAAATCCTGTCTCTGCCACCCACTAGTACTTTGACATTAAGTAAGTCACTTGAACTCTCTGTCC
TTCAGTTTTCCCAACTCTAAAACAGAAATATAATAATGCCTGTTTTATAGGATTGATACTAATATTAAAT
AAGGTAATATATGTAAAATACTTCTAACTCTCACTCATACGTAGTAGCACAAAGTTAAAAATTATTATGT
TTATTGTCATTATTTATTTTGCATCCTTAGACATTTACAGCTCATTTTAAGAATTTTCACCCAACAGAAA
AGCATACACTTCATGGCCTGAAACTTTCAACTACAAAACAAGTAACGGAAGGTCTGTCGAAGGAAATGGA
ATATACTGACTTAGTGCTAAATAAGTTCTGTCAACCCAATCAGTATATGTAAATCATTGAGGCTCTGTTT
TGTTTTGTTTTTTTGAGACAGTGTCTTGCTCTGTTGCCCAGGCTGAAGTACAGTGGCATGACCACGGCTC
TCTGCAGCCTTGACCTCCCAGGTTCAAGCAATCATAGAGGCTCTTTTAATAGAAAAACTCAACACACTCT
TCTCCTTACAGGTGGGCCAGAAAAACAAAAACAAACAAAGAAAATCTACAGTAATTCTGAGATCAAACAT
```

FIGURE 498 cont'd

AATATGAAACCTGGTTCTTGAACAATATCATTCAACGAATATACAAGATTTCAAATTCAGCCCCATGGTC
ATGAAGAGAGAGAGGGGATTACAGAGATGACCAGCATAATGGAGGAGGCCCTGGTGCAGTAGGCAAGATG
CAGAGGCTCCAAGGAGGTGCCTGTTTTCAACCCAACAAATCTCAATCCATTCCTTCGGGAATAAGAAGAA
GGAATCCAACTACCTCTTAAAAGACAGCCCTGAAACTCATGATGAAGAAAGCTGATATTCCAGAGAACAG
ATACAAAAATAACTGGGACCAATGACCTTACCCAGTGATATCAGGTGGCTGTAGTTCTCCAACATCACAT
CCCTGTACAAGGTCCTCTGATCAGGCTGCAGGCACTCCCACTCCTCCTGAGAGAAGTCAATGGCCACATC
CCTGAATGTCACTGATCCCTGAAACCACAAACACATGGATTATGGTGAAATTGAAGAAAGTTGTTTCAAG
ACGAAAGGAGAGGAAGTGAAGGATTAAACTGCAATAAAGGAGCAATATGGAAAATCGCAGAGTGCCTACA
CATTCTTCAAGAATCCTGCTGCTGGCCTGGTGTGGTGGCTCATGCCTGTTATACCAGCACTTTGGGAGAC
CAAGGTGGAAGGACTGCTTGAGCCCAGGAGTTGGCAAACAGCCTGGGCAACATAACGAGATGCACTCCCT
GGAAAAAAAAAAAAAGAAAGAAAGAAAGAACTGTCGTGGTGGCATGTGCCTATAGTCCCAGCTACTTGG
GAAGCTGAGGTGGGAGTATTGCTTGAGCCTGGGAGTTCAATGCTGCAGCGAAGTGTGATGGCACTACTGC
ACTCCAGCCTGGGCTACAGAGTGAGACCCTATCTCAAAAAAAAAAAAAAAAAAAAAAAAAAGGTGGCAGC
ATACAATTGAGGAATGCCGTTAATCCTCAAGCTTACTGTGGTATCAGATGATAGCAAAAGTATTTTTTCT
TGTCATGACAAATGATTTTTATAAGCTGCGTAAAATTCAAAATAACTGACATATTAGATTTAGTCATATT
TTTCTATTTATACATTTAAGATGGTCAGAGTCTCTAAGGTTTTCCCAAATTCAGAGAATCTGTAATCACC
TACCACTCATGCCCTGAATAATCTCTGTTACTGCCCACTGTCCTCACTGATCACTTTCCTAAAAGCCTCA
TAAAGCAGAACACCTTGTCACGCTTGCAGACTGAGGCCACTCACTATGGAATTCTACCTCAGCTACCTAG
AAAGCTCCAGTCTGTGGAGGAGTTTCAAGGTGTTCCCGAGTGTGGTCAAATGCGACAATCATCTGTAACT
TATCAAACCCACAAGACCATGTTTCCCTGTGGGACCAACTCCTCCACTGTTCCAACATTCTTTCTGACC
AAGGACTGAGTTAAGCACAGACTGAATAACCTGCTCAAAGAAAACATCAAAGCCAGTGGGAAAACAGAGG
TACGAATAGGAAGAGCACTGACTTTTATTTTTTGGTCACCAAACTTCACTGTAATGGGACAAAGTGGGGT
GTAAGATTGTGGATCCTGGCCAGGCACAGTGGCTCACGCCTGTAATCCCAGCACTGTGGGAGGCCAAGGC
AGGGGGATCATGAGGTCAGGAGATCGAGACCATCCTGGCTAATATGGTGAAATCCCATCTCTACCAAAAA
TACAAAAAATTAGCCAGGCGTGCTGGTGGGTGCCTGTAGTCCCAGCTACTCGGGAGTCTGAGGCAGGAGA
ATTGCTTGAACCTGGGAGGCGGAAGTTGCAATGAGCCAAGATCGCACCACTGCATTCCAGCCTGGGTGAC
AGAGCAAGACTCCGTCTCAAAAAAAAAAAAAAAAAAAAAAAAAATCGTGGATCCTTACGTAAGAAGGTT
CAGGTTTAATAATAACAGTCACCTAACCTAACCTGAAAGTCACCATATTTCAAGAAGACAGAAACACCAA
CTTACATGGACCATGTTTCTAGAATTACAAAATTGGTCAATCTTCCTCGGGCTTCTCCCCTGGAAAACAA
CAACAACAAAAAGGCCCTAAGTCAAGCTGTGTCCGAAAGCACTAGAACGAATAAATATTTTATCCTCCAT
TCCTATTTCTCAACTACTCCTGCTCACACGCACACTTCCACCCTTCTCCCGTCACTCCCTTTTTCCCTAC
ACACACTCTCACAAATAAACTGGCAGTGAACAGGTGGAGTGTGGATGAAACCAAGCTCTCGCCTACATCC
CAGGGAACCTGCGGCGGAAGCATGAATGCCGAGCACAGGCATTTCTGCCTTGAAGTTGTGGCTTCCAGCC
AGTCCTCCACTCTTGGGATACCAATCTTGGCCTAGGACTGGGCCTCTGATCCTGCTGTAAGCAATCCTCC
TCCCCTAGTCCACCTTTCAGAGCTGAGAAGGGCTTGCATCATCCAATCCAGAACCTCTTTGTGAACTCAG
GATTGGGTGCAGTGGGGCAAGGCATGAGAACTGGAAAGGATATAGACAGAATTGCATGGGCAGTGTTCAG
CATTCTGAGTTCACCAAAAGCCAGCTGGGGTAAGTACAGTTCAGAATAGCCATGTAATAGAATACAAAGT
AATCATTAATTGTTCCAGACATATGATTAACAGAAAAATCAGGTTACAAAGCAGGATAAACAATACGATT
ACATTTGTAAAATATATGTATATAGAAATATTAAGCAAAAGACTAATAGACATCAATACAAAAATTTAGA
CAGGTATATGCATGCTAACAGTGCTTATCTCTGTATTGTAGCCCCAATTTTCTTCTTTTTGCTAAAGAGT
ATGTCATAATTGTGACTATGCCCAGGCATTTAACTTAGAATATATAATTTATATTCACACACACACACACA
CACACATATATACACACATATACACATGTGTATGTATCTATATATGTACATATTTAAATGTACATACACA
TTTTTTTTCTTGCGAGGAAATTGTTCTCCAAATTAGATGAAAGACATCTTTTATTTAGACATTTTCCTTT
CAACGTGGGGACAAAAAAAGGAAACTCTACTGAGCTCTTGTTTTATGTAATAAATTTGTTTCCATTATT
TCCCAATTCTTGACCAACACTAAGATGTCTATGTTTTCTATGTATGTTAGTACAATTTCTAAAAAAAAT
TGTCTACAAGTCTTCAACTAATTTCTTGTATGCATTAATGATGGTCATATTTCTACATCCGAATTCAAAA
ATAAAAATAAAACAGAGTTAACAGAGAGTGAGTACTTTTAATCATAAAAAACAAAAAACTGTGCCTGTCA
TGAGGATCAAAAAGATTAATGTGACTATAACAAATAACATCAGCTAGTTCTGACATCCTTTAGCTGTATC
TCACCAATATAATTAGACATTTTCATTATCAAGACTCTTCTCTGAATGAACACAATGCAGATAAGTGGCA
TCTGGAAACTACATGAGAAAATCTGTGGAATGTACATCACCATGCTTGGTTCCCTTCTTCACCAAATAAC
TCATTAAAATATCATTTTGGATACAATTCCTACAGAATGCCTTACAAAAACCCTATCTTAGTATATGGGA
TTCATATACATGTAACATTTTCTTGAGTATCATTGTTCATAGCATGAATACTGCTTAATGGTATATCAAA
TATTTTTCTTTTCATAATTCTTTATAGACATCATTTTATTAGCTGCATAATACTTTATCACTTGAGTCTA
GTATAATTTGCTTAGTGATTTCCATATTACAGGACACTTGATTTATATAAGATCATTTACAGTGTCATTC
CAGGTATCACAATCTTTTGATTCTAGACTAAGGTTTTTCACCCTAGGCACTAATGACATATTGTGCTGTA
TAATCCTTTGTTGGGGCTATAGGGAGGGTTATCCTGTGCACGGTACAATGTTCAGCAGTATCCCTGACCT
CTATCCACTAGATCTAAGTAGCACCTCCCCCATGGTGTGACAACCAAAAGTTTTTAAACATCACCCCCGC
TGAGAATCAATGTTCTATCTAGATCAATGGATCCAAACCTCATGGGTCACATACAGTTTTGATAGTCTTA
TGAAATGATATACTATTTCTCCCTCTAAAACCCACATTGATAAATTTCCATAGTACTTCAATACATTATT
TCAAGAGCTTTGTGGTCCCCAAGACCATACGTGGAGTTACAAGAACTCAGATTAAGAATTTCAGTCCTAC
ATTCTTGACAAAAATAGAAAAAAAAAAATCCTAAAATGTGCATAGAACCACAAAAGACCCAAATAGCCAA

FIGURE 498 cont'd

AGCAGTCTGGAGCAAAAAGAACAAAGTTGGAGGCATCAAACTACCTGACTTCAATATATACTACAAAGCT
ATAGTAACCAAAACAGCATGATACTGACATAAAAACAGACACCTAGACAAACGGAACAGAATAGAGAGCC
CCAGAATAAATCCATATGTTTACAACCAACTGATTTTTGAGACAGGTGCCAAGAACATACAATAAGGAAA
AGACAGTCTCTTCAATACATACTGTTGTGAAAACTGGGGAGTCATACACAGAAGAATGAAATTAGACCCT
TTTCTCAAACCATTATACAAAAATCAACTCTAAATGGATTAAAGATTTAAATGTAAGATCCCAAACTATG
AAACAAATAGAAAAAAACGTACGGGGAAAGCTTCATGACATTGATCTGGGCAATAATTTTTTTTTCTAGA
AATGACTTCAAAAGCACAGGCAATAAAAGCAAACATAGACAAATGAAATTACATCAAGCTAAAAAAGCTT
CTGCACAGCAAAGTGAAGAGACTACCTACAGAATGAGAGAAAATATTTGCAGTCATGTATCTAATAAGGG
GTTAATATCCAAAACGTGTGAGGAACTCAACAGCAAGAAAACAACCCAATTAAAAAATGGGCAAAGGACC
TGATAAACACATCTCAAAAGACGACATATAAATGGCTACAGTATATGAAAAAATACTCAACATTACTAAT
CATCAGGGAAATGAAAATTAAACCTACAATAAGATATCACCTCATATGTGTTGGGGTGGCTATTGAAAAG
ACATAAGTTAACAAATGTTGGTGAGAATGTAGAGAAATGTGAACCATTGCACACTGTTGGTGAGAATGTA
AAGTGACACAGACATTATGGAAAACAGCATGGAGGTTCCTCAAAAAATTAGAAATAGAACCACCATATGA
TCCAGCAATCTACTACTGGATATTTATCCAAAGGAAATGAAATCTGTATACCAAAGAGACACCTGCACAC
CCATGTTTATTGCAGCACTATTCACAATAGCCAAGATATGGAATCAATCTAACTGTCTATCAATGAATGG
ATAAAGAAATGTGGTATATATGCAGGTATATATACACAATGGAAAACTAGCCATAAAAAAAGGGAAATG
CTGTCATTCGCAACAACATGGATGAACCTGGAGAAATTCATATTAAGTAAGCCAAGCACAGAAAGGCAGA
TGATCTCACTCATCAGTGGAATCTGAAAAATGTTCATATAGGCCAGGTGCGGTGGCTCACACTTGTAATC
CCAGCACTTTCGAAAGCGGAGGCGAAGGCCGAGGCAGGCGGATCACCTAAGGTCCAGAGTTCGAGACCAC
CCTGGCCAACATGGCAAAACCCTGTCTCTACTAAAAATACAAAAATAAGCTGGGTGTGGTGGCATGCACC
TGTAGTCCCAGCTACTCGGAAGGCTGGGGCAGGAGAATTACTTGAACCCGGGAGGCAGAGGTTGCAGTGA
ACCGAGATCACGCCACTGCACTCCAGCCTGGGCAACAGAGTAAGACACTCTCTCAAAAAAGAAAACA
CTTGATATCATAGAATTAGAGAAGAGAATGGTGTTTACAGGTCGGGGGTAATGTGGGTGAGGGAGGGAAG
ATGGTGTTGGCTGGGGAAATGTTGGTCAAAGGATATAAAATTTCAGGAAGATAAGAGAAATAAGCTCAAG
AAATCTATTACACAACAACGTATCTACTATTAATAACTACTATTAATAACTATTCTGTAGTGCTAAGAGA
GTGGATATTAAGTGTTCTCACCACAAAAATGATAACTATGTGAGGTAATGCATTGCTAATTAGCTAGATT
TAGTCATTCCACAATGTACATATACTATAAAACATCATGTTGCACACGATAAATACATACAATTTTATCT
GTCAATTTAAAAAGAACTTCTGTCCTAGATCATTTGAGCAACTCACTCATTTTCTTACTATGCAAGCAGC
AATCACAATGAATCACATATTCCCAATGCTCCTGTCCTATAGAAAGTCAAGGGAAATGACCTAAAATGAC
CACACGAAAACAAAAGCTAAAACATTAAACATTTATTATTATATGCCTAGCACTGCTCTAAGAGGTTTTA
GAGTATTAATTCATTCTAATGTTCATTACAAGCCTGAGAAGACCAGAAACGGACAGAACAAACATTCCAA
CCCAGATACTCTGGATCCACTCCCCTATTCTTAACCGCAACAGCGTACTGCCTCTCACAGTTCACACAAA
TAGCCCAAAATGCAACCGGAACTGCCGAATCTCACAGAGATCTGGCAAGTATTACAATTATCATCTCATG
GACTCTCCCGAAAAATCCTGACTCTGGTTGATACCAATTTCTGTGCAATCACTTTCCGATTCCTGAAAGC
CTCACAGACGAATGGAAATCACCCAACCATCTCCATTCTTCCCTACTTGGAAAAGGAGGCCTGTAAAGAG
TCAGAAACCTGGCGTGTGATTCCACAAACTAATCTTCTTTTCAAAGCAGAGTCTAAAATAAAGCTTTAAT
ATAAACCTCTGGAGGACTATTTTTATACCAGCTTAGAAGAAGAGAGCGTACAGGAAGGTGTGAACGATTT
GCCAAATGGCTCTGTGAATATTAAATGGCAAGGTGGGGAGCGGGCGGGTGGGAACGGCTCGCTGGGAG
GCGGCACAATGGGAGGGGGCAAGAATCAATTTGCATATTCTCCTGAAATTCACTAAAAATTTACAGGAAC
CTCTATATTCTAAAATCAAAAACGCATTTCTTGAACAAATACAAAGCACAAACTCACCCTTGACTTAAGT
GTGCAACAATAACGCTCTCATCCTCCTCTCGGTCCTTCTTTTGGATAATAATACGACTGGAGAAGGATAC
GGCAAGCGTGAGACTCCAGGCTTTTCTTGGAGCGCAGACTAAGTTTGAAAGCACCCTCCATGGCCACAAC
TTCCCTCACTTCGTACGAAATGAGAAGGAAATAAAAGGAGGAGGAATCGGTCTGAGTTCGAAGCTGGTTC
CTGGGGACAGATCTCTGAGGGACGCTGGGTTCTCAACATGTAGCTGCCCTCCTGGGGGACCCTCAAGAGG
CACTTCCAGCTCTCATATTCCCACCCCGAGTCCAGATCTGCGCCTTCTTGTGCAAAGCT

FIGURE 499
SEQ ID NO: 491
Genbank ID        : BF512871
Unigene ID(#167)  : Hs.193522
Unigene name      :    Transcribed sequence with moderate similarity to
protein  sp:P39188   (H.sapiens)  ALU1_HUMAN  Alu  subfamily  J  sequence
contamination warning entry
>gi|11598050|gb|BF512871.1|BF512871 UI-H-BW1-amu-h-08-0-UI.s1 NCI_CGAP_Sub7 Hom
o sapiens cDNA clone IMAGE:3071462 3', mRNA sequence
TTTTTTTTTTTTTTTTCCATACTGTAGTTTTTGAATTTTCAGTCATTCCTGCGCTTGGCACCCAGTATG
CACTCAAGCAAATGTCAGCAATACAAATGAATCCAGGACTTTTGACTCCTAATTCAGAGACTCTCCAACT
CTGCCCGAATTCTGGAAGACTTGCATTAATTACAATAATTATGGAACTATTTTGGAGCTCTACTTTTGAA
GCTGCTTTCGGAGCCTGTTTATAAACCACAAAGAAAGTCAGTCTTATTAAAACTGTCAAACTTCATTAAT

FIGURE 499 cont'd

```
GACCCAACCTGAAAATCCATAACAATATCTAAACATAGTTTTTTTTTTTTTTTTTAAAGAAAATCTCCA
AACACATCGAGTGCTATATGTTAAATACCTAAAGCTTTTAGTATGTCAGTCATACCTCAATAAGGTGGTT
TGGGGGAAAAAGAAAGCACAAATCGACATTCAGAGGATGGTGAAATGCTCCCATGAAGACAACCAAGCAA
ATATACCATATACACCTTCGTAATTCATGATCTCTGTACTC
```

FIGURE 500
SEQ ID NO: 492
Genbank ID        : NM_018492.1
Unigene ID(#167)  : Hs.104741
Unigene name      :       T-LAK cell-originated protein kinase       TOPK
>gi|8923876|ref|NM_018492.1|   Homo   sapiens   PDZ-binding   kinase;   T-cell
originated
 protein kinase (TOPK), mRNA

```
GCCGGGCGTATGTGTTGGTGCTAGAGGCAGCTGCAGGGTCTCGCTGGGGGCCGCTCGGGACCAATTTTGA
AGAGGTACTTGGCCACGNCTTATTTTCACCTCCGACCTTTTCCTTCCAGGCGGTGAGACTCTGGACTKAG
AGTGGCTTTTCACAATGGAAGGGATCAGTAATTTCAAGACACCAAGCAAATTATCAGAAAAAAAGAAATC
TGTATTATGTTCAACTCCAACTATAAATATCCCGGCCTCTCCGTTTATGCAGAAGCTTGGCTTTGGTACT
GGGGTAAATGTGTACCTAATGAAAAGATCTCCAAGAGGTTTGTCTCATTCTCCTTGGGCTGTAAAAAAGA
TTAATCCTATATGTAATGATCATTATCGAAGTGTGTATCAAAAGAGACTAATGGATGAAGCTAAGATTTT
GAAAAGCCTTCATCATCCAAACATTGTTGGTTATCGYGCTTTTACTGAAGCCAGTGATGGCAGTCTGTGT
CTTGCTATGGAATATGGAGGTGAAAAGTCTCTAAATGACTTAATAGAAGAACGATATAAAGCCAGCCAAG
ATCCTTTTCCAGCAGCCATAATTTTAAAAGTTGCTTTGAATATGGCAAGAGGGTTAAAGTATCTGCACCA
AGAAAAGAAACTGCTTCATGGAGACATAAAGTCTTCAAATGTTGTAATTAAAGGCGATTTTGAAACAATT
AAAATCTGTGATGTAGGAGTCTCTCTACCACTGGATGAAAATATGACTGTGACTGACCCTGAGGCTTGTT
ACATTGGCACAGAGCCATGGAAACCCAAAGAAGCTGTGGAGGAGAATGGTGTTATTACTGACAAGGCAGA
CATATTTGCCTTTGGCCTTACTTTGTGGGAAATGATGACTTTATCGATTCCACACATTAATCTTTCAAAT
GATGATGATGATGAAGATAAAACTTTTGATGAAAGTGATTTTGATGATGAAGCATACTATGCAGCGTTGG
GAACTAGGCCACCTATTAATATGGAAGAACTGGATGAATCATACCAGAAAGTAATTGAACTCTTCTCTGT
ATGCACTAATGAAGACCCTAAAGATCGTCCTTCTGCTGCACACATTGTTGAAGCTCTGGAAACAGATGTC
TAGTGATCATCTCAGCTGAAGTGTGGCTTGCGTAAATAACTGTTTATTCCAAAATATTTACATAGTTACT
ATCAGTAGTTATTAGACTCTAAAATTGGCATATTTGAGGACCATAGTTTCTTGTTAACATATGGATAACT
ATTTCTAATATGAAATATGCTTATATTGGCTATAAGCACTTGGAATTGTACTGGGTTTTCTGTAAAGTTT
TAGAAACTAGCTACATAAGTACTTTGATACTGCTCATGCTGACTTAAAACACTAGCAGTAAAACGCTGTA
AACTGTAACATTAAATTGAATGACCATTACTTTTATTAATGATCTTTCTTAAATATTCTATATTTTAATG
GATCTACTGACATTAGCACTTTGTACAGTACAAAATAAAGTCTACATTTGTTTAAAACACTGAAAAAAAA
AAAAAAA
```

FIGURE 501
SEQ ID NO: 493
Genbank ID        : AA706788
Unigene ID(#167)  : Hs.46531
Unigene name      :       phosphoglucomutase 5       PGM5
>gi|2716706|gb|AA706788.1|AA706788                                zj30b01.s1
Soares_fetal_liver_spleen_1NFLS_S
1 Homo sapiens cDNA clone IMAGE:451753 3', mRNA sequence

```
AAGGTTGAAATTAGGAATTTCTTTTTTAATGGCCACTAAAGTCCTAGCAAGTTTCTGACAGAAGCACAGA
CAGAAAATGGAAACAAATACCTTACTGGGAATGTTTCCTTGCTTGCACTAACCATGACTACAGCAATAAC
GCATTGCTTAACAGTCAAAGTGCACCAGGTCATTTCCGCAAATGGCAGGGTGAGTGACTGTGCCGTTCCC
AAGGAAGCAAAACAGACACAAACAGGTCCCACGCGCTGGGTGTCCTGGCTGAGTACAGAGGAGGCTGCTA
GACCGGCAGTACCCTTTTCCCAAGTGAGGAAAGACAGCTGTGACACTCTGCATGCCGGCAGGTGTCCACA
CCCTCCACTCCACCATCTGGCCCATAGCTGTACCAACAATTACATTTTCTTCCAGCTTCCACTTCATTTC
CTACTTTTACAGCATTTCATCCTCTCCTTTATGCAGCCTTTACAAATAAGATCAGAAATGTGTCCAAACA
AGTGCATTAAGATAGGCCCCTATTGGCCAAGTCAAAGAGCTCTCACACATGGGTGG
```

FIGURE 502
SEQ ID NO: 494

FIGURE 502 cont'd

```
Genbank ID       : BC005400.1
Unigene ID(#167) : Hs.164018
Unigene name     :      leucine zipper protein FKSG14 FKSG14
>gi|13529292|gb|BC005400.1| Homo sapiens leucine zipper protein FKSG14,
mRNA (c
DNA clone MGC:12540 IMAGE:3839409), complete cds
GGGGCTGGCAAGCGCTTCCTGCGCAGCGCCGAGGCGACCTGGAGTTTGTGACGCTGTGATGGTCTAGAGG
CTGGAGATTCAAGATCTGGGTGCCATCATTTTCTGGTTCTGTTGATGACCCTCTTCCAGTTTTTCTTATA
AGGCTAAAAATTCACAAAGCATATATCAATGAATCAGGAGGATCTAGATCCGGATAGTACTACAGATGTG
GGAGATGTTACAAATACTGAAGAAGAACTTATTAGAGAATGTGAAGAAATGTGGAAAGATATGGAAGAAT
GTCAGAATAAATTATCACTTATTGGAACTGAAACACTCACCGATTCAAATGCTCAGCTATCATTGTTAAT
TATGCAAGTAAATGTTTAACCGCTGAACTCAGTCAATGGCAGAAAAAAACACCTGAAACAATTCCCTTG
ACTGAAGACGTTCTCATAACATTAGGAAAAGAAGAGTTCCAAAAGCTGAGACAAGATCTTGAAATGGTAC
TGTCCACTAAGGAGTCAAAGAATGAAAAGTTAAAGGAAGACTTAGAAAGGGAACAACGGTGGTTGGATGA
ACAGCAACAGATAATGGAATCTCTTAATGTACTACACAGTGAATTGAAAAATAAGGTTGAAACATTTTCT
GAATCAAGAATCTTTAATGAACTGAAAACTAAATGCTTAATATAAAAGAATATAAGGAGAAACTCTTGA
GTACCTTGGGCGAGTTTCTAGAAGACCATTTTCCTCTGCCTGATAGAAGTGTTAAAAAGAAAAAGAAAAA
CATTCAAGAATCATCTGTAAACCTGATAACACTGCATGAAATGTTAGAGATTCTTATAAATAGATTATTT
GATGTTCCACATGATCCATATGTCAAAATTAGTGATTCCTTTTGGCCACCTTATGTTGAGCTGCTGCTGC
GTAATGGAATTGCCTTGAGACATCCAGAAGATCCAACCCGAATAAGATTAGAAGCTTTCCATCAGTAAAA
GGATGTTTTCTTTTTTCACACAGTAAAAATTCTTATCATTCAAGGATATTGGAACCACAGGACTATTTGG
ATAAAAAACATTATTTGCAAATTAATGCGCATAGTACTTTTATTGCAAAATGGCATGTGCTGCCATCTAT
TATTCATTTTTAAATGGTCATTTCTTATTCAGTGAGTGCTTTAGTGTTTTAAACTATATGGATAAGAATG
CAGGTAGATAATATTCTAGGCATAAAACATTTAATGTACCTTACCTCATGCAATATTCTTTGGATTCTTT
GTTGATTTATGATATTGCTAATATAATATTTTCTTAAAATATATAACAATATCTTTTATGCATTTTGAGT
TCCAGCTGGTGCTTCTTTATATTTAGAAATTATAATGGGAAGGCCATTTAATTTACAGATGGTTTTAAAA
TTGAGGTAATATCTGAGGTGGCATAATTTAAAAATATTTAGCAAATTTGTTTCATATATACTGTCTTATT
TCTAGATTTGTTTAAAATTGGAATATGAAAAACTAATGGATAAAGCTAGCATAAAATTGATATTTTAGTT
TGTATTATTAATATATCATGTTACCTTATATATTAATCTACTCTTGATTCTGCTAATTATTACCAACAAA
ATTGTATTCATGACATTTTATTAATCCTCTGTGAATTTTCTGTAAATAAAATTATTTCTGAAAATCTCTC
AAAAAAAAAAAAAAAAAAAAAAAAAAAAAAA
```

FIGURE 503
SEQ ID NO: 495

```
Genbank ID       : NM_002053.1
Unigene ID(#167) : Hs.62661
Unigene name     :      guanylate binding protein 1, interferon-inducible,
67kDa GBP1
>gi|4503938|ref|NM_002053.1| Homo sapiens guanylate binding protein 1,
interfer
on-inducible, 67kDa (GBP1), mRNA
ACAGAAGTGCTAGAAGCCAGTGCTCGTGAACTAAGGAGAAAAAGAACAGACAAGGGAACAGCCTGGACAT
GGCATCAGAGATCCACATGACAGGCCCAATGTGCCTCATTGAGAACACTAATGGGCGACTGATGGCGAAT
CCAGAAGCTCTGAAGATCCTTTCTGCCATTACACAGCCATGGTGGTGGTGGCAATTGTGGGCCTCTACC
GCACAGGCAAATCCTACCTGATGAACAAGCTGGCTGGAAAGAAAAAGGGCTTCTCTCTGGGCTCCACGGT
GCAGTCTCACACTAAAGGAATCTGGATGTGGTGTGTGCCCCACCCCAAGAAGCCAGGCCACATCCTAGTT
CTGCTGGACACCGAGGGTCTGGGAGATGTAGAGAAGGGTGACAACCAGAATGACTCCTGGATCTTCGCCC
TGGCCGTCCTCCTGAGCAGCACCTTCGTGTACAATAGCATGGGAACCATCAACCAGCAGGCTATGGACCA
ACTGTACTATGTGACAGAGCTGACACATAGAATCCGATCAAAATCCTCACCTGATGAGAATGAGAATGAG
GTTGAGGATTCAGCTGACTTTGTGAGCTTCTTCCCAGACTTTGTGTGGACACTGAGAGATTTCTCCCTGG
ACTTGGAAGCAGATGGACAACCCCTCACACCAGATGAGTACCTGACATACTCCCTGAAGCTGAAGAAAGG
TACCAGTCAAAAAGATGAAACTTTTAACCTGCCCAGACTCTGTATCCGGAAATTCTTCCCAAAGAAAAA
TGCTTTGTCTTTGATCGGCCCGTTCACCGCAGGAAGCTTGCCCAGCTCGAGAAACTACAAGATGAAGAGC
TGGACCCCGAATTTGTGCAACAAGTAGCAGACTTCTGTTCCTACATCTTTAGTAATTCCAAAACTAAAC
TCTTTCAGGAGGCATCCAGGTCAACGGGCCTCGTCTAGAGAGCCTGGTGCTGACCTACGTCAATGCCATC
AGCAGTGGGGATCTGCCGTGCATGGAGAACGCAGTCCTGGCCTTGGCCCAGATAGAGAACTCAGCTGCAG
```

FIGURE 503 cont'd

```
TGCAAAAGGCTATTGCCCACTATGAACAGCAGATGGGCCAGAAGGTGCAGCTGCCCACAGAAAGCCTCCA
GGAGCTGCTGGACCTGCACAGGGACAGTGAGAGAGAGGCCATTGAAGTCTTCATCAGGAGTTCCTTCAAA
GATGTGGACCATCTATTTCAAAAGGAGTTAGCGGCCCAGCTAGAAAAAAAGCGGGATGACTTTTGTAAAC
AGAATCAGGAAGCATCATCAGATCGTTGCTCAGGTTTACTTCAGGTCATTTTCAGTCCTCTAGAAGAAGA
AGTCAAGGCGGGAATTTATTCGAAACCAGGGGGCTATCGTCTCTTTGTTCAGAAGCTACAAGACCTGAAG
AAAAAGTACTATGAGGAACCGACGAAGGGGATACAGGCTGAAGAGATTCTGCAGACATACTTGAAATCCA
AGGAGTCTATGACTGATGCAATTCTCCAGACAGACCAGACTCTCACAGAAAAAGAAAAGGAGATTGAAGT
GGAACGTGTGAAAGCTGAGTCTGCACAGGCTTCAGCAAAAATGTTGCAGGAAATGCAAAGAAAGAATGAG
CAGATGATGGAACAGAAGGAGAGGAGTTATCAGGAACACTTGAAACAACTGACTGAGAAGATGGAGAACG
ACAGGGTCCAGTTGCTGAAAGAGCAAGAGAGGACCCTCGCTCTTAAACTTCAGGAACAGGAGCAACTACT
AAAAGAGGGATTTCAAAAAGAAAGCAGAATAATGAAAAATGAGATACAGGATCTCCAGACGAAAATGAGA
CGACGAAAGGCATGTACCATAAGCTAAAGACCAGAGCCTTCCTGTCACCCCTAACCAAGGCATAATTGAA
ACAATTTTAGAATTTGGAACAAGCGTCACTACATTTGATAATAATTAGATCTTGCATCATAACACCAAAA
GTTTATAAAGGCATGTGGTACAATGATCAAAATCATGTTTTTTCTTAAAAAAAAAAAAAAGACTGTAAAT
TGTGCAACAAAGATGCATTTACCTCTGTATCAACTCAGGAAATCTCATAAGCTGGTACCACTCAGGAGAA
GTTTATTCTTCCAGATGACCAGCAGTAGACAAATGGATACTGAGCAGAGTCTTAGGTAAAAGTCTTGGGA
AATATTTGGGCATTGGTCTGGCCAAGTCTACAATGTCCCAATATCAAGGACAACCACCCTAGCTTCTTAG
TGAAGACAATGTACAGTTATCCATTAGATCAAGACTACACGGTCTATGAGCAATAATGTGATTTCTGGAC
ATTGCCCATGTATAATCCTCACTGATGATTTCAAGCTAAAGCAAACCACCTTATACAGAGATCTAGAATC
TCTTTATGTTCTCCAGAGGAAGGTGGAAGAAACCATGGGCAGGAGTAGGAATTGAGTGATAAACAATTGG
GCTAATGAAGAAAACTTCTCTTATTGTTCAGTTCATCCAGATTATAACTTCAATGGGACACTTTAGACCA
TTAGACAATTGACACTGGATTAAACAAATTCACATAATGCCAAATACACAATGTATTTATAGCAACGTAT
AATTTGCAAAGATGGACTTTAAAAGATGCTGTGTAACTAAACTGAAATAATTCAATTACTTATTATTTAG
AATGTTAAAGCTTATGATAGTCTTTTCTAATTCTTAACACTCATACTTGAAATCTTTCCGAGTTTCCCCA
GAAGAGAATATGGGATTTTTTTGACATTTTTGACCCATTTAATAATGCTCTTGTGTTTACCTAGTATAT
GTAGACTTTGTCTTATGTGTCAAAAGTCCTAGGAAAGTGGTTGATGTTTCTTATAGCAATTAAAAATTAT
TTTTGAACTGA
```

FIGURE 504
SEQ ID NO: 496
Genbank ID       : NM_002309.2
Unigene ID(#167) : Hs.2250
Unigene name     : leukemia        inhibitory        factor        (cholinergic
differentiation factor) LIF
>gi|6006018|ref|NM_002309.2|  Homo    sapiens    leukemia    inhibitory    factor
(cholinerg
ic differentiation factor) (LIF), mRNA

```
ATGAACCTCTGAAAACTGCCGGCATCTGAGGTTTCCTCCAAGGCCCTCTGAAGTGCAGCCCATAATGAAG
GTCTTGGCGGCAGGAGTTGTGCCCCTGCTGTTGGTTCTGCACTGGAAACATGGGGCGGGGAGCCCCCTCC
CCATCACCCCTGTCAACGCCACCTGTGCCATACGCCACCCATGTCACAACAACCTCATGAACCAGATCAG
GAGCCAACTGGCACAGCTCAATGGCAGTGCCAATGCCCTCTTTATTCTCTATTACACAGCCCAGGGGGAG
CCGTTCCCCAACAACCTGGACAAGCTATGTGGCCCCAACGTGACGGACTTCCCGCCCTTCCACGCCAACG
GCACGGAGAAGGCCAAGCTGGTGGAGCTGTACCGCATAGTCGTGTACCTTGGCACCTCCCTGGGCAACAT
CACCCGGGACCAGAAGATCCTCAACCCCAGTGCCCTCAGCCTCCACAGCAAGCTCAACGCCACCGCCGAC
ATCCTGCGAGGCCTCCTTAGCAACGTGCTGTGCCGCCTGTGCAGCAAGTACCACGTGGGCCATGTGGACG
TGACCTACGGCCCTGACACCTCGGGTAAGGATGTCTTCCAGAAGAAGAAGCTGGGCTGTCAACTCCTGGG
GAAGTATAAGCAGATCATCGCCGTGTTGGCCCAGGCCTTCTAGCAGGAGGTCTTGAAGTGTGCTGTGAAC
CGAGGGATCTCAGGAGTTGGGTCCAGATGTGGGGCCTGTCCAAGGGTGGCTGGGCCCAGGGCATCGCT
AAACCCAAATGGGGGCTGCTGGCAGACCCCGAGGGTGCCTGGCCAGTCCACTCCACTCTGGGCTGGGCTG
TGATGAAGCTGAGCAGAGTGGAAACTTCCATAGGAGGGAGCTAGAAGAAGGTGCCCCTTCCTCTGGGAG
ATTGTGGACTGGGGAGCGTGGCTGGACTTCTGCCTCTACTTGTCCCTTTGGCCCCTTGCTCACTTTGTG
CAGTGAACAAACTACACAAGTCATCTACAAGAGCCCTGACCACAGGGTGAGACAGCAGGGCCCAGGGGAG
TGGACCAGCCCCCAGCAAATTATCACCATCTGTGCCTTTGCTGCCCCTTAGGTTGGGACTTAGGTGGGCC
AGAGGGGCTAGGATCCCAAAGGACTCCTTGTCCCCTAGAAGTTTGATGAGTGGAAGATAGAGAGGGCCT
CTGGGATGGAAGGCTGTCTTCTTTTGAGGATGATCAGAGAACTTGGGCATAGGAACAATCTGGCAGAAGT
TTCCAGAAGGAGGTCACTTGGCATTCAGGCTCTTGGGGAGGCAGAGAAGCCACCTTCAGGCCTGGGAAGG
AAGACACTGGGAGGAGGAGAGGCCTGGAAAGCTTTGGTAGGTTCTTCGTTCTCTTCCCCGTGATCTTCCC
TGCAGCCTGGGATGGCCAGGGTCTGATGGCTGGACCTGCAGCAGGGGTTTGTGGAGGTGGGTAGGGCAGG
GGCAGGTTGCTAAGTCAGGTGCAGAGGTTCTGAGGGACCCAGGCTCTTCCTCTGGGTAAAGGTCTGTAAG
AAGGGGCTGGGGTAGCTCAGAGTAGCAGCTCACATCTGAGGCCCTGGGAGGTCTTGTGAGGTCACACAGA
```

FIGURE 504 cont'd

```
GGTACTTGAGGGGGACTGGAGGCCGTCTCTGGTCCCCAGGGCAAGGGAACAGCAGAACTTAGGGTCAGGG
TCTCAGGGAACCCTGAGCTCCAAGCGTGCTGTGCGTCTGACCTGGCATGATTTCTATTTATTATGATATC
CTATTTATATTAACTTATTGGTGCTTTCAGTGGCCAAGTTAATTCCCCTTTCCCTGGTCCCTACTCAACA
AAATATGATGATGGCTCCCGACACAAGCGCCAGGGCCAGGGCTTAGCAGGGCCTGGTCTGGAAGTCGACA
ATGTTACAAGTGGAATAAGCTTACGGGTGAAGCTCAGAGAAGGGTCGGATCTGAGAGAATGGGGAGGCCT
GAGTGGGAGTGGGGGGCCTTGCTCCACCCCCATCCCTACTGTGACTTGCTTTAGCGTGTCAGGGTCCAG
GCTGCAGGGGCTGGGCCAATTTGTGGAGAGGCCGGGTGCCTTTCTGTCTTGCTTCCAGGGGGCTGGTTCA
CACTGTTCTTGGGCGCCCCAGCATTGTTGTTGAGGCGCACTGTTCCTGGCAGATATTGTGCCCCCTGGA
GCAGTGGGCAAGACAGTCCTTGTGGCCCACCCTGTCCTTGTTTCTGTGTCCCCATGCTGCCTCTGAAATA
GCGCCCTGGAACAACCCTGCCCCTGCACCCAGCATGCTCCGACACAGCAGGGAAGCTCCTCCTGTGGCCC
GGACACCCATAGACGGTGCGGGGGCCTGGCTGGGCCAGACCCCAGGAAGGTGGGGTAGACTGGGGGGAT
CAGCTGCCCATTGCTCCCAAGAGGAGGAGAGGGAGGCTGCAGACGCCTGGGACTCAGACCAGGAAGCTGT
GGGCCCTCCTGCTCCACCCCCATCCCACTCCCACCCATGTCTGGGCTCCCAGGCAGGGAACCCGATCTCT
TCCTTTGTGCTGGGGCCAGGCGAGTGGAGAAACGCCCTCCAGTCTGAGAGCAGGGGAGGGAAGGAGGCAG
CAGAGTTGGGGCAGCTGCTCAGAGCAGTGTTCTGGCTTCTTCTCAAACCCTGAGCGGGCTGCCGGCCTCC
AAGTTCCTCCGACAAGATGATGGTACTAATTATGGTACTTTTCACTCACTTTGCACCTTTCCCTGTCGCT
CTCTAAGCACTTTACCTGGATGGCGCGTGGGCAGTGTGCAGGCAGGTCCTGAGGCCTGGGGTTGGGGTGG
AGGGTGCGGCCCGGAGTTGTCCATCTGTCCATCCCAACAGCAAGACGAGGATGTGGCTGTTGAGATGTGG
GCCACACTCACCCTTGTCCAGGATGCAGGGACTGCCTTCTCCTTCCTGCTTCATCCGGCTTAGCTTGGGG
CTGGCTGCATTCCCCAGGATGGGCTTCGAGAAAGACAAACTTGTCTGGAAACCAGAGTTGCTGATTCCA
CCCGGGGGGCCCGGCTGACTCGCCCATCACCTCATCTCCCTGGACTTGGGAGCTCTGTGCCAGGCCCA
CCTTGCGGCCCTGGCTCTGAGTCGCTCTCCCACCCAGCCTGGACTTGGCCCCATGGGACCCATCCTCAGT
GCTCCCTCCAGATCCCGTCCGGCAGCTTGGCGTCCACCCTGCACAGCATCACTGAATCACAGAGCCTTTG
CGTGAAACAGCTCTGCCAGGCCGGGAGCTGGGTTTCTCTTCCCTTTTTATCTGCTGGTGTGGACCACACC
TGGGCCTGGCCGGAGGAAGAGAGAGTTTACCAAGAGAGATGTCTCCGGGCCCTTATTTATTATTTAAACA
TTTTTTTAAAAAGCACTGCTAGTTTACTTGTCTCTCCTCCCCATCGTCCCCATCGTCCTCCTTGTCCCTG
ACTTGGGGCACTTCCACCCTGACCCAGCCAGTCCAGCTCTGCCTTGCCGGCTCTCCAGAGTAGACATAGT
GTGTGGGGTTGGAGCTCTGGCACCCGGGGAGGTAGCATTTCCCTGCAGATGGTACAGATGTTCCTGCCTT
AGAGTCATCTCTAGTTCCCCACCTCAATCCCGGCATCCAGCCTTCAGTCCCGCCCACGTGCTAGCTCCGT
GGGCCCACCGTGCGGCCTTAGAGGTTTCCCTCCTTCCTTTCCACTGAAAAGCACATGGCCTTGGGTGACA
AATTCCTCTTTGATGAATGTACCCTGTGGGATGTTTCATACTGACAGATTATTTTTATTTATTCAATGT
CATATTTAAAATATTTATTTTTATACCAAATGAATCACTTTTTTTTTAAGAAAAAAAGAGAAATGAA
TAAAGAATCTACTCTTCG
```

FIGURE 505

SEQ ID NO: 497

Genbank ID : AW606588
Unigene ID(#167) : Hs.430335
Unigene name : Transcribed sequence with weak similarity to protein ref:NP_112159.1 (H.sapiens) hypothetical protein FLJ21617; erythroid differentiation-related factor 1 [Homo sapiens]
>gi|7311329|gb|AW606588.1|AW606588 QV0-HT0398-210100-096-c03 HT0398 Homo sapien
s cDNA, mRNA sequence

```
TTTTTCTGTATCTAATGGATTATGCCGCTCTGGAACATTCATGTGATGCTTTTGTTAATTGCTTATACAT
TTTATTAAGCTAATGAGCTTGGTCATAGTAACATATAAAATCAAGAATCGTTTAACTTTTGCAATAAAAA
TCTTGATGTTGACTCTGAAGTAGTAAGATGCAACTTCAATGTACTGGGATTGAGGCAGCCATAGCAATAT
TACCACAGGTTTTCCAAAAATTAACACAAATATTTTCTATTCTAGATGTGATATCTTTGGCATCACTGTT
CATTCTTTTCCTCCTTGATTAAAGTGAAACAATTACATTAAAATAGTTTTATGATTTAAAAATCATTCTT
TTTTTAAGCTATTATTTTTAATGTAGGTCAGTGTGTTATGTAAATTGATGTCCACTACCTGAACATGTGA
TGCTTTCTCTTTTATTCCTTGGTATTTCCTCCATATTCTCTGAGGGCCTTCAGTCAATTTTTTAAAGGA
AATAATAAGTTCAAATATGTATCTATGACTTAGGGTTACAAAGAATATTTTCTTTGCCTCCAGTATACTT
TGTATTAAAAAAATTATAAAAGGGCATAGGTTTTCATTTTCAAATATTTGAAAAAAAGGC
```

FIGURE 506

SEQ ID NO: 498

Genbank ID : AI675836
Unigene ID(#167) : Hs.348923

FIGURE 506 cont'd

```
Unigene name      :      VPS10 domain receptor protein SORCS 1      SORCS1
>gi|4876316|gb|AI675836.1|AI675836  wb97e04.x1  NCI_CGAP_Pr28  Homo sapiens
cDNA c
lone IMAGE:2313630 3', mRNA sequence
AGAGACATTATCTGTTTAATAAATATGATTGTAAAAGCAATAAACAAGAGCAATTATACATTACACTACA
TAGTATTTAACAAAAAATACATCAAAAAAGTCATTTTAAAATTAGAAGTAGTTCCAATACTATAAGAAAA
CTTTTTTTTTTTTTAATTGGCTTCCTATAAAAATAAGTCGGCAAATGAGAGATTTCAATGCTCAGTTGGA
TTCCTGGAAAACACAGAACAGCTGCCAAGCACCCCACTGCTCTCAAAGTTGCTGTTTGGAACTTCTGAAA
AAAAAAAGCAAAGCAAACCTCTGCATTTTGGACAGTGAATCCAATTAAAAATAAGGCAAGGTAGAAAGTG
TTGCTTGGGTGGTTCAGGGTAGAACATGCACAGTTTGCCTTCTGGGATTTTGGAAAACGTTGCAGTATCG
GATTTTTAGCTTGCCCTGAATCTTACCTTCCACA
```

FIGURE 507
SEQ ID NO: 499
Genbank ID        : AL080072.1
Unigene ID(#167)  : Hs.21195
Unigene name      :      MRNA; cDNA DKFZp564M0616 (from clone DKFZp564M0616)

```
>gi|5262482|emb|AL080072.1|HSM800573 Homo sapiens mRNA; cDNA DKFZp564M0616
(fro
m clone DKFZp564M0616)
GGGTCGAGGTCGACGGTAACAAAAGTTTTTTTTTTGCTTTTTAAAAAATTCAATGTTAGCAAGAGAATGA
TAAGTTTGGGAGCTTCATATGATGCTTTAGAAGTGTAAATTTCCTTTCTGATAAGCAGCTAAGCAAGCTA
TATCAGGAATGTAGCTTTTTGGTTGTTTTTTGAGATGGTCTTGCGTTGTTGCCCAGGCTTTGAGTGCAGT
GGCATGATCATGGCTCACTGCAGCCTCAACCTCCCTGACTCAAGCGATCCTCCCACCTCAGCCTCCCAGG
TAGCTGCGACTACAGGCACGCACCACTCCACTCGGCTAATTTTTTATTTTTATTTTTGTAGAGACAGGG
TCTTCCTATGTTGCCCAGGCCAGTCTCTGAACTCCTGGGCTCAAGTGATCCTTCTGCCTTGGCTCACACC
TATAATCCCAGCCTCCCAAGTAGCTGGGACTACAAGGCACCTACTGCTGCACTTAGCTTTATCTTTTAAC
TCATATTTTAAATGTCTTCTACAAGGCACCGAAAAATAAGTAGTTGTGTTCATTTTAAGTAAATAGTAG
TAAACAGTTTCAAATGCTGTTTGAGATGTTAATTAAGGCACACACTTAGACTAGTCCATTTGATTTGAAA
ATTAGGATTTTATTTGTGCTTTTTGTTAATTACTGGCTTTTAAAAGATCAGTAGTGGGGCAGAAACTAGA
CTAGTGGGTTGAAGGGTGAATAGGAAATAAGTAATACTTATTCTTTCAAGGAGCTCGACTGAAAAGGAGA
CAGTGGTAGTTTGAAGATATTGCTGTTTTTAAGATAAAAATGATTTCAGCACTTTAAAAATAAAAAGTTG
GAAATGATCAATGAATCAAGGATCATCAAGAAGAGGCAAGAGGAAGTAAGATTAAGCACAAAGAGTATC
AACTGATAGGTGGCATTTCAAGGAACTTCAGGTGTTGAATATCTAAAGCACCAAATGCGTGTGGACAGCA
GTGAAGATAAAGCTGGAAATGCGCCGGCAGACCAACACATGATGAGCCCTGTAGGTGGTGGACAAAGACT
ACGAGCAAGCCATTTAGGCAAACATCTGAAGAATTTAAAAATCAAAGGCAAACAAATAGGACTGTTTCAT
TAAGATCACTTGCATTCTAACAGGTTATGATGAATGGAAAGCTGATGGTTCCTGGTTGGAAAAAAGATAA
TTTTCAATTTGGACATGTCACATTTGAGATGCAGTTGACACACCCAAGATACATAATATATTGTCTTTCA
AAATTCAGAAACCTAATAAACCATGATCTTAATAACCGCCAAAAAAAAAAAAAAAAAAAAAAC
```

FIGURE 508
SEQ ID NO: 500
Genbank ID        : NM_018265.1
Unigene ID(#167)  : Hs.73239
Unigene name      :      hypothetical protein FLJ10901 FLJ10901
>gi|8922753|ref|NM_018265.1| Homo sapiens hypothetical protein FLJ10901
(FLJ109
01), mRNA
```
ATGCTGCAAATGCCGAAGTTAAATGAAATACCTCCGGGGAGGGCAGGCCGCAGGGAGGCTCGGGGGGAGG
GAAGATGGCCTGGACAAACAGGTCCTGAAGCTGCGAGGCTGGAGTGGAGGGCGCAGGGGCAGGCGGGCGG
CGCCAGAGCTCCATGGGACAGCTGGGGAAGCTCCAGGCTACCTACACAACCTGGCCCAGGCTGGTCACGG
TGTCCCCCCTCCCTGCTCTGTGCCCTCTCCTTCCAGAAATCCACCATGGAGAGTAAGGATGAGGTCAGCG
ACACCGACAGTGGCATCATCCTGCAGTCTGGCCCCGACAGCCCGGTCTCCCCAATGAAGGAGCTGACCCA
TGCAGTGCACAAGCAGCAGAGGGCCCTGGAAGCGAGGCTGGAGGCCTGCCTGGAGGAGCTGAGGAGACTC
TGCCTTCGGGAAGCGGAGCTGACGGGCACCTTGCCAGCGGAGTATCCCCTCAAACCAGGGGAAAAGGCCC
CCAAGGTTCGCCGCAGGATCGGAGCGGCTTACAAACTGGATGACTGGGCCTTGCACAGAGAGGACCCCCT
AAGCAGCCTGGAGCGCCAGCTGGCCCTGCAGCTGCAGATCACAGAGGCAGCCCGTCGGCTGTGCCTGGAG
```

FIGURE 508 cont'd

GAGAACCTCAGCAGGCAGGCTCGGCGGCAGCGGAAGCACTCCATGCTGCAGGAGGAGAAGAAGCTGCAGG
AGCTCCAGCGCTGCCTGGTCGAGCGGCGGCGCAATAGCGAGCCACCTCCGGCTGCTGCTCTCCCCCTGGG
CCGAGAGCTCAGTGCCTCTGATGACAGCTCCCTGTCAGATGGGCTCCTCCTGGAGGAAGAGGAATCCCAA
GTGCCAAAACCTCCTCCAGAGTCTCCAGCCCCACCTTCTCGGCCTCTCCCACCCCAAACCCTTGAGGGTC
TGCAGCCAACAGGACCTGAGGCTGGGAGCCCAGAACGGGCTCCAGTCCAGAACAGCCCCTGGAAGGAAAC
CAGCCTGGACCACCCCTATGAGAAGCCCAGGAAGTCTTCTGAGCCCTGGAGCGAGTCCAGCAGCCCAGCC
ACCACACCACAGGATGGGCCCAGTGCCTCCAGCCTGTGGCTTCTGGAGCCTGCCTCCTACCACGTGGTTC
CCATCCGTGGTGTTCCTGGCCAGTGGCAGGGCCGCACCAGTGCCCCAGCCACCCCTGAGATACAGGGGAG
GAGGGGCCAGTCGCAGTCTCTGAGGGTGGATTCCTTCCGGGCGGGTCCTGAGGGCCGAGGTCGCAGCGCC
TTTCCCCGCCGCCGCCCCACTCACTACACGGTGACAGTGCCAGATTCCTGCTTTCCCGCGACCAAGCCCC
CGCTGCCCCACGCCGCCTGCCACTCCTGCTCAGAAGACAGTGGCTCTGACGTCTCCAGCATCTCCCACCC
CACTTCGCCGGGCAGCAGCAGCCCCGACATCTCCTTTCTGCAGCCTCTCTCCCTCCCAAGACCCATCGT
CACCGCGGGCCTGGGTCCCAGCCGGCAGCAGAGAGCTGGTCGCCCACCACCCCAAGCTACTGCTGCCGC
CTGGCTATTTCCGGCGGGGCGGTACGTGGTGGTGGCTGAGAGCCCCTGCCGCCTGGCGAGTGGGAGCT
GTGCCGCGCAGCCCCGGGCCCTGCTTACGAGGAGGAGGGCACTCCCCTGCGCTACCAGCGTCTGGTGCCC
TCCCGCAGCCGCATCGTGCGGACGCCCTCCCTGAAGGACAGCCCGGCAGGCCGGGGCTCAGCAAGGCCG
CCGTGTCCGAGGAGCTCAAGTGGTGGCACGAGCGTGCACGCCTCCGGAGCACCCGACCCCACTCACTGGA
CCGCCAAGGAGCTTTCCGGGTCAGGAGCCTGCCCCTTGGGAGAGAGGGCTTCGGACGAGCCCTGGGACCC
CGGGCACAGGTGCCCACAGTTTGTGTGCTGTGGAGATCGCCTGATGGGGCCCCTGTGCAAGTCTTTGTAC
CTGAAAAAGGAGAGATCATCAGCCAGGTGTAACTCTGCGCCCCACGCTGGAAAAAACTGTTTCATAGAGG
GGCTGGGCTGAGACCCCCCCACCCCTGAGTGCCTCTTTCAGCTCCCCATCCCCATCGCAGGCCGATGAC
CTGGAGCTAAGACCTTTTATTATTTTTTTTTACACGACTTTTTTCAGAAGCCCTGACCTAAGGATTTAT
ATATGTGGATTGTCCTCAATACCCCTGTGATATGATTATGTTTTATCCCCCAGAGTTTGGCCTACTGGAC
TTAAGGCCTTGCCTGTCTGACTGACAGCCTCTATCTCCTTATATAAGACAAGTGGCAGGGGACGAGTGAA
GCAGAGTGAGCCACCTTGGGAGTTCTCCAACGCTCTGTGCTCTGGTTCTAAGAAATTCCCTGGGGAACTG
CCCCTGGCCCTCCTGTCCCACTATTGCTGGAGGCTGGACATGGTACATACTCATGCACATGACTCTCCCC
CATTTCCCAGGTCTCTGGGTACCCCAGCCTGGGCTGGGGGAGAATCTCTTCCCCCTTTTCTAATGTGCTC
TGTGATGCACACACCAAGTGGTAGGTCAAAGGTCAGTATATCCCGGTGGTGTATTGTCTTGCTAGACCCT
GCTATTTTCCTGACCCCCTAAATCCTCTTTAGGGACCCAGTCACTATACCCTGTCTATGCCCTGTGGGCT
CCCAGACCCCTGAGCTTTGAGTCAGTGGCATCACAGTTTGTAGCCTCAGGGGTCTGGCTGGGGGCTGGT
CCATGCTTGTGGTTAGTGGACAGCAGCCACCCTTTGACAGCTACCTCTGGACATCTCAAGGGCTTGCAGC
CCCACTGCTCCTTCTAACATTTTGTTTGTTTTTGAGATGGAGTCTCGCTCTGTCGCCCAGGCTGGAATGC
TGTAGCAAGATTTCGGCTCACTGCAACCCCGTCTCCCGGGTTCAAGCGAATCTCCTGCCTCAGCCTTCT
GAGTAGCTGGGATTACAGGCAAGCACCACCATGCCTGCTAATTTTTTATTTTTAGTAGAGATGGGGTTTC
ATCATGTTGGCCAGGCTGGTCTCGAACTCCTGACCTCAAGTGATCCACCTGCCTTGGCCTTTCAAAGTGC
TGGGATTACAGGCATGAGCCACCGCACCTGGCCCTTCTAACGTTTTTTCATCATAGTCCCAAAAACCAAT
ACTTTACAAGTGGTTTTTGAAAGGCACCACTTTTGTGGCATGTTCTGGTTGGGAGAGGGAGTCACAGTTC
CTACTCCCCCCACCAGCTATGCTTCTGCTCTGAGAAGGTGGTTATTTATACAAACATGGACATACTCACT
CCCAAGGGCTGATGAGATGCTGAATTTTCTTTGGGGGCATTCATTAATTGTCCCAGCTGCAGCGACTGGA
GCAAGTCTGGAAGCTGCCTGTGCTAAGACCACCCAGCTGTCCCTGGGTTCTCATCCTAGGGCCTTCTTTG
CTTCCAGGTCAGGGACCTGCTTCAATGAGAAAGCAACTGAATTGAGGCTAGGAGAGGTAGGGAGAGCTG
AGTTCTGACTTCACCTGTGCAGAACTCTCTGCCCCATGTTACCTGGACTGGAACAGACTGTGAATATAG
CAGAAGGTTCCAAGAACTCTGGTGTCTGACCTAGAAGAGGCACAGTTCTCTCTACTGGAAAGAAAACGAT
GTAGCCGATTGCACAAGGGTGCCAAGGGAAGACCCAGGATGGCCCATCAAAGGAACCTGGGGGAGGATGC
AGGAGGCTGAAGGGATGCACCTGGCATTTCTCTCACTGTGCTCTTACCGCATCAGCAACCCCCAACTTTT
GGGCCTACTCTGCCCCCATGCGTGAATACCCTGCTTGGATGCTGTGCTTTTCCGGTTTGTCTCTAAGCC
CCTTTCTCCAGGGCATGTTGGTTTCCCTGGCCTCTCAGTGTCCTAACTGGAGCCCAGAGTGCCTTGTTCT
GAGCCAGGAGACGGCTGAGCACTGGCCCTCCACACCTAAGCGTCCTTTACATTAACTTATTGGTCTTGTA
TAACACCTGGTGCCATTGCCAAGTGGCTGTGTCCTCAGCTACAGAGCTGGAATTGTGTGGGGTTTAGTGC
TAAATACTTCAATAAAGTCTGTTTTTGTGATTGGCTG

METHODS, SYSTEMS, AND COMPOSITIONS FOR CLASSIFICATION, PROGNOSIS, AND DIAGNOSIS OF CANCERS

The application contains a sequence listing which has been submitted via CD-R in lieu of a printed paper copy, and is hereby incorporated by reference in its entirety. The CD-R, recorded on Mar. 9, 2005, are labeled "CRF," "Copy 1," and "Copy 2" and each contains only one identical 1.95 MB file (38271767.APP).

FIELD OF THE INVENTION

The present invention relates generally to systems, compositions, and methods for predicting disease susceptibility in a patient.

BACKGROUND

Mutations in p53 are thought to occur in more than 50% of human cancers and are most frequently observed in the DNA binding and transactivation domains, underscoring the importance of its transcriptional activity in suppressing tumor development. In sporadic breast cancers, unlike most cancer types, p53 mutations are only observed in approximately 20% of cases. However, that breast cancer is frequently observed in individuals with germline mutations of p53 (i.e., Li-Fraumeni syndrome) suggests a particularly important role for p53 inactivation in breast carcinogenesis, and perhaps a similarly important role for other factors capable of compromising p53 function.

For example, the reduced transcriptional activation of p53 following hypermethylation and subsequent inhibition of the HOXA5 transcription factor has recently been implicated as a possible epigenetic mechanism in reducing p53 expression in breast cancers. In both breast tumors and other cancer types, amplification and overexpression of the MDM2 gene, whose product promotes p53 degradation, has been implicated in oncogenesis. Moreover, both deletion and epigenetic silencing of the p14ARF gene, a negative regulator of MDM2, has been observed in various cancer types. Thus, p53 deficiency in breast carcinogenesis can potentially arise from a number of mechanisms other than p53 gene mutation.

There is evidence that the p53 status has prognostic significance in a number of cancer types and in particular breast cancer. In breast cancer, p53 mutations confer worse overall and disease-free survival, and a higher incidence of tumor recurrence, independent of other risk factors. Recent evidence suggests that p53 inactivation renders breast tumors resistant to certain DNA-damaging chemotherapies and endocrine therapies presumably through loss of p53-dependent apoptosis.

However, in all of these studies, the prognostic capability and degree of therapeutic resistance of the p53 mutants was found to depend largely on mutant-specific attributes, such as the type of mutations or the precise domain in which the mutation occurs. Importantly, this latter observation is consistent with findings from previous studies showing that not all p53 mutations have equal effects: some simply confer loss of function, while others have a dominant negative effect (such as trans-dominant suppression of wildtype p53 or oncogenic gain of function), while still others show only a partial loss of function where, for example, only a small subset of p53 downstream transcriptional target genes are dysregulated. For these reasons, no single molecular assessment of p53 status appears to provide an absolute indication of the complete p53 function.

There is a need for methods that better assess the effects of different p53 mutations on cell function in general and gene expression in particular, in an effort to enable better cancer prognosis and diagnosis.

SUMMARY

Accordingly, the present invention provides methods, systems, and compositions that provide a more useful measure of in vivo p53 functionality. These methods, systems, and compositions may be employed for the classification, prognosis, and diagnosis of cancers.

In one aspect of the present invention there is provided a method for predicting disease outcome in a patient, the method comprising the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the patient.

In another aspect of the present invention there is provided a method for predicting disease outcome in a late-stage breast cancer patient, the method comprising the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the late-stage breast cancer patient wherein the set of genes are selected from the group consisting of GenBank accession numbers: BG271923 (SEQ ID NO: 22), NM_002466 (SEQ ID NO: 31), D38553 (SEQ ID NO: 11), NM_000909 (SEQ ID NO: 9), NM_024843 (SEQ ID NO: 1), R73030 (SEQ ID NO: 29), NM_003226 (SEQ ID NO: 28), AW299538 (SEQ ID NO: 5) and AI990465 (SEQ ID NO: 25).

In yet another aspect of the present invention there is provided a method for predicting clinical outcome in an early-stage, locally-treated breast cancer patient, the method comprising the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the early-stage, locally-treated breast cancer patient wherein the set of genes are selected from the group consisting of GenBank accession numbers: AI961235 (SEQ ID NO-23), BG271923 (SEQ ID NO: 22), NM_002466 (SEQ ID NO: 31), BC001651 (SEQ ID NO: 14), D38553 (SEQ ID NO: 11), AK000345 (SEQ ID NO: 26), BC004504 (SEQ ID NO: 8), NM_000909 (SEQ ID NO: 9), NM_024843 (SEQ ID NO: 1), R73030 (SEQ ID NO: 29), AI435828 (SEQ ID NO: 20), AI810764 (SEQ ID NO: 24), AI922323 (SEQ ID NO: 10), NM_003225 (SEQ ID NO: 32), NM_003226 (SEQ ID NO: 28), AW299538 (SEQ ID NO: 5), NM_003462 (SEQ ID NO: 16), AI990465 (SEQ ID NO: 25), NM_004392 (SEQ ID NO: 15), NM_001267 (SEQ ID NO: 7) and AI826437 (SEQ ID NO: 3).

In a further aspect of the present invention there is provided a method for predicting clinical outcome in a liver cancer patient, the method comprising the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the liver cancer patient wherein the set of genes are selected from the group consisting of GenBank accession numbers: NM_002466 (SEQ ID NO: 31), BC001651 (SEQ ID NO: 14), D38553 (SEQ ID NO: 11), NM_024843 (SEQ ID NO: 1), AI435828 (SEQ ID NO: 20), AI810764 (SEQ ID NO: 24), NM_003226 (SEQ ID NO: 28) and AW299538 (SEQ ID NO: 5).

In a still further aspect of the present invention there is provided a method of identifying a group of genes for predicting disease outcome in a patient, the method comprising the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; ranking the differentially expressed genes according to their ability to predict p53 mutational status; training the ranked genes to distinguish between mutant and wildtype p53 gene expression profiles; obtaining a p53 classifier including a set of genes capable of predicting p53 mutational status; validating the p53 classifier in independent datasets; and assessing the ability of the p53 classifier to predict disease outcome in the patient.

In another aspect of the present invention there is provided a computer system for predicting disease outcome in a patient, the computer system comprising: a computer having a processor and a memory, the memory having executable code stored thereon for execution by the processor for performing the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the patient.

In yet another aspect of the present invention there is provided a diagnostic tool for predicting disease susceptibility in a patient comprising a plurality of genes capable of predicting p53 mutational status immobilized on a solid support.

In a still further aspect of the present invention there is provided a nucleic acid array for predicting disease susceptibility in a patient comprising a solid support and displayed thereon nucleic acid probes corresponding to genes capable of predicting p53 mutational status in the patient.

These aspects and embodiments are described in greater detail below.

Definitions

As used in this application, the singular form "a," "an," and "the" include plural references unless the context clearly dictates otherwise. For example, the term "an agent" includes a plurality of agents, including mixtures thereof.

An individual is not limited to a human being but may also be other organisms including but not limited to a mammal, invertebrate, plant, fungus, virus, bacteria, or one or more cells derived from any of the above.

As used herein the term "comprising" means "including". Variations of the word "comprising", such as "comprise" and "comprises", have correspondingly varied meanings.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

As used herein, the term "histologic grade" or "tumor grade" refers to characteristics of tumors classified according to the Elston-Ellis system of grading tumors.

As used herein, "p53 status" refers to the mutational status of the p53 gene. A p53 mutant tumor contains a mutation in the p53 gene that alters the function of the protein. A p53 wildtype tumor contains no detectable mutation in the p53 gene.

As used herein "Disease-specific survival" or DSS is a survival assessment where the end point being examined is death because of a disease, for example, breast cancer.

As used herein, "Disease-free survival" or DFS is a survival assessment where the end points are either tumor recurrence (i.e., the cancer comes back as the consequence of distant metastasis to other sites in the body) or death because of breast cancer without evidence of distant metastasis.

As used herein, an "array" is an intentionally created collection of molecules which can be prepared either synthetically or biosynthetically. The molecules in the array can be identical or different from each other. The array can assume a variety of formats, e.g., libraries of soluble molecules; libraries of compounds tethered to resin beads, silica chips, or other solid supports.

As used herein, a "nucleic acid library or array" is an intentionally created collection of nucleic acids which can be prepared either synthetically or biosynthetically in a variety of different formats (e.g., libraries of soluble molecules; and libraries of oligonucleotides tethered to resin beads, silica chips, or other solid supports). Additionally, the term "array" is meant to include those libraries of nucleic acids which can be prepared by spotting nucleic acids of essentially any length (e.g., from 1 to about 1000 nucleotide monomers in length) onto a substrate. The term "nucleic acid" as used herein refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleotide sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

As used herein, the term "complementary" refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. Complementary nucleotides are, generally, A and T (or A and U), or C and G. Two single stranded RNA or DNA molecules are said to be complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100% of the nucleotides of the other strand. Alternatively, complementarity exists when an RNA or DNA strand will hybridize under selective hybridization conditions to its complement. Typically, selective hybridization will occur when there is at least about 65% complementarity over a stretch of at least 14 to 25 nucleotides, preferably at least about 75%, and more preferably at least about 90% complementarity.

As used herein, a "fragment," "segment," or "DNA segment" refers to a portion of a larger DNA polynucleotide or DNA. A polynucleotide, for example, can be broken up, or fragmented into, a plurality of segments. Various methods of fragmenting nucleic acids are well known in the art. These methods may be, for example, either chemical or physical in nature. Chemical fragmentation may include partial degradation with a DNase; partial depurination with acid; the use of restriction enzymes; intron-encoded endonucleases; DNA-based cleavage methods, such as triplex and hybrid formation methods, that rely on the specific hybridization of a nucleic acid segment to localize a cleavage agent to a specific location in the nucleic acid molecule; or other enzymes or compounds which cleave DNA at known or unknown locations. Physical fragmentation methods may involve subjecting the DNA to a high shear rate. High shear rates may be produced, for example, by moving DNA through a chamber or channel with pits or spikes, or forcing the DNA sample through a restricted size flow passage, e.g., an aperture having a cross sectional dimension in the micron or submicron scale. Other physical methods include sonication and nebulization. Combinations of physical and chemical fragmentation methods may likewise be employed such as fragmentation by heat and ion-mediated hydrolysis. See for example, Sambrook et al., "Molecular Cloning: A Laboratory Manual," 3rd Ed. Cold Spring Harbor Laboratory Press, Cold Spring Harbor, N.Y. (2001) ("Sambrook et al.) which is incorporated herein by reference for all purposes. These methods can be optimized to digest a nucleic acid into fragments of a selected size range. Useful size ranges may be from 100, 200, 400, 700 or 1000 to 500, 800, 1500, 2000, 4000 or 10,000 base pairs. However, larger size ranges such as 4000, 10,000 or 20,000 to 10,000, 20,000 or 500,000 base pairs may also be useful.

As used herein, the term "hybridization" refers to the process in which two single-stranded polynucleotides bind non-covalently to form a stable double-stranded polynucleotide. The term "hybridization" may also refer to triple-stranded hybridization. The resulting (usually) double-stranded polynucleotide is a "hybrid." The proportion of the population of polynucleotides that forms stable hybrids is referred to herein as the "degree of hybridization". Hybridization conditions will typically include salt concentrations of less than about 1M, more usually less than about 500 mM and less than about 200 mM. Hybridization temperatures can be as low as 5° C., but are typically greater than 22° C., more typically greater than about 30° C., and preferably in excess of about 37° C. Hybridizations are usually performed under stringent conditions, i.e. conditions under which a probe will hybridize to its target subsequence. Stringent conditions are sequence-dependent and are different in different circumstances. Longer fragments may require higher hybridization temperatures for specific hybridization. As other factors may affect the stringency of hybridization, including base composition and length of the complementary strands, presence of organic solvents and extent of base mismatching, the combination of parameters is more important than the absolute measure of any one alone. Generally, stringent conditions are selected to be about 5° C. lower than the thermal melting point ($T_m$) for the specific sequence at a defined ionic strength and pH. The $T_m$ is the temperature (under defined ionic strength, pH and nucleic acid composition) at which 50% of the probes complementary to the target sequence hybridize to the target sequence at equilibrium.

Typically, stringent conditions include salt concentration of at least 0.01 M to no more than 1 M Na ion concentration (or other salts) at a pH 7.0 to 8.3 and a temperature of at least 25° C. For example, conditions of 5× SSPE (750 mM NaCl, 50 mM NaPhosphate, 5 mM EDTA, pH 7.4) and a temperature of 25-30° C. are suitable for allele-specific probe hybridizations. For stringent conditions, see for example, Sambrook, Fritsche and Maniatis. "Molecular Cloning A Laboratory Manual" 2nd Ed. Cold Spring Harbor Press (1989) and Anderson "Nucleic Acid Hybridization" 1st Ed., BIOS Scientific Publishers Limited (1999), which are hereby incorporated by reference in their entireties for all purposes above.

As used herein, "hybridization probes" are nucleic acids (such as oligonucleotides) capable of binding in a base-specific manner to a complementary strand of nucleic acid. Such probes include peptide nucleic acids, as described in Nielsen et al., Science 254:1497-1500 (1991), Nielsen Curr. Opin. Biotechnol., 10:71-75 (1999) and other nucleic acid analogs and nucleic acid mimetics.

As used herein, "mRNA" or "mRNA transcripts" include, but are not limited to pre-mRNA transcript(s), transcript processing intermediates, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the mRNA transcript or a subsequence thereof has ultimately served as a template. Thus, a cDNA reverse transcribed from an mRNA, a cRNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the mRNA, cRNA transcribed from the cDNA, DNA amplified from the genes, RNA transcribed from amplified DNA, and the like.

As used herein, a "probe" is a molecule that can be recognized by a particular target. In some embodiments, a probe can be surface immobilized. Examples of probes that can be investigated by this invention include, but are not restricted to, agonists and antagonists for cell membrane receptors, toxins and venoms, viral epitopes, hormones (e.g. opioid peptides, steroids, etc.), hormone receptors, peptides, enzymes, enzyme substrates, cofactors, drugs, lectins, sugars, oligonucleotides, nucleic acids, oligosaccharides, proteins, and monoclonal antibodies.

As used herein, a "target" is a molecule that has an affinity for a given probe. Targets may be naturally-occurring or man-made molecules. Also, they can be employed in their unaltered state or as aggregates with other species. Targets may be attached, covalently or noncovalently, to a binding member, either directly or via a specific binding substance. Examples of targets which can be employed by this invention include, but are not restricted to, antibodies, cell membrane receptors, monoclonal antibodies and antisera reactive with specific antigenic determinants (such as on viruses, cells or other materials), drugs, oligonucleotides, nucleic acids, peptides, cofactors, lectins, sugars, polysaccharides, cells, cellular membranes, and organelles. Targets are sometimes referred to in the art as anti-probes. As the term targets is used herein, no difference in meaning is intended. A "Probe Target Pair" is formed when two macromolecules have combined through molecular recognition to form a complex.

BRIEF DESCRIPTION OF THE DRAWINGS

The patent or application file contains at least one drawing executed in color. Copes of this patent or patent application publication with color drawing(s) will be provided by the Office upon request and payment of the necessary fee.

The accompanying drawings, which are incorporated in and form a part of this specification, illustrate embodiments of the invention and, together with the description, serve to explain the disclosed principles of the invention:

FIGS. 9-508 each show the Genbank ID, Unigene ID, Unigene name, and sequence corresponding to the nucleic acid sequences shown in SEQ ID NO.'s 1-500, respectively.

DETAILED DESCRIPTION

Figure 1:
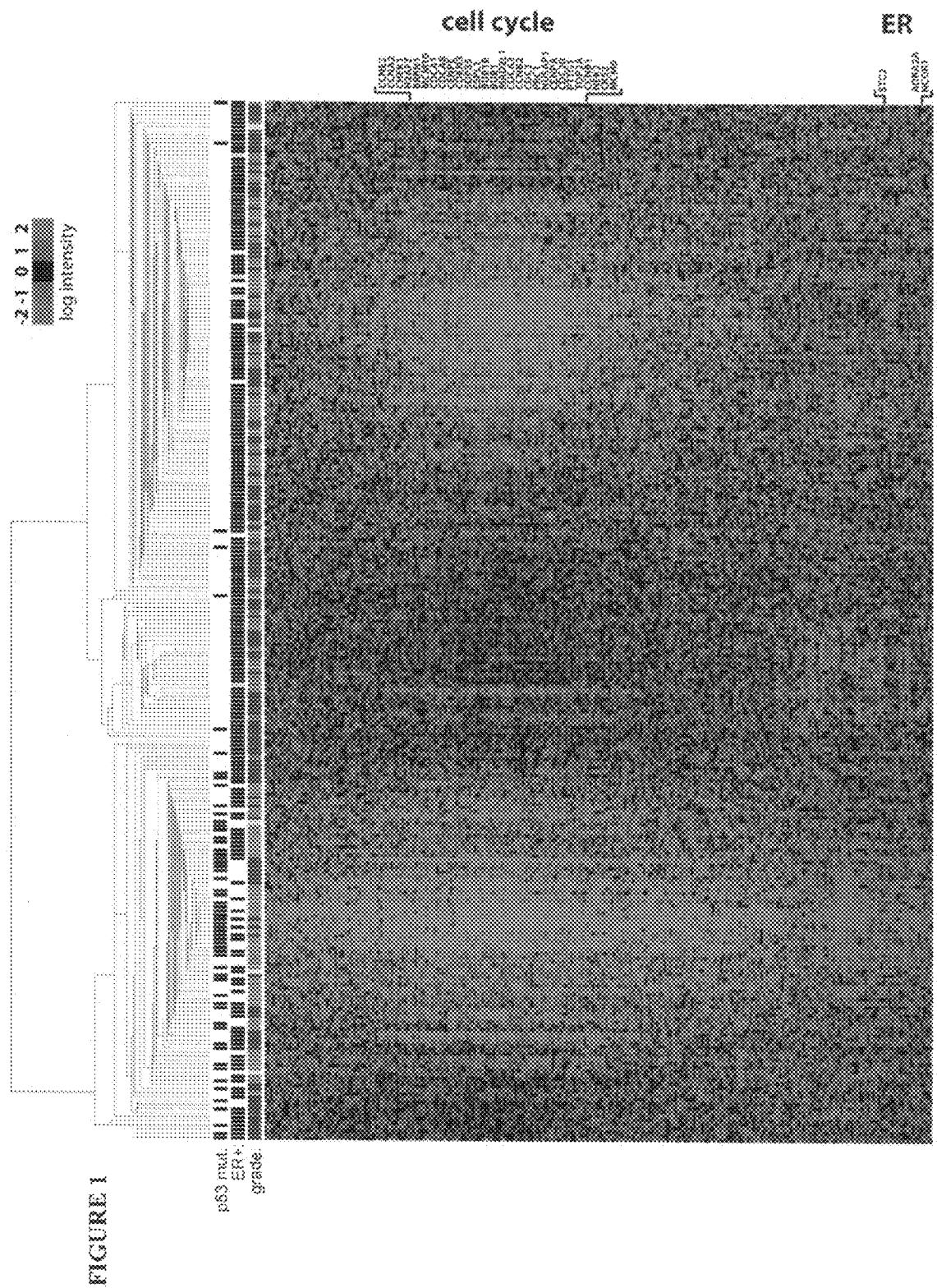
FIG. 1 shows hierarchical clustering of 257 tumors using the top 250 genes statistically correlated with p53 status for use in one disclosed embodiment of the invention.

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

Embodiments of the disclosed methods, systems, and compositions for classification, prognosis, and diagnosis of cancers will now be described. These methods, systems, and compositions provide a more useful measure of in vivo p53 functionality and thereby provide a better prognostic indicator of patient outcome as compared to p53 mutation status alone. Other advantages inherent in the disclosed embodiments of the methods, systems, and compositions will be apparent from the following description.

p53 mutations in cancer development and progression can result in trans-dominant suppression of the wild-type p53 allele conferring loss of p53 activity or an oncogenic gain of function independent of wildtype p53. Additionally, the altered activity of some effectors of p53 function, including those that directly influence p53 expression, may contribute to p53 deficiency recapitulating the p53-mutant phenotype. In breast cancer, these effects manifest in more aggressive tumors, therapeutic resistance, and poor clinical outcome.

In accordance with providing a more useful measure of in vivo p53 functionality, disclosed herein is a "p53 classifier", an expression signature deduced from differences in the molecular configurations of p53 wildtype and mutant tumors. The classifier may comprise a defined number of genes, for example, at least 3 genes. In other embodiments, the classifier may comprise from about 3 genes to about 500 genes. Table 1 provides a listing of the 500 genes. In some embodiments, an optimized p53 classifier comprises 32 genes (Table 2). The optimized 32-gene classifier could distinguish p53 mutant and wildtype tumors with significant accuracy and could predict recurrence and survival in populations representing all therapeutic groups. Moreover, the p53 classifier was a more significant predictor of survival than p53 mutation status alone and remained significant by multivariate analysis independent of other clinical predictors where p53 mutation status did not. Furthermore, downregulation of p53 expression in the absence of mutations was sufficient to induce a mutant (mt) phenotype tumor behaviour in both transcriptional activity and clinical outcome.

In independent datasets of both breast and liver cancers, and regardless of other clinical features, subsets of the optimized p53 classifier could predict p53 status with significant accuracy. As a predictor of disease-specific survival (DSS), the classifier significantly outperformed p53 mutational status alone in both a large patient cohort with heterogeneous treatment, as well as in a set of patients who received postoperative adjuvant endocrine therapy alone.

Moreover, in an independent cDNA microarray study comprised mostly of stage 3 patients who received chemotherapy in the neoadjuvant setting, a 9-gene subset of the p53 classifier was a highly significant predictor of both disease-specific and disease-free survival. The genes of the p53 classifier could accurately discern not only which patients would relapse and die following chemotherapy, but also which late stage patients would survive their cancer.

A 21-gene subset of the classifier could also significantly distinguish molecular subgroups of early-stage radiation-treated patients who would go on to develop a distant metastasis within 5 years from those who would not.

Therefore, by defining among other aspects, a p53 classifier described herein, the methods, systems and compositions of the present invention demonstrate a much greater impact of p53 on human tumor behaviour than previously appreciated and thereby provide a better approach for clinically assessing p53 function.

One aspect of the present invention provides a method for predicting disease outcome in a patient, the method comprising the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the patient. The disease outcome may be selected from the group consisting of disease-specific survival, disease-free survival, tumor recurrence and therapeutic response. The disease may be any cancer but is preferably breast cancer or liver cancer.

The predicted p53 mutational status may be obtained by ranking the differentially expressed genes according to their association with p53 mutational status, ER (estrogen receptor) status and histologic grade of the tumor. A multivariate ranking procedure such as a Linear Model Fit may be employed to rank the genes. The ranked genes may be subjected to supervised learning to enable them to distinguish between mutant and wildtype gene expression profiles. An example of a supervised learning method that may be employed is Diagonal Linear Discriminant Analysis (DLDA).

In some embodiments, the set of genes with the ability to predict p53 mutational status may comprise at least 3 genes, preferably about 3-500 genes and most preferably about 32 genes. The 32 genes making up the optimized p53 classifier may be selected from the group comprising the list of genes in Table 1. In some embodiments, the 32 genes may include GenBank accession numbers: AI961235 (SEQ ID NO: 23), BG271923 (SEQ ID NO: 22), NM_002466 (SEQ ID NO: 31), BC001651 (SEQ ID NO: 14), D38553 (SEQ ID NO: 11), AK000345 (SEQ ID NO: 26), AA742697 (SEQ ID NO: 21), AL080170 (SEQ ID NO: 30), BF245284 (SEQ ID NO: 27), BC004504 (SEQ ID NO: 8), H15261 (SEQ ID NO: 2), NM_000909 (SEQ ID NO: 9), NM_024843 (SEQ ID NO: 1), R73030 (SEQ ID NO: 29), NM_030896 (SEQ ID NO: 17), AI435828 (SEQ ID NO: 20), AL512727 (SEQ ID NO: 6), AW242997 (SEQ ID NO: 18), AI810764 (SEQ ID NO: 24), AI922323 (SEQ ID NO: 10), AL360204 (SEQ ID NO: 13), NM_003225 (SEQ ID NO: 32), NM_003226 (SEQ ID NO: 28), AW299538 (SEQ ID NO: 5), NM_003462 (SEQ ID NO: 16), AI990465 (SEQ ID NO: 25), NM_004392 (SEQ ID NO: 15), NM_001267 (SEQ ID NO: 7), AF269087 (SEQ ID NO: 4), AI826437 (SEQ ID NO: 3), AL355392 (SEQ ID NO: 12), and AU156421 (SEQ ID NO: 19).

The present invention also provides a method for predicting disease outcome in a late-stage breast cancer patient, the method comprising the steps of obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the late-stage breast cancer patient wherein the set of genes are selected from the group consisting of GenBank accession numbers: BG271923, NM_002466, D38553, NM_000909, NM_024843, R73030, NM_003226, AW299538 and AI990465. All GenBank accession numbers are associated with a sequence and a SEQ ID NO. as shown in FIGS. 9-508.

The present invention also provides a method for predicting clinical outcome in an early-stage, locally-treated breast cancer patient, the method comprising the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the early-stage, locally-treated breast cancer patient wherein the set of genes are selected from the group consisting of GenBank accession numbers: AI961235, BG271923, NM_002466, BC001651, D38553, AK000345, BC004504, NM_000909, NM_024843, R73030, AI435828, AI810764, AI922323, NM_003225, NM_003226, AW299538, NM_003462, AI990465, NM_004392, NM_001267 and AI826437.

The present invention also provides a method for predicting clinical outcome in a liver cancer patient, the method comprising the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the liver cancer patient wherein the set of genes are selected from the group consisting of GenBank accession numbers: NM_002466, BC001651, D38553, NM_024843, AI435828, AI810764, NM_003226 and AW299538.

The present invention also provides a method of identifying a group of genes for predicting disease outcome in a patient, the method comprising the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; ranking the differentially expressed genes according to their ability to predict p53 mutational status; training the ranked genes to distinguish between mutant and wildtype p53 gene expression profiles; obtaining a p53 classifier including a set of genes capable of predicting p53 mutational status; validating the p53 classifier in independent datasets; and assessing the ability of the p53 classifier to predict disease outcome in the patient.

In the above-disclosed method of identifying a group of genes for predicting disease outcome in a patient, the differentially expressed genes may be ranked by a multivariate ranking procedure according to their association with p53 status, ER (estrogen receptor) status and histologic grade of the tumor. The multivariate ranking procedure may be a Linear Model-Fit method or any other method known to one of skill in the art. The step of training may comprise employing a supervised learning method, such as Diagonal Linear Discriminant Analysis (DLDA) or any other supervised learning method known to one of skill in the art.

The p53 classifier disclosed above may comprise at least 3 genes, preferably between about 3-500 genes and more preferably about 32 genes. This 32-gene p53 classifier is an "optimized classifier" which may include genes selected from the group consisting of GenBank accession numbers: AI961235, BG271923, NM_002466, BC001651, D38553, AK000345, AA742697, AL080170, BF245284, BC004504, H15261, NM_000909, NM_024843, R73030, NM_030896, AI435828, AL512727, AW242997, AI810764, AI922323, AL360204, NM_003225, NM_003226, AW299538, NM_003462, AI990465, NM_004392, NM_001267, AF269087, AI826437, AL355392 and AU156421.

The disease outcome may be selected from the group consisting of disease-specific survival, disease-free survival, tumor recurrence and therapeutic response. In one disclosed embodiment, a 9-gene partial classifier may predict clinical outcome in a late-stage breast cancer patient. The 9-gene partial classifier may include genes selected from the group consisting of GenBank accession numbers: BG271923, NM_002466, D38553, NM_000909, NM_024843, R73030, NM_003226, AW299538 and AI990465.

In another disclosed embodiment, a 21-gene partial classifier may predict clinical outcome in an early-stage, locally-treated breast cancer patient. The 21-gene partial classifier may include genes selected from the group consisting of GenBank accession numbers: AI961235, BG271923, NM_002466, BC001651, D38553, AK000345, BC004504, NM_000909, NM_024843, R73030, AI435828, AI810764, AI922323, NM_003225, NM_003226, AW299538, NM_003462, AI990465, NM_004392, NM_001267 and AI826437.

In yet another disclosed embodiment, a 8-gene partial classifier may predict clinical outcome in a liver cancer patient. The 8-gene partial classifier may include genes selected from the group consisting of GenBank accession numbers: NM_002466, BC001651, D38553, NM_024843, AI435828, AI810764, NM_003226 and AW299538.

The present invention also provides a computer system for predicting disease outcome in a patient, the computer system comprising: a computer having a processor and a memory, the memory having executable code stored thereon for execution by the processor for performing the steps of: obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the patient.

The present invention also provides a diagnostic tool for predicting disease susceptibility in a patient comprising a plurality of genes capable of predicting p53 mutational status immobilized on a solid support. The solid support may be a microarray, for example. In one embodiment, the plurality of genes immobilized on the solid support may include genes selected from the group consisting of GenBank accession numbers: AI961235, BG271923, NM_002466, BC001651, D38553, AK000345, AA742697, AL080170, BF245284, BC004504, H15261, NM_000909, NM_024843, R73030, NM_030896, AI435828, AL512727, AW242997, AI810764, AI922323, AL360204, NM_003225, NM_003226, AW299538, NM_003462, AI990465, NM_004392, NM_001267, AF269087, AI826437, AL355392 and AU156421. In another embodiment, the plurality of genes immobilized on the solid support may include genes selected from the group consisting of GenBank accession numbers: BG271923, NM_002466, D38553, NM_000909, NM_024843, R73030, NM_003226, AW299538 and AI990465. In yet another embodiment, the plurality of genes immobilized on the solid support may include genes selected from the group consisting of GenBank accession numbers: AI961235, BG271923, NM_002466, BC001651, D38553, AK000345, BC004504, NM_000909, NM_024843, R73030, AI435828, AI810764, AI922323, NM_003225, NM_003226, AW299538, NM_003462, AI990465, NM_004392, NM_001267 and AI826437. In a still further embodiment, the plurality of genes immobilized on the solid support may include genes selected from the group consisting of GenBank accession numbers: NM_002466, BC001651, D38553, NM_024843, AI435828, AI810764, NM_003226 and AW299538.

The present invention also provides a nucleic acid array for predicting disease susceptibility in a patient comprising a solid support and displayed thereon nucleic acid probes corresponding to genes capable of predicting p53 mutational status in the patient. The nucleic acid array may comprise at least 8, 32, 100, 250 or 500 nucleic acid probes.

Thus, the disclosed methods, systems and compositions are capable of discerning p53-deficient from p53-enabled breast tumors and may be effective in gauging p53 activity in other cancer types. As much as 14% of breast tumors that are otherwise p53 wildtype at the DNA sequence level may be deficient for p53 by other means. Moreover, the classifier is a significant predictor of disease-specific survival and recurrence in various breast cancer populations and therefore will have clinical utility in predicting these endpoints, particularly in the context of therapeutic agents that function predominantly through p53-dependent cell death pathways.

EXAMPLES

Example 1

The Molecular Configurations of p53 Mutant and p53 Wildtype Tumors are Distinct

To gain insight into the molecular variation between p53 mutant (mt) and p53 wildtype (wt) breast tumors, high-density oligonucleotide microarrays were utilized to analyze a population-based series of 257 biopsies, all of which were previously sequenced for mutations in the p53 coding regions (Bergh, J., Norberg, T., Sjogren, S., Lindgren, A. & Holmberg, L. Complete sequencing of the p53 gene provides prognostic information in breast cancer patients, particularly in relation to adjuvant systemic therapy and radiotherapy. *Nat Med* 1, 1029-34 (1995), incorporated herein by reference).

The original patient material consisted of freshly frozen breast tumors from a population-based cohort of 315 women representing 65% of all breast cancers resected in Uppsala County during the time period Jan. 1, 1987 to Dec. 31, 1989 (Bergh et al., previously incorporated by reference). After surgery, the viable part of the fresh tumor was cut in two; one part was immediately frozen in isopentane and stored at −70° C. until analysis, and the other was fixed in 10% formalin and prepared for histopathologic examination. Frozen tumor tissue was available from 299 of the original 315 patients. Out of these, 270 had RNA of sufficient quantity and quality for microarray experiments, and after Affymetrix quality control, expression profiles of 260 tumors were further analysed. The present study was approved by the ethical committee at the Karolinska Institute.

Mutational analysis of the p53 gene (TP53) was carried out in the original 315 tumors as described previously in Bergh et al. (previously incorporated by reference). Among the 260 tumors included in the present study, 59 had p53 mutations found by cDNA sequence analysis of exons 2 to 11 (Bergh et al., previously incorporated by reference). In three samples p53 status could not be evaluated. Clinico-pathological characteristics were derived from the patient records and from routine clinical measurements at the time of diagnosis. Estrogen receptor status was determined by ligand binding assay as part of the routine clinical procedure. An experienced pathologist determined the Elston-Ellis grades of the tumors, classifying the tumors into low, medium and high-grade tumors (Elston, C. W. & Ellis, I. O. Pathological prognostic factors in breast cancer. I. The value of histological grade in breast cancer: experience from a large study with long-term follow-up. *Histopathology* 19, 403-10 (1991), incorporated herein by reference). Axillary lymph node metastases were found in 84 of these 260 patients while 166 were node-negative. Ten patients had unknown node status, as no axillary examination was performed due to advanced age or concomitant serious disease. Systemic adjuvant therapy was offered to all node-positive patients. In general, premenopausal women were offered chemotherapy and postmenopausal women received endocrine treatment. Out of the 260 patients included in the present study, 149 did not receive adjuvant therapy. Overall survival of the patients was based on information from the Swedish population registry, and date and cause of death were obtained from a review of the patient records in late 1999.

RNA from 59 tumors known to contain p53 mutations resulting in amino acid-level alterations, and from 198 tumors known to have wildtype p53 were analyzed on Affymetrix U133A and U133B arrays.

Extraction of total RNA was carried out using the Qiagen RNeasy Mini Kit (Qiagen, Germany). Frozen tumors were cut into small pieces and homogenized for around 30-40 seconds in test tubes (maximum 40 mg/tube) containing RLT buffer (RNeasy lysis buffer) with mercaptoethanol. The mixtures were then treated with Proteinase K for 10 minutes at 55° C., which in previous RNA extractions demonstrated improved RNA yield (Egyhazi, S. et al. Proteinase K added to the extraction procedure markedly increases RNA yield from primary breast tumors for use in microarray studies. *Clin Chem* 50, 975-6 (2004), incorporated herein by reference). In the following centrifugation steps on RNeasy columns, DNase treatment was also included to increase the RNA quality. The integrity of the RNA extracts was tested on an Agilent 2100 Bioanalyzer (Agilent Technologies, Rockville, Md., U.S.A), measuring the 28S:18S ribosomal RNA ratio. RNA extracts of high quality were stored at −70° C. until microarray analysis.

Preparation of in vitro transcription (IVT) products (i.e., target) and oligonucleotide array hybridization and scanning were performed according to the Affymetrix protocol (Affymetrix Inc., Santa Clara, Calif., U.S.A). First-strand cDNA was synthesized from a starting amount of 2-5 µg total RNA using a T7-linked oligo-dT primer, followed by second-strand synthesis. Double-stranded cDNA was purified using phenol/chloroform extraction and phase lock gel. Biotinylated cRNA targets were prepared from the cDNA templates in IVT reactions. The labeled cRNA targets were purified using Qiagen RNeasy Mini Kit and subsequently chemically fragmented. Ten µg of the fragmented, biotinylated cRNA was hybridized to the Affymetrix oligonucleotide human array set, HG-U133A&B, which contains 45,000 probe sets representing more than 39,000 transcripts derived from approximately 33,000 well-substantiated human genes. Hybridization was carried out in a hybridization oven at 45° C. and rotation was set at 60 rpm for 16 h. The arrays were washed and stained in the Fluidics Station 400 (Affymetrix Inc., Santa Clara, Calif., U.S.A) in accordance with the Affymetrix protocol. Staining was carried out using streptavidin-phycoerythrin (SAPE, final concentration of 10 µg/ml) and signal amplification with a biotinylated anti-streptavidin antibody and a second SAPE staining. The arrays were washed and scanned according to the manufacturer's instructions.

The raw expression data was processed using Microarray Suite 5.0 software (Affymetrix Inc., Santa Clara, Calif., U.S.A) and normalized using the global mean method. For each microarray, probeset signal values were scaled by adjusting the mean log intensity to a target signal value of 500. Samples with suboptimal average signal intensities were re-labeled and re-hybridized on new arrays. If microarray artifacts were visible, the samples were re-hybridized on new chips using the same fragmented probe, or alternatively, if the defective areas were small, the affected probes were censored from further analysis. The normalized expression data from both U133A and B chips were combined and natural log transformed.

The extent to which gene expression patterns could distinguish p53 mt and wt tumors was first investigated. By Wilcoxon rank-sum test 3,330 Affymetrix probe-sets representing ~2,770 distinct genes (according to UniGene build #167) were identified whose expression patterns distinguished p53 mt and wt tumors with a false discovery rate (FDR)-adjusted p value of p<0.001. A number of these genes were found to be known transcriptional targets of p53 including PERP, RRM2, SEMA3B, TAP1, GTSE1, CHECK1, and CHEK2. Shown in FIG. 1 is the result of hierarchical cluster analysis using the top 250 genes, all of which are associated with p53 status with FDR p<$5.9 \times 10^{-8}$. As expected from the gene selection criteria, the majority of p53 mt and wt tumors clustered into separate tumor groups. Of two predominant cluster nodes, 90% of the p53 mutants were found in one cluster (i.e., the "mutant-like" cluster), while 77% of p53 wt tumors segregated with the other (the "wildtype-like" cluster).

The hierarchical structure of the gene expression profiles was next investigated. As in the tumors, two predominant clusters were observed: one consisting of ~200 genes more highly expressed in the mutant-like tumor cluster, and the other representing ~50 genes more highly expressed in the wildtype-like cluster. Within the former, the genes most highly correlated with p53 mutant status were associated with cell cycle progression including, CDC2, CDC20, CCNB1, CCNB2, CKS2, CDCA1, CDCA3, CDCA8, CENPA, TOP2A, PTTG1 and MCM6. This finding is consistent with the observation that wt p53 has a negative regulatory effect on cell cycle genes. Of the genes more highly expressed in the wildtype-like cluster, the presence of several estrogen-regulated and ER status-associated genes including STC2, NCOR1, and ADRA2A was observed.

Further examination of the tumors revealed that in addition to p53 status, the predominant tumor clusters were also correlated with other clinical features, namely estrogen receptor (ER) status and tumor grade. The estrogen receptor status of a cell has been found to be correlated with cancer in several instances. Normal breast cells usually have receptors for estrogen. However, cancer cells arising in the breast do not always have receptors for estrogen. Breast cancers that have estrogen receptors are said to be "estrogen receptor-positive," while those breast cancers that do not possess estrogen receptors are "estrogen receptor-negative." In estrogen receptor-positive cancers, cancer cell growth is under the control of estrogen. In contrast, the growth of estrogen receptor-negative cancer cells is not governed by estrogen.

FIG. 1 shows hierarchical clustering of 257 tumors using the top 250 genes statistically correlated with p53 status. Tumors are represented in columns, genes are represented in rows. The degree of color saturation reflects the magnitude of the log expression signal; red hues denote higher expression levels while green hues indicate lower expression levels. The top row of black vertical bars indicates which breast tumors possess p53 mutations. The second row of bars indicates tumors that are ER positive. The third row of bars reflects histologic grade (Elston-Ellis grading system); green bars=grade I, blue bars=grade II, and red bars=grade III.

Segregating with the mutant-like cluster were observed 86% of estrogen receptor-negative (ER−) tumors ($p_{cs}$=1 7×10$^{-10}$), 96% of grade III tumors ($p_{cs}$=2.5×10$^{-19}$) and only 3% of grade I tumors ($p_{fe}$=6.9×10$^{-15}$). This result owes, in part, to the fact that the p53 mutants in this study are positively correlated with ER negativity ($p_{cs}$=1.7×10$^{-6}$) and grade III status ($p_{cs}$=1.2×10$^{-11}$), and is consistent with previous reports demonstrating that p53 mutant breast cancers are significantly correlated with negative ER status and higher tumor grade. See for example, Cattoretti, G., Rilke, F., Andreola, S., D'Amato, L. & Delia, D. P53 expression in breast cancer. *Int J Cancer* 41, 178-83 (1988); Isola, J., Visakorpi, T., Holli, K. & Kallioniemi, O. P. Association of overexpression of tumor suppressor protein p53 with rapid cell proliferation and poor prognosis in node-negative breast cancer patients. *J Natl Cancer Inst* 84, 1109-14 (1992); Andersen, T. I. et al. Prognostic significance of TP53 alterations in breast carcinoma. *Br J Cancer* 68, 540-8 (1993) and Bhargava, V. et al. The association of p53 immunopositivity with tumor proliferation and other prognostic indicators in breast cancer. *Mod Pathol* 7, 361-8 (1994), all of which are incorporated herein by reference.

However, it was also observed that among the p53 wt tumors within the mutant-like cluster, there, too, was a significant over-representation of ER-($p_{cs}$=2.0×10$^{-6}$) and grade III tumors ($p_{fe}$=7.1×10$^{-11}$). Thus, by univariate statistical analysis, a large number of genes highly associated with p53 status have been identified that are capable of segregating tumors in a manner correlated with p53 status, but also histologic grade and ER status.

Example 2

A Gene Expression Classifier for Predicting p53 Deficiency

The finding that a fraction of p53 wt tumors were found to cluster together with the majority of p53 mutants suggests the possibility that these tumors may in fact be p53 deficient through mechanisms other than p53 mutation. Conversely, the discovery of p53 mutants with molecular configurations reminiscent of most wt tumors suggests that these tumors might in fact express functionally intact p53. However, the tumor group assignments in this case were based on genes selected by a univariate ranking procedure that did not account for the association of p53 status with ER and grade status. This raised the possibility that, to some extent, the selected genes included those that are mostly grade and/or ER associated, which may have biased the clustering of the tumors towards these properties rather than p53 status, per se.

Therefore, a robust gene expression-based classifier for predicting p53 status was developed by designing a predictive model including a multivariate linear regression method known as linear model-fit (LMF) for ranking p53 status-correlated genes independent of histologic grade and ER status.

Figure 2:
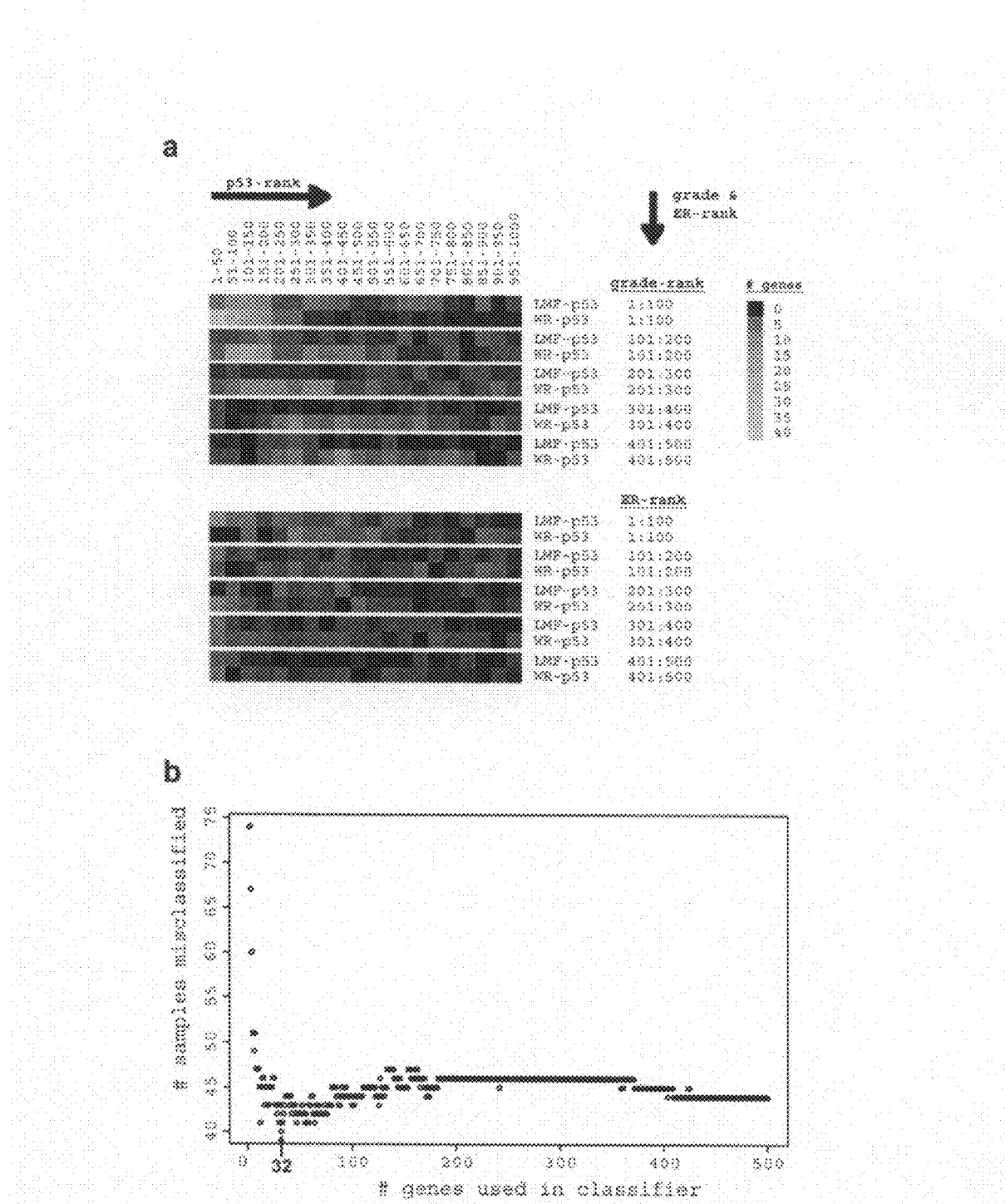
FIG. 2 shows optimization and results of a gene classifier for p53 status in accordance with a disclosed embodiment of the invention.

FIG. 2 shows optimization and results of a gene-based classifier for p53 status. Diagonal Linear Discriminant Analysis (DLDA) was employed for the supervised learning of p53 status using gene expression profiles ranked by the Linear Model-Fit method. (A): Analysis of overlap between grade/estrogen receptor (ER)-correlated genes and p53-correlated genes ranked by Wilcoxon rank-sum test or Linear Model fit. The heat maps indicate the number of genes correlated with tumor grade (upper heat map) or ER status (lower heat map) in 100-gene bins (rows) and also correlated with p53 status (columns; ranked in 50-gene bins); p53 correlated genes were ranked by LMF=Linear Model-Fit or WR=Wilcoxon rank-sum; grade correlated genes were ranked by KW=Kruskal-Wallis, and ER correlated genes by WR. (B): The accuracy of the classifier is plotted as a function of the number of genes used to build the classifier; the optimal classifier consisted of 32 genes and misclassified a total of 40 tumors. (C): The results of the classifier applied to the Uppsala dataset (257 tumors) using leave-one-out cross validation. Unigene symbols (build #167), Genbank accession numbers, and Affymetrix probe IDs (A.=U133A; B.=U133B) are shown.

For gene selection, a linear model was fitted to the gene expression data with expression level as the response, and p53 status, ER status and grade status as the predictor variables. As an initial filter for removing genes not well correlated with the predictor variables, all genes with a p-value fit greater than 0.001 were excluded. Using ER and grade as additional predictors allowed for filtering out genes whose expression patterns could be mostly explained by either ER or grade status. When applied, the LMF ranking procedure markedly reduced the rank of many known cell cycle-regulated genes compared to the univariate Wilcoxon rank-sum (WR) method, indicating that these genes are best explained by high grade rather than p53 status (FIG. 2A, upper panel). Conversely, it was observed that ER-associated genes moved up in the top ranked p53-associated genes by LMF, presumably because their lower ranking by WR resulted from a large number of more highly ranked grade-associated genes (FIG. 2A, lower panel).

For class prediction purposes, the genes were ranked in decreasing order of the absolute value of the p53 status coefficient. For building the classifier, a variant of the maximum likelihood method, DLDA (diagonal linear discriminant analysis) was employed. This had previously been applied to class determination problems using microarray data, described for example, in Dudoit, S., Frilyand, J. & Speed, T. P. Comparison of discrimination methods for the classification of tumors using gene expression data. *Journal of the American Statistical Association* 97, 77-87 (2002), incorporated herein by reference. The set of predictor genes with greatest classification accuracy was chosen by leave-one-out cross validation.

The accuracy of the classifier as a function of the number of genes it comprised is plotted in FIG. 2B. Of particular note was the observation that the accuracy of the tumor classification was highly stable, varying by only 2.7% (i.e., 7 tumors) regardless of whether the classifier comprised 7 genes or 500 genes. Genes in the 500-gene classifier are shown in Table 1 below. The optimal classifier, however, was achieved at 32 genes (Table 2), whereby 40 tumors (15.6%) were misclassified. 28 of the wt tumors (14%) were classified as mutant-like, while 12 mutants (20%) were misclassified as wildtype-like (FIG. 2C).

TABLE 1

| Rank Order | Affymetrix Probeset ID | Genbank (decimals removed) | UniGene Cluster ID (build #173) | UniGene Name | UniGene Symbol |
|---|---|---|---|---|---|
| 1 | A.217889_s_at | NM_024843 | Hs.31297 | cytochrome b reductase 1 | CYBRD1 |
| 2 | B.243929_at | H15261 | Hs.21948 | Transcribed sequences | |
| 3 | B.229975_at | AI826437 | Hs.283417 | Transcribed sequences | |
| 4 | B.223864_at | AF269087 | Hs.326736 | ankyrin repeat domain 30A | ANKRD30A |
| 5 | B.227081_at | AW299538 | Hs.75528 | nucleolar GTPase | HUMAUANTIG |
| 6 | A.215014_at | AL512727 | Hs.232127 | MRNA; cDNA DKFZp547P042 (from clone DKFZp547P042) | |
| 7 | A.206869_at | NM_001267 | Hs.97220 | Chondroadherin | CHAD |
| 8 | A.221585_at | BC004504 | Hs.331904 | calcium channel, voltage-dependent, gamma subunit 4 | CACNG4 |
| 9 | A.205440_s_at | NM_000909 | Hs.519057 | neuropeptide Y receptor Y1 | NPY1R |
| 10 | B.228969_at | AI922323 | Hs.226391 | anterior gradient 2 homolog (*Xenopus laevis*) | AGR2 |
| 11 | A.212949_at | D38553 | Hs.308045 | barren homolog (*Drosophila*) | BRRN1 |
| 12 | B.226067_at | AL355392 | Data not found | | |
| 13 | B.232855_at | AL360204 | Hs.283853 | MRNA full length insert cDNA clone EUROIMAGE 980547 | |
| 14 | A.221520_s_at | BC001651 | Hs.48855 | Cell division cycle associated 8 | CDCA8 |
| 15 | A.205472_s_at | NM_004392 | Hs.63931 | Dachshund homolog 1 (*Drosophila*) | DACH1 |
| 16 | A.205186_at | NM_003462 | Hs.406050 | Dynein, axonemal, light intermediate Polypeptide 1 | DNALI1 |
| 17 | A.221275_s_at | NM_030896 | Data not found | | |
| 18 | B.229030_at | AW242997 | Data not found | | |
| 19 | B.233413_at | AU156421 | Hs.518736 | CDNA FLJ13457 fis, clone PLACE1003343 | |
| 20 | A.203438_at | AI435828 | Hs.155223 | stanniocalcin 2 | STC2 |
| 21 | B.230378_at | AA742697 | Hs.62492 | secretoglobin, family 3A, member 1 | SCGB3A1 |
| 22 | B.238581_at | BG271923 | Hs.237809 | guanylate binding protein 5 | GBP5 |
| 23 | B.235343_at | AI961235 | Hs.96885 | hypothetical protein FLJ12505 | FLJ12505 |
| 24 | B.229150_at | AI810764 | Hs.102406 | Transcribed sequences | |
| 25 | A.205734_s_at | AI990465 | Hs.38070 | lymphoid nuclear protein related to AF4 | LAF4 |
| 26 | A.214079_at | AK000345 | Hs.272499 | Dehydrogenase/reductase (SDR family) member 2 | DHRS2 |
| 27 | B.238746_at | BF245284 | Hs.354427 | Transcribed sequence with weak similarity to protein ref: NP_286085.1 (E. coli) beta-D-galactosidase [*Escherichia coli* O157: H7 EDL933] | |
| 28 | A.204623_at | NM_003226 | Data not found | | |
| 29 | B.230863_at | R73030 | Hs.252938 | low density lipoprotein-related protein 2 | LRP2 |
| 30 | A.215047_at | AL080170 | Data not found | | |
| 31 | A.201710_at | NM_002466 | Hs.179718 | v-myb myeloblastosis viral oncogene homolog (avian)-like 2 | MYBL2 |
| 32 | A.205009_at | NM_003225 | Data not found | | |
| 33 | A.207750_at | NM_018510 | Data not found | | |
| 34 | B.237339_at | AI668620 | Hs.144151 | Transcribed sequences | |
| 35 | A.220540_at | NM_022358 | Hs.528664 | potassium channel, subfamily K, member 15 | KCNK15 |
| 36 | B.223062_s_at | BC004863 | Hs.286049 | phosphoserine aminotransferase 1 | PSAT1 |
| 37 | A.204508_s_at | BC001012 | Hs.512620 | carbonic anhydrase XII | CA12 |
| 38 | A.214451_at | NM_003221 | Hs.33102 | transcription factor AP-2 beta (activating enhancer binding protein 2 beta) | TFAP2B |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 39 | A.202870_s_at | NM_001255 | Hs.82906 | CDC20 cell division cycle 20 homolog (S. cerevisiae) | CDC20 |
| 40 | B.236641_at | AW183154 | Hs.3104 | kinesin family member 14 | KIF14 |
| 41 | A.219197_s_at | AI424243 | Hs.435861 | signal peptide, CUB domain, EGF-like 2 | SCUBE2 |
| 42 | A.207183_at | NM_006143 | Hs.92458 | G protein-coupled receptor 19 | GPR19 |
| 43 | A.220414_at | NM_017422 | Hs.180142 | calmodulin-like 5 | CALML5 |
| 44 | A.205354_at | NM_000156 | Hs.81131 | guanidinoacetate N-methyltransferase | GAMT |
| 45 | A.201755_at | NM_006739 | Hs.77171 | MCM5 minichromosome maintenance deficient 5, cell division cycle 46 (S. cerevisiae) | MCM5 |
| 46 | A.209459_s_at | AF237813 | Hs.1588 | 4-aminobutyrate aminotransferase | ABAT |
| 47 | B.225516_at | AA876372 | Hs.432978 | solute carrier family 7 (cationic amino acid transporter, y+ system), member 2 | SLC7A2 |
| 48 | A.204558_at | NM_003579 | Hs.66718 | RAD54-like (S. cerevisiae) | RAD54L |
| 49 | B.224428_s_at | AY029179 | Hs.435733 | cell division cycle associated 7 | CDCA7 |
| 50 | B.228854_at | AI492388 | Hs.356349 | zinc finger protein 145 (Kruppel-like, expressed in promyelocytic leukemia) | ZNF145 |
| 51 | A.208502_s_at | NM_002653 | Hs.84136 | paired-like homeodomain transcription factor 1 | PITX1 |
| 52 | B.226936_at | BG492359 | Hs.35962 | CDNA clone IMAGE: 4448513, partial cds | |
| 53 | B.230021_at | AI638593 | Hs.441708 | hypothetical protein MGC45866 | MGC45866 |
| 54 | A.206799_at | NM_006551 | Hs.204096 | secretoglobin, family 1D, member 2 | SCGB1D2 |
| 55 | A.202410_x_at | NM_000612 | Hs.349109 | insulin-like growth factor 2 (somatomedin A) | IGF2 |
| 56 | A.206509_at | NM_002652 | Hs.99949 | prolactin-induced protein | PIP |
| 57 | A.204885_s_at | NM_005823 | Hs.408488 | Mesothelin | MSLN |
| 58 | A.201496_x_at | AI889739 | Hs.78344 | myosin, heavy polypeptide 11, smooth muscle | MYH11 |
| 59 | A.206401_s_at | J03778 | Hs.101174 | microtubule-associated protein tau | MAPT |
| 60 | A.204734_at | NM_002275 | Hs.80342 | keratin 15 | KRT15 |
| 61 | A.204014_at | NM_001394 | Hs.417962 | dual specificity phosphatase 4 | DUSP4 |
| 62 | A.204775_at | NM_005441 | Hs.75238 | chromatin assembly factor 1, subunit B (p60) | CHAF1B |
| 63 | A.215356_at | AK023134 | Hs.130675 | hypothetical gene FLJ13072 | FLJ13072 |
| 64 | B.243049_at | AI791225 | Hs.444098 | MRNA; cDNA DKFZp434I1226 (from clone DKFZp434I1226) | |
| 65 | B.223721_s_at | AF176013 | Hs.260720 | DnaJ (Hsp40) homolog, subfamily C, member 12 | DNAJC12 |
| 66 | A.219918_s_at | NM_018123 | Data not found | | |
| 67 | B.243735_at | N58363 | Hs.8739 | signal transducer and activator of transcription 3 interacting protein 1 | STATIP1 |
| 68 | A.214188_at | AW665096 | Hs.15299 | HMBA-inducible | HIS1 |
| 69 | B.226980_at | AK001166 | Hs.421337 | DEP domain containing 1B | DEPDC1B |
| 70 | A.203071_at | NM_004636 | Hs.82222 | sema domain, immunoglobulin domain (Ig), short basic domain, secreted, (semaphorin) 3B | SEMA3B |
| 71 | A.206204_at | NM_004490 | Hs.411881 | growth factor receptor-bound protein 14 | GRB14 |
| 72 | A.205979_at | NM_002407 | Hs.97644 | secretoglobin, family 2A, member 1 | SCGB2A1 |
| 73 | A.208335_s_at | NM_002036 | Hs.517102 | Duffy blood group | FY |
| 74 | B.227550_at | AW242720 | Hs.388347 | MRNA; cDNA DKFZp686J0156 (from clone DKFZp686J0156) | |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 75 | A.220187_at | NM_024636 | Hs.44208 | likely ortholog of mouse tumor necrosis-alpha-induced adipose-related protein | FLJ23153 |
| 76 | B.226473_at | BE514414 | Hs.103305 | hypothetical protein MGC10561 | MGC10561 |
| 77 | A.204822_at | NM_003318 | Hs.169840 | TTK protein kinase | TTK |
| 78 | A.204724_s_at | NM_001853 | Hs.126248 | collagen, type IX, alpha 3 | COL9A3 |
| 79 | A.205240_at | NM_013296 | Hs.278338 | G-protein signalling modulator 2 (AGS3-like, C. elegans) | GPSM2 |
| 80 | A.205898_at | U20350 | Hs.78913 | chemokine (C—X3—C motif) receptor 1 | CX3CR1 |
| 81 | B.223381_at | AF326731 | Hs.234545 | cell division cycle associated 1 | CDCA1 |
| 82 | A.209243_s_at | AF208967 | Hs.201776 | paternally expressed 3 | PEG3 |
| 83 | A.204146_at | BE966146 | Data not found | | |
| 84 | B.228273_at | BG165011 | Hs.528654 | hypothetical protein FLJ11029 | FLJ11029 |
| 85 | A.204162_at | NM_006101 | Hs.414407 | kinetochore associated 2 | KNTC2 |
| 86 | A.204914_s_at | AI360875 | Hs.432638 | SRY (sex determining region Y)-box 11 | SOX11 |
| 87 | A.209309_at | D90427 | Hs.512643 | alpha-2-glycoprotein 1, zinc | AZGP1 |
| 88 | A.205048_s_at | NM_003832 | Data not found | | |
| 89 | B.227419_x_at | AW964972 | Hs.361171 | placenta-specific 9 | PLAC9 |
| 90 | B.232944_at | AK024132 | Hs.525858 | MRNA; cDNA DKFZp686I18125 (from clone DKFZp686I18125) | |
| 91 | B.224753_at | BE614410 | Hs.434886 | cell division cycle associated 5 | CDCA5 |
| 92 | A.210051_at | U78168 | Hs.8578 | Rap guanine nucleotide exchange factor (GEF) 3 | RAPGEF3 |
| 93 | A.215616_s_at | AB020683 | Hs.301011 | jumonji domain containing 2B | JMJD2B |
| 94 | A.210272_at | M29873 | Hs.415794 | cytochrome P450, family 2, subfamily B, polypeptide 7 pseudogene | CYP2B7 |
| 95 | B.222608_s_at | AK023208 | Hs.62180 | anillin, actin binding protein (scraps homolog, Drosophila) | ANLN |
| 96 | B.240724_at | AI668629 | Hs.25345 | Transcribed sequences | |
| 97 | B.228554_at | AL137566 | Hs.32405 | MRNA; cDNA DKFZp686A0815 (from clone DKFZp686A0815) | |
| 98 | A.205280_at | NM_000824 | Hs.32973 | glycine receptor, beta | GLRB |
| 99 | B.238659_at | AA760689 | Hs.210532 | KIAA0141 gene product | KIAA0141 |
| 100 | B.238116_at | AW959427 | Hs.98849 | dynein, cytoplasmic, light polypeptide 2B | DNCL2B |
| 101 | A.212448_at | AB007899 | Hs.249798 | neural precursor cell expressed, developmentally down-regulated 4-like | NEDD4L |
| 102 | B.235572_at | AI469788 | Hs.381225 | kinetochore protein Spc24 | Spc24 |
| 103 | A.209603_at | AI796169 | Hs.169946 | GATA binding protein 3 | GATA3 |
| 104 | A.205358_at | NM_000826 | Hs.335051 | glutamate receptor, ionotropic, AMPA 2 | GRIA2 |
| 105 | A.202095_s_at | NM_001168 | Hs.1578 | baculoviral IAP repeat-containing 5 (survivin) | BIRC5 |
| 106 | A.211470_s_at | AF186255 | Hs.38084 | sulfotransferase family, cytosolic, 1C, member 1 | SULT1C1 |
| 107 | A.205350_at | NM_004378 | Hs.346950 | cellular retinoic acid binding protein 1 | CRABP1 |
| 108 | A.205890_s_at | NM_006398 | Hs.44532 | ubiquitin D | UBD |
| 109 | A.209680_s_at | BC000712 | Hs.20830 | kinesin family member C1 | KIFC1 |
| 110 | B.240192_at | AI631850 | Hs.158992 | FLJ45983 protein | FLJ45983 |
| 111 | A.205225_at | NM_000125 | Hs.1657 | estrogen receptor 1 | ESR1 |
| 112 | B.235545_at | AI810054 | Hs.445098 | DEP domain containing 1 | DEPDC1 |
| 113 | B.224210_s_at | BC001147 | Hs.436924 | peroxisomal membrane protein 4, 24 kDa | PXMP4 |
| 114 | B.229381_at | AI732488 | Hs.29190 | hypothetical protein MGC24047 | MGC24047 |
| 115 | A.210523_at | D89675 | Hs.87223 | bone morphogenetic protein receptor, type IB | BMPR1B |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 116 | A.204641_at | NM_002497 | Hs.153704 | NIMA (never in mitosis gene a)-related kinase 2 | NEK2 |
| 117 | B.227764_at | AA227842 | Hs.21929 | hypothetical protein MGC52057 | MGC52057 |
| 118 | B.238900_at | BE669692 | Data not found | | |
| 119 | A.202580_x_at | NM_021953 | Hs.511941 | forkhead box M1 | FOXM1 |
| 120 | A.205366_s_at | NM_018952 | Hs.147465 | homeo box B6 | HOXB6 |
| 121 | B.227966_s_at | AA524895 | Hs.449141 | Hypothetical protein LOC285103, mRNA (cDNA clone IMAGE: 5273139), partial cds | |
| 122 | B.228069_at | AL138828 | Data not found | | |
| 123 | A.210163_at | AF030514 | Hs.103982 | chemokine (C—X—C motif) ligand 11 | CXCL11 |
| 124 | A.204855_at | NM_002639 | Hs.55279 | serine (or cysteine) proteinase inhibitor, clade B (ovalbumin), member 5 | SERPINB5 |
| 125 | B.229390_at | AV734646 | Hs.381220 | Full length insert cDNA clone ZA84A12 | |
| 126 | A.203213_at | AL524035 | Hs.334562 | cell division cycle 2, G1 to S and G2 to M | CDC2 |
| 127 | A.219555_s_at | NM_018455 | Hs.283532 | uncharacterized bone marrow protein BM039 | BM039 |
| 128 | B.227282_at | AB037734 | Hs.4993 | protocadherin 19 | PCDH19 |
| 129 | A.220085_at | NM_018063 | Hs.203963 | helicase, lymphoid-specific | HELLS |
| 130 | A.203256_at | NM_001793 | Hs.191842 | cadherin 3, type 1, P-cadherin (placental) | CDH3 |
| 131 | B.234992_x_at | BG170335 | Hs.293257 | epithelial cell transforming sequence 2 oncogene | ECT2 |
| 132 | A.204825_at | NM_014791 | Hs.184339 | maternal embryonic leucine zipper kinase | MELK |
| 133 | A.204126_s_at | NM_003504 | Hs.114311 | CDC45 cell division cycle 45-like (S. cerevisiae) | CDC45L |
| 134 | A.218663_at | NM_022346 | Hs.528669 | chromosome condensation protein G | HCAP-G |
| 135 | B.239962_at | AA972452 | Hs.292072 | Transcribed sequences | |
| 136 | A.205046_at | NM_001813 | Hs.75573 | centromere protein E, 312 kDa | CENPE |
| 137 | B.235717_at | AA180985 | Hs.285574 | zinc finger protein 229 | ZNF229 |
| 138 | B.233154_at | AK022197 | Hs.130581 | CDNA FLJ12135 fis, clone MAMMA1000307 | |
| 139 | A.206754_s_at | NM_000767 | Hs.1360 | cytochrome P450, family 2, subfamily B, polypeptide 6 | CYP2B6 |
| 140 | A.204533_at | NM_001565 | Hs.413924 | chemokine (C—X—C motif) ligand 10 | CXCL10 |
| 141 | A.212925_at | AA143765 | Hs.439180 | chromosome 19 open reading frame 21 | C19orf21 |
| 142 | B.223229_at | AB032931 | Hs.5199 | HSPC150 protein similar to ubiquitin-conjugating enzyme | HSPC150 |
| 143 | A.206599_at | NM_004695 | Hs.90911 | solute carrier family 16 (monocarboxylic acid transporters), member 5 | SLC16A5 |
| 144 | A.208103_s_at | NM_030920 | Hs.385913 | acidic (leucine-rich) nuclear phosphoprotein 32 family, member E | ANP32E |
| 145 | A.217953_at | AW189430 | Hs.348921 | PHD finger protein 3 | PHF3 |
| 146 | A.219686_at | NM_018401 | Hs.58241 | serine/threonine kinase 32B | STK32B |
| 147 | A.217276_x_at | AL590118 | Hs.301947 | kraken-like | dJ222E13.1 |
| 148 | B.234863_x_at | AK026197 | Hs.272027 | F-box protein 5 | FBXO5 |
| 149 | B.240465_at | BF508074 | Data not found | | |
| 150 | A.218308_at | NM_006342 | Hs.104019 | transforming, acidic coiled-coil containing protein 3 | TACC3 |
| 151 | A.206157_at | NM_002852 | Hs.2050 | pentaxin-related gene, rapidly induced by IL-1 beta | PTX3 |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 152 | A.209368_at | AF233336 | Hs.212088 | epoxide hydrolase 2, cytoplasmic | EPHX2 |
| 153 | B.230856_at | AI073396 | Hs.9398 | WD40 repeat protein Interacting with phosphoInositides of 49 kDa | WIPI49 |
| 154 | A.201890_at | NM_001034 | Hs.226390 | ribonucleotide reductase M2 polypeptide | RRM2 |
| 155 | A.205364_at | NM_003500 | Hs.9795 | acyl-Coenzyme A oxidase 2, branched chain | ACOX2 |
| 156 | B.225911_at | AL138410 | Hs.282832 | hypothetical protein LOC255743 | LOC255743 |
| 157 | B.244696_at | AI033582 | Hs.372254 | Transcribed sequences | |
| 158 | A.218730_s_at | NM_014057 | Hs.109439 | osteoglycin (osteoinductive factor, mimecan) | OGN |
| 159 | A.219498_s_at | NM_018014 | Hs.314623 | B-cell CLL/lymphoma 11A (zinc finger protein) | BCL11A |
| 160 | A.203702_s_at | AL043927 | Hs.169910 | tubulin tyrosine ligase-like family, member 4 | TTLL4 |
| 161 | A.206045_s_at | NM_003787 | Hs.23567 | nucleolar protein 4 | NOL4 |
| 162 | A.219919_s_at | NM_018276 | Hs.29173 | slingshot homolog 3 (*Drosophila*) | SSH3 |
| 163 | A.215779_s_at | BE271470 | Data not found | | |
| 164 | B.230966_at | AI859620 | Hs.437023 | interleukin 4 induced 1 | IL4I1 |
| 165 | A.206378_at | NM_002411 | Hs.46452 | secretoglobin, family 2A, member 2 | SCGB2A2 |
| 166 | A.221562_s_at | AF083108 | Hs.511950 | sirtuin (silent mating type information regulation 2 homolog) 3 (*S. cerevisiae*) | SIRT3 |
| 167 | A.221258_s_at | NM_031217 | Hs.301052 | kinesin family member 18A | DKFZP434G2226 |
| 168 | A.221577_x_at | AF003934 | Hs.296638 | growth differentiation factor 15 | GDF15 |
| 169 | B.235709_at | H37811 | Hs.20575 | growth arrest-specific 2 like 3 | GAS2L3 |
| 170 | B.235171_at | AI354636 | Data not found | | |
| 171 | A.207437_at | NM_006491 | Hs.292511 | neuro-oncological ventral antigen 1 | NOVA1 |
| 172 | A.203638_s_at | NM_022969 | Hs.404081 | fibroblast growth factor receptor 2 (bacteria-expressed kinase, keratinocyte growth factor receptor, craniofacial dysostosis 1, Crouzon syndrome, Pfeiffer syndrome, Jackson-Weiss syndrome) | FGFR2 |
| 173 | A.218542_at | NM_018131 | Hs.14559 | chromosome 10 open reading frame 3 | C10orf3 |
| 174 | A.217613_at | AW173720 | Hs.176227 | hypothetical protein FLJ11155 | FLJ11155 |
| 175 | B.241310_at | AI685841 | Hs.161354 | Transcribed sequences | |
| 176 | A.205234_at | NM_004696 | Hs.351306 | solute carrier family 16 (monocarboxylic acid transporters), member 4 | SLC16A4 |
| 177 | A.203726_s_at | NM_000227 | Hs.83450 | laminin, alpha 3 | LAMA3 |
| 178 | A.221436_s_at | NM_031299 | Hs.30114 | cell division cycle associated 3 | CDCA3 |
| 179 | A.205242_at | NM_006419 | Hs.100431 | chemokine (C—X—C motif) ligand 13 (B-cell chemoattractant) | CXCL13 |
| 180 | A.218726_at | NM_018410 | Hs.104859 | hypothetical protein DKFZp762E1312 | DKFZp762E1312 |
| 181 | A.218856_at | NM_016629 | Data not found | | |
| 182 | B.226661_at | T90295 | Data not found | | |
| 183 | A.218741_at | NM_024053 | Hs.208912 | chromosome 22 open reading frame 18 | C22orf18 |
| 184 | A.206201_s_at | NM_005924 | Hs.77858 | mesenchyme homeo box 2 (growth arrest-specific homeo box) | MEOX2 |
| 185 | B.236184_at | AI798959 | Hs.131686 | Transcribed sequences | |
| 186 | A.220651_s_at | NM_018518 | Hs.198363 | MCM10 minichromosome maintenance deficient 10 (*S. cerevisiae*) | MCM10 |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 187 | A.216331_at | AK022548 | Hs.74369 | integrin, alpha 7 | ITGA7 |
| 188 | B.232105_at | AU148391 | Hs.181245 | MRNA; cDNA DKFZp686B15184 (from clone DKFZp686B15184) | |
| 189 | B.226907_at | N32557 | Hs.192822 | protein phosphatase 1, regulatory (inhibitor) subunit 14C | PPP1R14C |
| 190 | B.234976_x_at | BG324504 | Hs.321127 | solute carrier family 4, sodium bicarbonate cotransporter, member 5 | SLC4A5 |
| 191 | A.211323_s_at | L38019 | Hs.149900 | inositol 1,4,5-triphosphate receptor, type 1 | ITPR1 |
| 192 | A.206391_at | NM_002888 | Hs.82547 | retinoic acid receptor responder (tazarotene induced) 1 | RARRES1 |
| 193 | A.222348_at | AW971134 | Hs.212787 | KIAA0303 protein | KIAA0303 |
| 194 | B.235845_at | AI380207 | Hs.368802 | Sp5 transcription factor | SP5 |
| 195 | B.239233_at | AA744613 | Hs.292925 | KIAA1212 | KIAA1212 |
| 196 | A.208383_s_at | NM_002591 | Hs.1872 | phosphoenolpyruvate carboxykinase 1 (soluble) | PCK1 |
| 197 | A.214440_at | NM_000662 | Hs.155956 | N-acetyltransferase 1 (arylamine N-acetyltransferase) | NAT1 |
| 198 | B.230456_at | BE501559 | Hs.380824 | NS5ATP13TP2 protein | NS5ATP13TP2 |
| 199 | A.219650_at | NM_017669 | Data not found | | |
| 200 | A.210052_s_at | AF098158 | Hs.9329 | TPX2, microtubule-associated protein homolog (Xenopus laevis) | TPX2 |
| 201 | A.204468_s_at | NM_005424 | Hs.78824 | tyrosine kinase with immunoglobulin and epidermal growth factor homology domains | TIE |
| 202 | A.209531_at | BC001453 | Hs.26403 | glutathione transferase zeta 1 (maleylacetoacetate isomerase) | GSTZ1 |
| 203 | A.217014_s_at | AC004522 | Data not found | | |
| 204 | B.227155_at | R10289 | Hs.3844 | LIM domain only 4 | LMO4 |
| 205 | A.213520_at | NM_004260 | Hs.31442 | RecQ protein-like 4 | RECQL4 |
| 206 | B.241505_at | BF513468 | Data not found | | |
| 207 | A.213451_x_at | BE044614 | Hs.411644 | tenascin XB | TNXB |
| 208 | A.214389_at | AI733515 | Hs.148907 | hypothetical protein MGC52019 | MGC52019 |
| 209 | B.235229_at | AI694413 | Data not found | | |
| 210 | A.203571_s_at | NM_006829 | Hs.511763 | chromosome 10 open reading frame 116 | C10orf116 |
| 211 | B.237168_at | AA708016 | Data not found | | |
| 212 | A.203915_at | NM_002416 | Hs.77367 | chemokine (C—X—C motif) ligand 9 | CXCL9 |
| 213 | B.224509_s_at | BC006399 | Hs.155839 | reticulon 4 interacting protein 1 | RTN4IP1 |
| 214 | A.206093_x_at | NM_007116 | Data not found | | |
| 215 | A.205613_at | NM_016524 | Hs.258326 | B/K protein | LOC51760 |
| 216 | B.236885_at | AI651930 | Data not found | | |
| 217 | B.236341_at | AI733018 | Hs.247824 | cytotoxic T-lymphocyte-associated protein 4 | CTLA4 |
| 218 | A.221854_at | AI378979 | Hs.313068 | plakophilin 1 (ectodermal dysplasia/ skin fragility syndrome) | PKP1 |
| 219 | A.201291_s_at | NM_001067 | Hs.156346 | topoisomerase (DNA) II alpha 170 kDa | TOP2A |
| 220 | B.232734_at | AK023230 | Hs.139709 | hypothetical protein FLJ12572 | FLJ12572 |
| 221 | A.214053_at | AW772192 | Hs.7888 | CDNA FLJ44318 fis, clone TRACH3000780 | |
| 222 | B.231195_at | AI492376 | Data not found | | |
| 223 | A.212956_at | AB020689 | Hs.411317 | KIAA0882 protein | KIAA0882 |
| 224 | A.214404_x_at | AI307915 | Hs.79414 | SAM pointed domain containing ets transcription factor | SPDEF |
| 225 | B.237086_at | AI693336 | Hs.163484 | forkhead box A1 | FOXA1 |
| 226 | A.205948_at | NM_007050 | Hs.225952 | protein tyrosine phosphatase, receptor type, T | PTPRT |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 227 | A.214745_at | AW665865 | Hs.193143 | KIAA1069 protein | KIAA1069 |
| 228 | A.208029_s_at | NM_018407 | Hs.296398 | lysosomal associated protein transmembrane 4 beta | LAPTM4B |
| 229 | A.205569_at | NM_014398 | Hs.10887 | lysosomal-associated membrane protein 3 | LAMP3 |
| 230 | B.235046_at | AA456099 | Hs.176376 | Transcribed sequences | |
| 231 | A.203130_s_at | NM_004522 | Data not found | | |
| 232 | B.238584_at | W52934 | Hs.113009 | hypothetical protein FLJ22527 | FLJ22527 |
| 233 | A.220986_s_at | NM_030953 | Hs.169333 | tigger transposable element derived 6 | TIGD6 |
| 234 | A.205023_at | D14134 | Hs.446554 | RAD51 homolog (RecA homolog, *E. coli*) (*S. cerevisiae*) | RAD51 |
| 235 | B.237048_at | AW451103 | Hs.71371 | Clone IMAGE: 4797878, mRNA, partial cds | |
| 236 | B.225400_at | BF111780 | Hs.440663 | chromosome 1 open reading frame 19 | C1orf19 |
| 237 | A.206134_at | NM_014479 | Hs.145296 | ADAM-like, decysin 1 | ADAMDEC1 |
| 238 | A.214469_at | NM_021052 | Hs.121017 | histone 1, H2ae | HIST1H2AE |
| 239 | A.202188_at | NM_014669 | Hs.295014 | nucleoporin 93 kDa | NUP93 |
| 240 | A.204678_s_at | U90065 | Hs.376874 | potassium channel, subfamily K, member 1 | KCNK1 |
| 241 | B.231517_at | AW243917 | Hs.196566 | ZYG-11A early embryogenesis protein mRNA, complete cds | |
| 242 | A.210387_at | BC001131 | Data not found | | |
| 243 | B.223623_at | AF325503 | Hs.43125 | esophageal cancer related gene 4 protein | ECRG4 |
| 244 | B.228729_at | N90191 | Hs.23960 | cyclin B1 | CCNB1 |
| 245 | A.204904_at | NM_002060 | Hs.296310 | gap junction protein, alpha 4, 37 kDa (connexin 37) | GJA4 |
| 246 | B.237301_at | BF433570 | Hs.144479 | Transcribed sequences | |
| 247 | B.239623_at | N93197 | Hs.49573 | CDNA FLJ44606 fis, clone BRACE2005991 | |
| 248 | B.242601_at | AA600175 | Hs.443169 | hypothetical protein LOC253012 | LOC253012 |
| 249 | B.223861_at | AL136755 | Hs.298312 | HORMA domain containing protein | NOHMA |
| 250 | A.213122_at | AI096375 | Hs.173094 | TSPY-like 5 | TSPYL5 |
| 251 | A.204482_at | NM_003277 | Hs.505337 | claudin 5 (transmembrane protein deleted in velocardiofacial syndrome) | CLDN5 |
| 252 | B.240512_x_at | H10766 | Hs.23406 | potassium channel tetramerisation domain containing 4 | KCTD4 |
| 253 | A.209642_at | AF043294 | Hs.287472 | BUB1 budding uninhibited by benzimidazoles 1 homolog (yeast) | BUB1 |
| 254 | B.239669_at | AW006409 | Hs.532143 | Transcribed sequences | |
| 255 | B.243028_x_at | BE045392 | Data not found | | |
| 256 | A.210721_s_at | AB040812 | Hs.32539 | p21(CDKN1A)-activated kinase 7 | PAK7 |
| 257 | A.215942_s_at | BF973178 | Hs.122552 | G-2 and S-phase expressed 1 | GTSE1 |
| 258 | B.222895_s_at | AA918317 | Hs.57987 | B-cell CLL/lymphoma 11B (zinc finger protein) | BCL11B |
| 259 | A.203708_at | NM_002600 | Hs.188 | phosphodiesterase 4B, cAMP-specific (phosphodiesterase E4 dunce homolog, *Drosophila*) | PDE4B |
| 260 | B.235178_x_at | AL120674 | Data not found | | |
| 261 | B.236471_at | AI949827 | Hs.404741 | nuclear factor (erythroid-derived 2)-like 3 | NFE2L3 |
| 262 | A.220024_s_at | NM_020956 | Hs.205457 | periaxin | PRX |
| 263 | A.213711_at | NM_002281 | Hs.170925 | keratin, hair, basic, 1 | KRTHB1 |
| 264 | A.204766_s_at | NM_002452 | Hs.413078 | nudix (nucleoside diphosphate linked moiety X)-type motif 1 | NUDT1 |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 265 | B.227182_at | AW966474 | Hs.88417 | sushi domain containing 3 | SUSD3 |
| 266 | A.220061_at | NM_017888 | Hs.122939 | hypothetical protein FLJ20581 | FLJ20581 |
| 267 | A.220117_at | NM_024697 | Hs.99256 | hypothetical protein FLJ22419 | FLJ22419 |
| 268 | B.237395_at | AV700083 | Hs.176588 | cytochrome P450, family 4, subfamily Z, polypeptide 1 | CYP4Z1 |
| 269 | B.226034_at | BE222344 | Hs.346735 | Clone IMAGE: 3881549, mRNA | |
| 270 | A.207038_at | NM_004694 | Hs.42645 | solute carrier family 16 (monocarboxylic acid transporters), member 6 | SLC16A6 |
| 271 | B.238541_at | BE544855 | Hs.236572 | CDNA clone IMAGE: 5265729, partial cds | |
| 272 | A.207702_s_at | NM_012301 | Hs.22599 | atrophin-1 interacting protein 1 | AIP1 |
| 273 | B.236496_at | AW006352 | Hs.159643 | chromosome 14 open reading frame 66 | C14orf66 |
| 274 | A.215300_s_at | AK022172 | Hs.396595 | flavin containing monooxygenase 5 | FMO5 |
| 275 | A.219580_s_at | NM_024780 | Hs.145807 | transmembrane channel-like 5 | TMC5 |
| 276 | B.230469_at | AW665138 | Hs.58559 | pleckstrin homology domain containing, family K member 1 | PLEKHK1 |
| 277 | B.243636_s_at | AI042373 | Hs.132917 | Transcribed sequences | |
| 278 | A.203764_at | NM_014750 | Hs.77695 | discs, large homolog 7 (Drosophila) | DLG7 |
| 279 | A.209936_at | AF107493 | Hs.439480 | RNA binding motif protein 5 | RBM5 |
| 280 | A.207961_x_at | NM_022870 | Data not found | | |
| 281 | B.233059_at | AK026384 | Hs.199776 | potassium inwardly-rectifying channel, subfamily J, member 3 | KCNJ3 |
| 282 | A.221583_s_at | AI129381 | Hs.354740 | potassium large conductance calcium-activated channel, subfamily M, alpha member 1 | KCNMA1 |
| 283 | B.228762_at | AW151924 | Hs.159142 | lunatic fringe homolog (Drosophila) | LFNG |
| 284 | A.219415_at | NM_020659 | Hs.268728 | tweety homolog 1 (Drosophila) | TTYH1 |
| 285 | A.203397_s_at | BF063271 | Hs.278611 | UDP-N-acetyl-alpha-D-galactosamine:polypeptide N-acetylgalactosaminyltransferase 3(GalNAc-T3) | GALNT3 |
| 286 | A.206091_at | NM_002381 | Hs.278461 | matrilin 3 | MATN3 |
| 287 | A.217562_at | BF589529 | Hs.497208 | DBCCR1-like | DBCCR1L |
| 288 | B.229764_at | AW629527 | Hs.338851 | FLJ41238 protein | FLJ41238 |
| 289 | B.232544_at | AU144916 | Hs.222056 | CDNA FLJ11572 fis, clone HEMBA1003373 | |
| 290 | A.203819_s_at | AU160004 | Hs.79440 | IGE-II mRNA-binding protein 3 | IMP-3 |
| 291 | A.206102_at | NM_021067 | Data not found | | |
| 292 | A.210738_s_at | AF011390 | Hs.5462 | solute carrier family 4, sodium bicarbonate cotransporter, member 4 | SLC4A4 |
| 293 | B.236285_at | AI631846 | Hs.137007 | hypothetical protein BC009980 | LOC113730 |
| 294 | A.209800_at | AF061812 | Hs.432448 | keratin 16 (focal non-epidermolytic palmoplantar keratoderma) | KRT16 |
| 295 | A.218211_s_at | NM_024101 | Hs.297405 | Melanophilin | MLPH |
| 296 | B.223361_at | AF116682 | Hs.238205 | chromosome 6 open reading frame 115 | C6orf115 |
| 297 | B.242776_at | AA584428 | Hs.12742 | zinc finger, CCHC domain containing 6 | ZCCHC6 |
| 298 | A.221909_at | BF984207 | Data not found | | |
| 299 | A.209408_at | U63743 | Hs.69360 | kinesin family member 2C | KIF2C |
| 300 | A.215812_s_at | U41163 | Data not found | | |
| 301 | B.232238_at | AK001380 | Hs.121028 | asp (abnormal spindle)-like, microcephaly associated (Drosophila) | ASPM |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 302 | B.223126_s_at | AF312864 | Hs.12532 | chromosome 1 open reading frame 21 | C1orf21 |
| 303 | A.212141_at | X74794 | Hs.460184 | MCM4 minichromosome maintenance deficient 4 (*S. cerevisiae*) | MCM4 |
| 304 | A.222325_at | AW974812 | Hs.433049 | Transcribed sequences | |
| 305 | B.224314_s_at | AF277174 | Hs.130946 | egl nine homolog 1 (*C. elegans*) | EGLN1 |
| 306 | A.207470_at | NM_017535 | Hs.194369 | arginine-glutamic acid dipeptide (RE) repeats | RERE |
| 307 | B.228504_at | AI828648 | Hs.406684 | sodium channel, voltage-gated, type VII, alpha | SCN7A |
| 308 | B.228245_s_at | AW594320 | Hs.405557 | ovostatin 2 | OVOS2 |
| 309 | A.213712_at | BF508639 | Hs.58488 | catenin (cadherin-associated protein), alpha-like 1 | CTNNAL1 |
| 310 | A.213998_s_at | AW188131 | Hs.250696 | DEAD (Asp-Glu-Ala-Asp) box polypeptide 17 | DDX17 |
| 311 | B.230323_s_at | AW242836 | Hs.355663 | hypothetical protein BC016153 | LOC120224 |
| 312 | A.212713_at | R72286 | Hs.296049 | microfibrillar-associated protein 4 | MFAP4 |
| 313 | B.230316_at | R49343 | Hs.430576 | SEC14-like 2 (*S. cerevisiae*) | SEC14L2 |
| 314 | A.32128_at | Y13710 | Hs.16530 | chemokine (C—C motif) ligand 18 (pulmonary and activation-regulated) | CCL18 |
| 315 | B.236718_at | AI278445 | Hs.43334 | Transcribed sequence with weak similarity to protein sp: P39189 (*H. sapiens*) ALU2_HUMAN Alu subfamily SB sequence Contamination warning entry | |
| 316 | B.227030_at | BG231773 | Hs.371680 | CDNA FLJ46579 fis, clone THYMU3042758 | |
| 317 | B.235658_at | AW058580 | Hs.151444 | Transcribed sequences | |
| 318 | B.230622_at | BE552393 | Hs.100469 | myeloid/lymphoid or mixed-lineage leukemia (trithorax homolog, *Drosophila*); translocated to, 4 | MLLT4 |
| 319 | A.205213_at | NM_014716 | Hs.337242 | centaurin, beta 1 | CENTB1 |
| 320 | A.221754_s_at | AI341234 | Hs.6191 | coronin, actin binding protein, 1B | CORO1B |
| 321 | A.214612_x_at | U10691 | Data not found | | |
| 322 | A.203463_s_at | H05668 | Hs.7407 | epsin 2 | EPN2 |
| 323 | B.237350_at | AW027968 | Hs.454465 | Similar to CDNA sequence BC021608 (LOC143941), mRNA | |
| 324 | A.220789_s_at | NM_004749 | Hs.231411 | transforming growth factor beta regulator 4 | TBRG4 |
| 325 | A.208496_x_at | NM_003534 | Hs.247813 | histone 1, H3g | HIST1H3G |
| 326 | A.202992_at | NM_000587 | Hs.78065 | complement component 7 | C7 |
| 327 | A.210432_s_at | AF225986 | Hs.300717 | sodium channel, voltage-gated, type III, alpha | SCN3A |
| 328 | B.239525_at | AI733041 | Hs.374649 | hypothetical protein DKFZp547A023 | DKFZp547A023 |
| 329 | B.244344_at | AW135316 | Hs.105448 | protein kinase, lysine deficient 4 | PRKWNK4 |
| 330 | B.236773_at | AI635931 | Hs.147613 | Transcribed sequences | |
| 331 | A.207118_s_at | NM_004659 | Hs.211819 | matrix metalloproteinase 23B | MMP23B |
| 332 | B.228558_at | AL518291 | Data not found | | |
| 333 | B.230269_at | AI963605 | Hs.406256 | Transcribed sequences | |
| 334 | B.228262_at | AW237462 | Hs.127951 | hypothetical protein FLJ14503 | FLJ14503 |
| 335 | B.238878_at | AA496211 | Hs.157208 | aristaless related homeobox | ARX |
| 336 | B.228559_at | BF111626 | Hs.55028 | CDNA clone IMAGE: 6043059, partial cds | |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 337 | A.204542_at | NM_006456 | Hs.288215 | sialyltransferase 7 ((alpha-N-acetylneuraminyl-2,3-beta-galactosyl-1,3)-N-acetyl galactosaminide alpha-2,6-sialyltransferase) B | SIAT7B |
| 338 | B.224839_s_at | BF310919 | Hs.355862 | glutamic pyruvate transaminase (alanine aminotransferase) 2 | GPT2 |
| 339 | A.209755_at | AF288395 | Hs.158244 | nicotinamide nucleotide adenylyltransferase 2 | NMNAT2 |
| 340 | B.229019_at | AI694320 | Hs.6295 | zinc finger protein 533 | ZNF533 |
| 341 | A.218039_at | NM_016359 | Hs.279905 | nucleolar and spindle associated protein 1 | NUSAP1 |
| 342 | A.205947_s_at | NM_003382 | Hs.170560 | vasoactive intestinal peptide receptor 2 | VIPR2 |
| 343 | B.244107_at | AW189097 | Hs.444393 | Transcribed sequences | |
| 344 | B.228241_at | AI827789 | Hs.100686 | breast cancer membrane protein 11 | BCMP11 |
| 345 | A.204750_s_at | BF196457 | Hs.95612 | desmocollin 2 | DSC2 |
| 346 | A.204130_at | NM_000196 | Hs.1376 | hydroxysteroid (11-beta) dehydrogenase 2 | HSD11B2 |
| 347 | A.220119_at | NM_022140 | Hs.104746 | erythrocyte membrane protein band 4.1 like 4A | EPB41L4A |
| 348 | B.230238_at | AI744123 | Hs.13308 | hypothetical protein LOC134548 | LOC134548 |
| 349 | A.204719_at | NM_007168 | Hs.58351 | ATP-binding cassette, sub-family A (ABC1), member 8 | ABCA8 |
| 350 | A.219961_s_at | NM_018474 | Hs.436632 | chromosome 20 open reading frame 19 | C20orf19 |
| 351 | A.219132_at | NM_021255 | Hs.44038 | pellino homolog 2 (*Drosophila*) | PELI2 |
| 352 | A.220584_at | NM_025094 | Data not found | | |
| 353 | B.227350_at | AI807356 | Hs.127797 | CDNA FLJ11381 fis, clone HEMBA1000501 | |
| 354 | B.230800_at | AV699353 | Hs.443428 | adenylate cyclase 4 | ADCY4 |
| 355 | A.204709_s_at | NM_004856 | Hs.270845 | kinesin family member 23 | KIF23 |
| 356 | B.243526_at | AI968904 | Hs.174373 | hypothetical protein LOC349136 | LOC349136 |
| 357 | A.219491_at | NM_024036 | Hs.148438 | leucine rich repeat and fibronectin type III domain containing 4 | LRFN4 |
| 358 | A.204686_at | NM_005544 | Hs.390242 | insulin receptor substrate 1 | IRS1 |
| 359 | B.228066_at | AI870951 | Hs.445574 | Transcribed sequence with weak similarity to protein pir: I37984 (*H. sapiens*) I37984 keratin 9, type I, cytoskeletal - human | |
| 360 | A.206795_at | NM_004101 | Hs.42502 | coagulation factor II (thrombin) receptor-like 2 | F2RL2 |
| 361 | A.209464_at | AB011446 | Hs.442658 | aurora kinase B | AURKB |
| 362 | B.229082_at | AI141520 | Data not found | | |
| 363 | B.240304_s_at | BG484769 | Hs.115838 | CDNA FLJ44282 fis, clone TRACH2003516 | |
| 364 | B.227702_at | AA557324 | Hs.439760 | cytochrome P450, family 4, subfamily X, polypeptide 1 | CYP4X1 |
| 365 | B.235077_at | BF956762 | Hs.418271 | maternally expressed 3 | MEG3 |
| 366 | A.202705_at | NM_004701 | Hs.194698 | cyclin B2 | CCNB2 |
| 367 | A.209616_s_at | S73751 | Hs.278997 | carboxylesterase 1 (monocyte/macrophage serine esterase 1) | CES1 |
| 368 | A.211441_x_at | AF280113 | Hs.306220 | cytochrome P450, family 3, subfamily A, polypeptide 43 | CYP3A43 |
| 369 | B.241861_at | R89089 | Data not found | | |
| 370 | B.228425_at | BF056746 | Hs.516311 | MRNA; cDNA DKFZp686E10196 (from clone DKFZp686E10196); complete cds | |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 371 | A.213938_at | Z38645 | Hs.476384 | CAZ-associated structural protein | CAST |
| 372 | A.202409_at | X07868 | Data not found | | |
| 373 | A.219115_s_at | NM_014432 | Hs.288240 | Interleukin 20 receptor, alpha | IL20RA |
| 374 | A.39248_at | N74607 | Hs.234642 | Aquaporin 3 | AQP3 |
| 375 | B.227232_at | T58044 | Data not found | | |
| 376 | B.230319_at | AI222435 | Hs.90250 | CDNA FLJ36413 fis, clone THYMU2010816. | |
| 377 | A.203287_at | NM_005558 | Hs.18141 | Ladinin 1 | LAD1 |
| 378 | A.218009_s_at | NM_003981 | Hs.344037 | Protein regulator of cytokinesis 1 | PRC1 |
| 379 | A.222351_at | AW009884 | Hs.431156 | Protein phosphatase 2 (formerly 2A), Regulatory subunit A (PR 65), beta isoform | PPP2R1B |
| 380 | A.204794_at | NM_004418 | Hs.1183 | Dual specificity phosphatase 2 | DUSP2 |
| 381 | A.211456_x_at | AF333388 | Data not found | | |
| 382 | A.206296_x_at | NM_007181 | Hs.95424 | Mitogen-activated protein kinase kinase Kinase kinase 1 | MAP4K1 |
| 383 | A.205357_s_at | NM_000685 | Hs.197063 | Angiotensin II receptor, type 1 | AGTR1 |
| 384 | B.244385_at | AA766126 | Data not found | | |
| 385 | A.202235_at | NM_003051 | Hs.75231 | Solute carrier family 16 (monocarboxylic Acid transporters), member 1 | SLC16A1 |
| 386 | B.240422_at | AI935710 | Hs.530456 | Transcribed sequences | |
| 387 | B.230644_at | AI375083 | Hs.31522 | Leucine rich repeat and fibronectin type III Domain containing 5 | LRFN5 |
| 388 | A.220238_s_at | NM_018846 | Hs.376793 | Kelch-like 7 (*Drosophila*) | KLHL7 |
| 389 | B.235004_at | AI677701 | Hs.201619 | RNA binding motif protein 24 | RBM24 |
| 390 | A.201397_at | NM_006623 | Hs.3343 | Phosphoglycerate dehydrogenase | PHGDH |
| 391 | A.208010_s_at | NM_012411 | Hs.87860 | Protein tyrosine phosphatase, Non-receptor type 22 (lymphoid) | PTPN22 |
| 392 | A.210138_at | AF074979 | Hs.141492 | Regulator of G-protein signalling 20 | RGS20 |
| 393 | A.203828_s_at | NM_004221 | Hs.943 | Natural killer cell transcript 4 | NK4 |
| 394 | A.205862_at | NM_014668 | Hs.438037 | GREB1 protein | GREB1 |
| 395 | A.219984_s_at | NM_020386 | Hs.36761 | HRAS-like suppressor | HRASLS |
| 396 | A.203358_s_at | NM_004456 | Hs.444082 | Enhancer of zeste homolog 2 (*Drosophila*) | EZH2 |
| 397 | B.232570_s_at | AL356755 | Data not found | | |
| 398 | A.212613_at | AI991252 | Hs.376046 | Butyrophilin, subfamily 3, member A2 | BTN3A2 |
| 399 | B.238077_at | T75480 | Hs.13982 | Potassium channel tetramerisation Domain containing 6 | KCTD6 |
| 400 | A.217023_x_at | AF099143 | Data not found | | |
| 401 | B.242093_at | AW263497 | Hs.97774 | Synaptotagmin-like 5 | SYTL5 |
| 402 | B.232979_at | AK000839 | Hs.306410 | CDNA FLJ20832 fis, clone ADKA03033 | |
| 403 | B.232286_at | AA572675 | Hs.188173 | CDNA FLJ12187 fis, clone MAMMA1000831 | |
| 404 | A.203223_at | NM_004703 | Hs.390163 | Rabaptin, RAB GTPase binding effector protein 1 | RABEP1 |
| 405 | B.225834_at | AL135396 | Hs.339665 | Similar to RIKEN cDNA 2700049P18 gene | MGC57827 |
| 406 | A.205591_at | NM_006334 | Hs.74376 | Olfactomedin 1 | OLFM1 |
| 407 | B.228058_at | AI559190 | Hs.105887 | Similar to common salivary protein 1 | LOC124220 |
| 408 | A.207828_s_at | NM_005196 | Data not found | | |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 409 | A.222379_at | AI002715 | Hs.348522 | Potassium voltage-gated channel, Isk-related family, member 4 | KCNE4 |
| 410 | A.210084_x_at | AF206665 | Hs.405479 | Tryptase, alpha | TPS1 |
| 411 | B.233249_at | AU155297 | Hs.287562 | CDNA FLJ13313 fis, clone OVARC1001489 | |
| 412 | B.232948_at | AU147218 | Hs.297369 | CDNA FLJ12111 fis, clone MAMMA1000025 | |
| 413 | B.229033_s_at | AA143060 | Hs.454758 | Melanoma associated antigen (mutated) 1 | MUM1 |
| 414 | B.229623_at | BF508344 | Hs.112742 | CDNA clone IMAGE: 6301163, containing Frame-shift errors | |
| 415 | A.222339_x_at | AI054381 | Hs.293379 | Transcribed sequences | |
| 416 | A.205347_s_at | NM_021992 | Hs.56145 | Thymosin, beta, identified in neuroblastoma Cells | TMSNB |
| 417 | B.229245_at | AA535361 | Hs.343666 | Phosphoinositol 3-phosphate-binding Protein-3 | PEPP3 |
| 418 | B.225491_at | AL157452 | Hs.349088 | Solute carrier family 1 (glial high affinity Glutamate transporter), member 2 | SLC1A2 |
| 419 | B.239594_at | BF110735 | Data not found | | |
| 420 | A.213906_at | AW592266 | Hs.300592 | v-myb myeloblastosis viral oncogene homolog (avian)-like 1 | MYBL1 |
| 421 | B.223757_at | AF305836 | Hs.406958 | Deiodinase, iodothyronine, type III opposite Strand | DIO3OS |
| 422 | B.242296_x_at | BF594828 | Hs.91145 | Transcribed sequences | |
| 423 | B.236312_at | AA938184 | Hs.44380 | Transcribed sequence with weak similarity to protein ref: NP_071385.1 (*H. sapiens*) hypothetical protein FLJ20958 [*Homo sapiens*] | |
| 424 | B.227529_s_at | BF511276 | Hs.197081 | A kinase (PRKA) anchor protein (gravin) 12 | AKAP12 |
| 425 | A.221928_at | AI057637 | Hs.234898 | acetyl-Coenzyme A carboxylase beta | ACACB |
| 426 | B.244013_at | AI084430 | Hs.113919 | Hypothetical protein LOC374969 | LOC374969 |
| 427 | A.219769_at | NM_020238 | Hs.142179 | inner centromere protein antigens 135/155 kDa | INCENP |
| 428 | B.239758_at | AI142126 | Hs.26125 | Transcribed sequences | |
| 429 | B.239913_at | AI421796 | Hs.132591 | solute carrier family 10 (sodium/bile acid cotransporter family), member 4 | SLC10A4 |
| 430 | A.211226_at | AF080586 | Hs.158351 | galanin receptor 2 | GALR2 |
| 431 | A.206023_at | NM_006681 | Hs.418367 | Neuromedin U | NMU |
| 432 | A.210538_s_at | U37546 | Data not found | | |
| 433 | B.232277_at | AA643687 | Hs.149425 | solute carrier family 28 (sodium-coupled nucleoside transporter), member 3 | SLC28A3 |
| 434 | A.207339_s_at | NM_002341 | Hs.376208 | Lymphotoxin beta (TNF superfamily, member 3) | LTB |
| 435 | A.37145_at | M85276 | Data not found | | |
| 436 | B.243837_x_at | AA639707 | Hs.443239 | Transcribed sequences | |
| 437 | A.221198_at | NM_021920 | Data not found | | |
| 438 | B.233442_at | AU147500 | Hs.287499 | CDNA FLJ12196 fis, clone MAMMA1000867 | |
| 439 | B.232545_at | AF176701 | Hs.442734 | F-box and leucine-rich repeat protein 9 | FBXL9 |
| 440 | B.238323_at | BG387172 | Hs.528776 | TEA domain family member 2 | TEAD2 |
| 441 | B.231993_at | AK026784 | Hs.301296 | CDNA: FLJ23131 fis, clone LNG08502 | |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 442 | B.224212_s_at | AF169689 | Hs.247734 | Protocadherin alpha 2 | PCDHA2 |
| 443 | B.231560_at | D59759 | Data not found | | |
| 444 | A.201195_s_at | AB018009 | Hs.184601 | solute carrier family 7 (cationic amino acid transporter, y+ system), member 5 | SLC7A5 |
| 445 | B.239185_at | AI284184 | Hs.388917 | ATP-binding cassette, sub-family A (ABC1), member 9 | ABCA9 |
| 446 | B.232776_at | AU145289 | Hs.193223 | CDNA FLJ11646 fis, clone HEMBA1004394 | |
| 447 | A.212865_s_at | BF449063 | Hs.512555 | collagen, type XIV, alpha 1 (undulin) | COL14A1 |
| 448 | B.228750_at | AI693516 | Hs.28625 | Transcribed sequences | |
| 449 | B.241577_at | AI732794 | Data not found | | |
| 450 | A.209125_at | J00269 | Data not found | | |
| 451 | B.238898_at | BG028463 | Hs.163734 | Transcribed sequences | |
| 452 | A.203548_s_at | BF672975 | Hs.180878 | lipoprotein lipase | LPL |
| 453 | B.230363_s_at | BE858808 | Hs.52463 | inositol polyphosphate-5-phosphatase F | INPP5F |
| 454 | A.221111_at | NM_018402 | Hs.272350 | interleukin 26 | IL26 |
| 455 | B.226597_at | AI348159 | Hs.76277 | polyposis locus protein 1-like 1 | DP1L1 |
| 456 | A.218169_at | NM_018052 | Hs.445061 | Hypothetical protein FLJ10305 | FLJ10305 |
| 457 | A.206107_at | NM_003834 | Hs.65756 | regulator of G-protein signalling 11 | RGS11 |
| 458 | B.230158_at | AA758751 | Hs.484250 | Hypothetical protein FLJ32949 | FLJ32949 |
| 459 | B.244706_at | AA521309 | Hs.380763 | similar to hypothetical protein FLJ10883 | LOC115294 |
| 460 | B.228648_at | AA622495 | Hs.10844 | leucine-rich alpha-2-glycoprotein 1 | LRG1 |
| 461 | B.237047_at | AI678049 | Hs.508819 | CDNA FLJ40458 fis, clone TESTI2041778 | |
| 462 | A.205671_s_at | NM_002120 | Hs.1802 | major histocompatibility complex, class II, DO beta | HLA-DOB |
| 463 | A.217167_x_at | AJ252550 | Data not found | | |
| 464 | A.205399_at | NM_004734 | Hs.21355 | Doublecortin and CaM kinase-like 1 | DCAMKL1 |
| 465 | B.236646_at | BE301029 | Hs.226422 | Hypothetical protein FLJ31166 | FLJ31166 |
| 466 | A.203354_s_at | AW117368 | Hs.408177 | ADP-ribosylation factor guanine nucleotide factor 6 | EFA6R |
| 467 | B.237252_at | AW119113 | Hs.2030 | Thrombomodulin | THBD |
| 468 | A.206341_at | NM_000417 | Hs.130058 | interleukin 2 receptor, alpha | IL2RA |
| 469 | A.210525_x_at | BC001787 | Hs.123232 | Chromosome 14 open reading frame 143 | C14orf143 |
| 470 | A.214897_at | AB007975 | Hs.492779 | MRNA, chromosome 1 specific transcript KIAA0506. | |
| 471 | A.203362_s_at | NM_002358 | Hs.79078 | MAD2 mitotic arrest deficient-like 1 (yeast) | MAD2L1 |
| 472 | B.230874_at | AI241896 | Hs.48653 | CDNA FLJ39593 fis, clone SKNSH2001222 | |
| 473 | B.224396_s_at | AF316824 | Hs.435655 | asporin (LRR class 1) | ASPN |
| 474 | A.208305_at | NM_000926 | Hs.2905 | Progesterone receptor | PGR |
| 475 | B.223867_at | AF334676 | Hs.414648 | tektin 3 | TEKT3 |
| 476 | A.211363_s_at | AF109294 | Hs.459541 | Methylthioadenosine phosphorylase | MTAP |
| 477 | B.232267_at | AL162032 | Hs.23644 | G protein-coupled receptor 133 | GPR133 |
| 478 | B.244121_at | BE835502 | Data not found | | |
| 479 | B.242808_at | AI733287 | Hs.203755 | Transcribed sequence with moderate similarity to protein sp: P12947 (*H. sapiens*) RL31_HUMAN 60S ribosomal protein L31 | |
| 480 | A.215465_at | AL080207 | Hs.134585 | ATP-binding cassette, sub-family A (ABC1), member 12 | ABCA12 |

TABLE 1-continued

| Rank Order | Affymetrix Probeset ID | Genbank (decimals removed) | UniGene Cluster ID (build #173) | UniGene Name | UniGene Symbol |
|---|---|---|---|---|---|
| 481 | A.210244_at | U19970 | Hs.51120 | Cathelicidin antimicrobial peptide | CAMP |
| 482 | A.204603_at | NM_003686 | Hs.47504 | Exonuclease 1 | EXO1 |
| 483 | B.232986_at | AC074331 | Data not found | | |
| 484 | B.225241_at | BG253437 | Hs.356289 | steroid sensitive gene 1 | URB |
| 485 | B.230760_at | BF592062 | Hs.169859 | zinc finger protein, Y-linked | ZFY |
| 486 | A.209480_at | M16276 | Hs.409934 | major histocompatibility complex, class II, DQ beta 1 | HLA-DQB1 |
| 487 | A.206664_at | NM_001041 | Hs.429596 | Sucrase-isomaltase (alpha-glucosidase) | SI |
| 488 | A.206291_at | NM_006183 | Hs.80962 | Neurotensin | NTS |
| 489 | A.222085_at | AW452357 | Hs.27373 | Hypothetical gene supported by AK075564; BC060873 | LOC400451 |
| 490 | A.214899_at | AC007842 | Data not found | | |
| 491 | B.240174_at | BF512871 | Hs.193522 | Transcribed sequence with moderate Similarity to protein sp: P39188 (*H. sapiens*) ALU1_HUMAN Alu subfamily J sequence Contamination warning entry | |
| 492 | A.219148_at | NM_018492 | Hs.104741 | T-LAK cell-originated protein kinase | TOPK |
| 493 | B.226303_at | AA706788 | Hs.46531 | Phosphoglucomutase 5 | PGM5 |
| 494 | B.222848_at | BC005400 | Hs.164018 | Leucine zipper protein FKSG14 | FKSG14 |
| 495 | A.202270_at | NM_002053 | Hs.62661 | Guanylate binding protein 1, interferon-inducible, 67 kDa | GBP1 |
| 496 | A.205266_at | NM_002309 | Hs.2250 | leukemia inhibitory factor (cholinergic differentiation factor) | LIF |
| 497 | B.239008_at | AW606588 | Hs.430335 | Transcribed sequence with weak similarity to protein sp: P39195 (*H. sapiens*) ALU8_HUMAN Alu subfamily SX sequence contamination warning entry | |
| 498 | B.228194_s_at | AI675836 | Hs.348923 | sortilin-related VPS10 domain containing receptor 1 | SORCS1 |
| 499 | A.215514_at | AL080072 | Hs.21195 | MRNA; cDNA DKFZp564M0616 (from clone DKFZp564M0616) | |
| 500 | A.219010_at | NM_018265 | Hs.73239 | Hypothetical protein FLJ10901 | FLJ10901 |

The 500-gene classifier: The genes are ranked according to their correlation with p53 status. The genes are identified by their GenBank Accession Nos., Affymetrix Probeset IDs, Unigene IDs, Unigene Names and Unigene Symbols.

For sequences and SEQ ID NOs for the genes described in Table 1, see FIGS. 9-508 in which each of the sequences for the above genes is shown and is associated with a GenBank Accession No., Unigene ID, and/or a Unigene Name, and a SEQ ID NO.

Example 3

The p53 Classifier has Significant Accuracy in Two Independent Datasets

Figure 3:
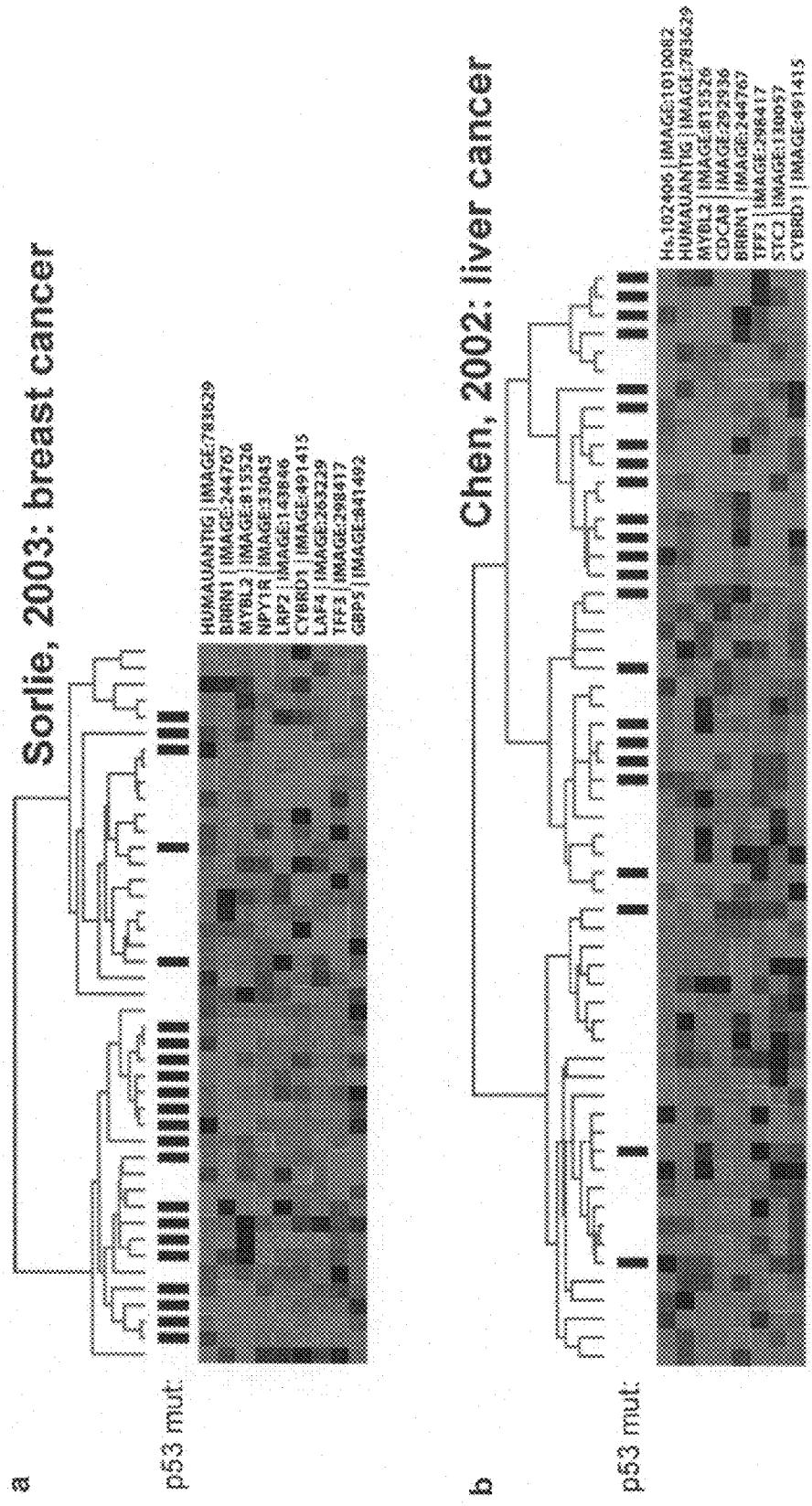
FIG. 3 shows that genes of the classifier can predict p53 status in independent cDNA microarray datasets in accordance with a disclosed embodiment of the invention.

The performance of the p53 classifier in the context of independent datasets was then evaluated. FIG. 3 shows that genes of the classifier can predict p53 status in independent cDNA microarray datasets. (A) A 9-gene subset of the 32-gene classifier can predict p53 status in an independent breast cancer dataset. 9 genes of our classifier were selected based on their presence in 50% or more of the tumors. The tumors used in the analysis were required to have expression data present for >50% of the genes. (B) An 8-gene subset of the p53 classifier can predict p53 status in an independent liver cancer dataset. 8 overlapping genes were selected based on their presence in 90% or more of the tumors. The tumors used in the analysis were required to have expression data present for >50% of the genes. (A&B) Black vertical bars indicate p53 mutant status. Gene symbols (Unigene build #167) and corresponding IMAGE clone IDs (from the original studies) are listed. The hierarchical clustergrams are shown. Genes (rows) and tumors (columns) were clustered. In the tumor dendrograms, the green branch denotes the wild-type-like configurations, and the red branch the mutant-like profiles.

Two publicly available microarray datasets where p53 status was known, were therefore accessed: a breast cancer study by Sorlie et al (Sorlie, T. et al. Repeated observation of breast tumor subtypes in independent gene expression data sets. *Proc Natl Acad Sci USA* 100, 8418-23 (2003), incorporated herein by reference) and a liver cancer study by Chen et al (Chen, X. et al. Gene expression patterns in human liver cancers. *Mol Biol Cell* 13, 1929-39 (2002), incorporated herein by reference). Both studies were conducted on cDNA microarray platforms.

In the Sorlie dataset, 69 breast tumors were sequenced for p53 mutations. This subset of tumors was queried for the availability of expression data corresponding to the genes of the classifier. Twenty-eight genes in the classifier mapped to UniGene IDs (build #167). Though over half of these genes mapped to the Sorlie et. al. microarray, few were expressed in the majority of the tumors, and a number of tumors possessed measurements for less than half of the genes. Only 9 genes in the classifier were found to correspond to cDNA probes (representing 9 different genes) having expression measurements present in >50% of the tumors, where the tumors possessed measurements for >50% of the genes (resulting in a subset of 44 well-sampled tumors). Using this 9-gene subset of the classifier to hierarchically cluster the tumors (FIG. 3A), 77% of the p53 mt tumors clustered into one branch, and 77% of the wildtypes clustered into the other ($p_{cs}=3.0\times10^{-4}$) recapitulating the robust predictive capability of the classifier.

A cDNA-microarray based liver cancer dataset where p53 status was ascertained by immunohistochemistry, IHC (Chen, X. et al. Gene expression patterns in human liver cancers. *Mol Biol Cell* 13, 1929-39 (2002), incorporated herein by reference) was next analyzed. In this study, p53 protein levels were ascertained by IHC. Here, 8 classifier genes could be mapped to all 59 tumors assayed for p53 status (with each gene having data present in 90% or more of all tumors, and where each tumor contained data for >50% of the genes). With similar statistical significance as that seen in the breast cancer dataset (i.e, $p_{fe}=3.5\times10^{-4}$), this 8-gene subset of the classifier was able to cluster the HCC samples into two predominant clusters correlated with p53 status: 87% of the mutants in one cluster, and 61% of the wildtypes in the other (FIG. 3B). Together, these observations suggest that the genes comprising the p53 classifier are robust in their ability to classify not only breast tumors based on p53 status, but also liver cancers, and therefore may have generalizable utility in predicting p53 status in other cancer types.

TABLE 2

| Genbank Accession No. | Affymetrix Probeset ID | UniGene ID (build #171) | UniGene Name (build #167) | UniGene Symbol |
|---|---|---|---|---|
| AI961235 | B.235343_at | Hs.96885 | Hypothetical protein FLJ12505 | FLJ12505 |
| BG271923 | B.238581_at | Hs.237809 | Guanylate binding protein 5 | GBP5 |
| NM_002466 | A.201710_at | Hs.179718 | v-myb myeloblastosis viral oncogene homolog (avian)-like 2 | MYBL2 |
| BC001651 | A.221520_s_at | Hs.48855 | Cell division cycle associated 8 | CDCA8 |
| D38553 | A.212949_at | Hs.308045 | Barren homolog (*Drosophila*) | BRRN1 |
| AK000345 | A.214079_at | Hs.272499 | Dehydrogenase/reductase (SDR family) member 2 | DHRS2 |
| AA742697 | B.230378_at | Hs.62492 | Secretoglobin, family 3A, member 1 | SCGB3A1 |
| AL080170 | A.215047_at | | | |
| BF245284 | B.238746_at | Hs.354427 | Transcribed sequences | |
| BC004504 | A.221585_at | Hs.331904 | Calcium channel, voltage-dependent, gamma subunit 4 | CACNG4 |
| H15261 | B.243929_at | Hs.21948 | Transcribed sequences | |
| NM_000909 | A.205440_s_at | Hs.519057 | Neuropeptide Y receptor Y1 | NPY1R |
| NM_024843 | A.217889_s_at | Hs.31297 | Cytochrome b reductase 1 | CYBRD1 |
| R73030 | B.230863_at | Hs.252938 | Low density lipoprotein-related protein 2 | LRP2 |
| NM_030896 | A.221275_s_at | | | |
| AI435828 | A.203438_at | Hs.155223 | Stanniocalcin 2 | STC2 |
| AL512727 | A.215014_at | Hs.232127 | MRNA; cDNA DKFZp547P042 (from clone DKFZp547P042) | |
| AW242997 | B.229030_at | | | |
| AI810764 | B.229150_at | Hs.102406 | Transcribed sequences | |
| AI922323 | B.228969_at | Hs.226391 | Anterior gradient 2 homolog (*Xenopus laevis*) | AGR2 |
| AL360204 | B.232855_at | Hs.283853 | MRNA full length insert cDNA clone EUROIMAGE 980547 | |
| NM_003225 | A.205009_at | Hs.350470 | Trefoil factor 1 (breast cancer, estrogen-inducible sequence expressed in) | TFF1 |
| NM_003226 | A.204623_at | Hs.82961 | Trefoil factor 3 (intestinal) | TFF3 |
| AW299538 | B.227081_at | Hs.75528 | Nucleolar GTPase | HUMAUAN TIG |
| NM_003462 | A.205186_at | Hs.406050 | Dynein, axonemal, light intermediate polypeptide 1 | DNALI1 |
| AI990465 | A.205734_s_at | Hs.38070 | Lymphoid nuclear protein related to AF4 | LAF4 |
| NM_004392 | A.205472_s_at | Hs.63931 | Dachshund homolog (*Drosophila*) | DACH1 |
| NM_001267 | A.206869_at | Hs.97220 | Chondroadherin | CHAD |
| AF269087 | B.223864_at | Hs.326736 | Breast cancer antigen NY-BR-1 | NY-BR-1 |
| AI826437 | B.229975_at | Hs.283417 | Transcribed sequences | |
| AL355392 | B.226067_at | | | |
| AU156421 | B.233413_at | Hs.518736 | CDNA FLJ13457 fis, clone PLACE1003343. | |

Optimized 32-gene p53 Classifier: The genes are identified by their GenBank Accession Nos., Affymetrix Probeset IDs, Unigene IDs, Unigene Names and Unigene Symbols.

Example 4

Figure 4:
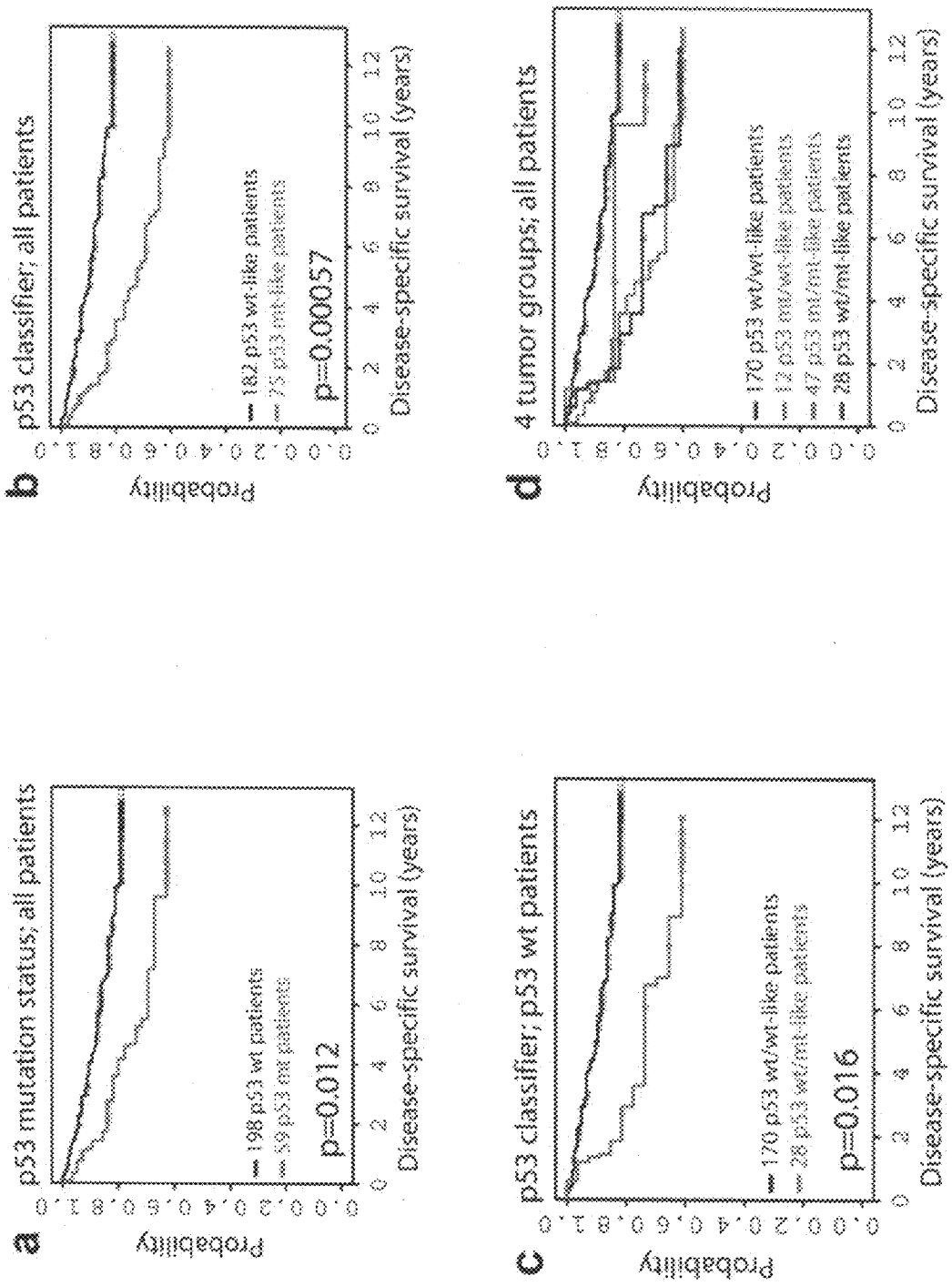
FIG. 4 shows that the p53 classifier has greater prognostic significance than p53 mutation status alone in accordance with a disclosed embodiment of the invention.

The p53 Classifier is a Greater Prognostic Indicator of Patient Outcome than p53 Mutation status Alone It is widely accepted that in breast cancer and other tumor types p53 status is prognostic of clinical outcomes such as tumor recurrence, patient survival, and therapeutic response. The hypothesis that a classifier based on p53 activity would out-perform p53 mutation status alone as a prognostic indicator of clinical outcomes was tested. FIG. 4 shows that the p53 classifier has greater prognostic significance than p53 mutation status alone. Kaplan-Meier survival curves are shown for patients classified according to (A) p53 mutation status, (B&C) the p53 classifier, or (D) both. The clinical endpoint was death from breast cancer (ie, disease-specific survival). In A, B, and D all 257 patients were assessed; in C, only the 198 patients with p53 wildtype tumors were assessed. The Wald test ($p_w$) was used to assess significance of the hazard ratios (HR).

The classifier and sequence-level p53 mutation status were compared with respect to their abilities to predict disease-specific survival (DSS) in all 257 patients of the Uppsala cohort regardless of treatment type or clinical stage.

The significance of the hazard ratio generated using the p53 classifier to segregate patients was an order of magnitude greater than that obtained using p53 mutation status alone ($p_w$=0.00057 versus $p_w$=0.012, respectively) (FIG. 4 A&B); notably, this improved p-value was statistically significant at $p_{mc}$=0.0046. Furthermore, the p53 classifier could also significantly segregate patients into low and high risk groups in the subset of 198 women confirmed by sequencing to have wildtype p53 ($p_w$=0.016) (FIG. 4C) indicating that those with p53 wt tumors classified as mutant-like have poorer DSS than those with wt tumors of the wt-like class. In FIG. 4D, survival curves among all four tumor subgroups were compared. Notably, it was observed that patients with p53 mt or wt tumors classified as mt-like (green and blue curves, respectively) have similar overall survival curves, while the twelve with p53 mt tumors classified as wt-like (red curve) show a survival curve that falls between that of the group with mutant-like p53 mt tumors (green curve) and that of the group with wt-like p53 wt tumors (black curve) and is not significantly different from either curve ($p_w$=0.47 for mt/mt-like comparison and $p_w$=0.37 for wt/wt-like comparison).

Figure 5:
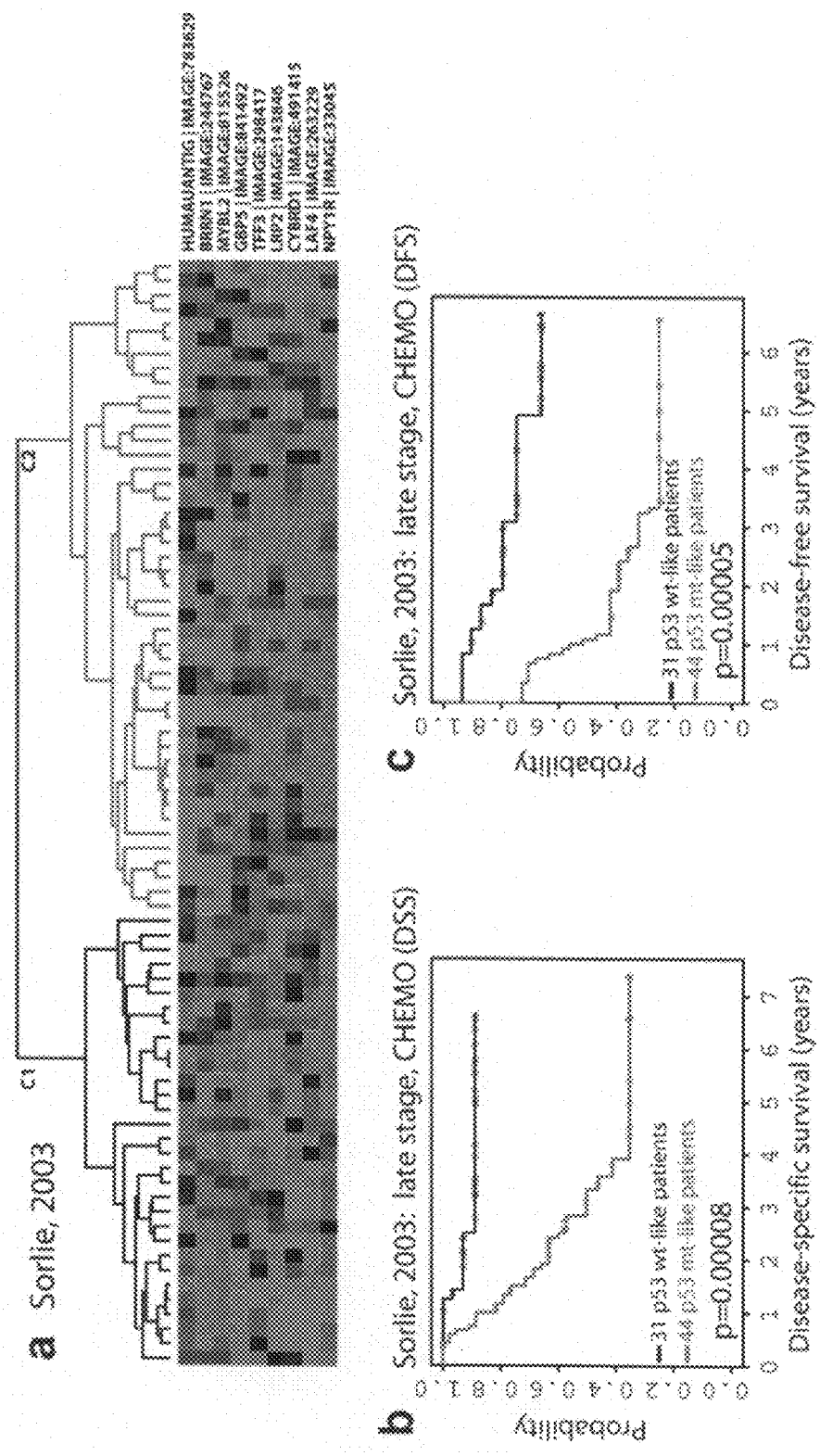
FIG. 5 shows that the p53 classifier has strong prognostic significance in an independent dataset of late-stage tumors in accordance with a disclosed embodiment of the invention.

Next, the prognostic significance of the classifier on the Sorlie et al cDNA microarray dataset was examined (Sorlie, T. et al. Repeated observation of breast tumor subtypes in independent gene expression data sets. *Proc Natl Acad Sci U S A* 100, 8418-23 (2003), incorporated herein by reference). FIG. 5 shows that the p53 classifier has strong prognostic significance in an independent dataset of late-stage tumors. Tumors were hierarchically classified according to the 9-gene partial classifier described in FIG. 3 and analyzed for correlations with survival outcomes: (A) hierarchical clustergram of 76 tumors from the Sorlie et al dataset; the black branch of the tumor dendrogram denotes the wildtype-like configuration, and the red branch the mutant-like profile. Shown are Kaplan-Meier estimates for (B) disease-specific survival and (C) disease-free survival, where patient groups were determined according to the green and red branches of the tumor dendrogram in (A).

Here, the 9-gene partial classifier that could distinguish mt and wt tumors both with 77% accuracy, was used to hierarchically cluster 76 well-sampled tumor specimens with associated patient survival information (FIG. 5A). Importantly, the majority of these tumors (>80%) are derived from two independent prospective studies on chemotherapeutic response of stage III patients with locally advanced breast cancer (T3/T4 and/or N2). The tumors clustered into two predominant branches with 31 tumors in the wt-like cluster and 44 tumors in the mutant-like cluster. Grouping the patients according to these tumor profiles, the Kaplan-Meier survival curves for disease-specific and disease-free survival (FIGS. 5B& C) were both highly significant in this cohort ($p_w$=0.00008 (DSS) and $p_w$=0.00005 (DFS)). Remarkably, the 31 patients in the p53 wt-like cluster showed a 90% probability of surviving their breast cancer for a period of 7 years compared to a 35% probability of 7-year survival for the 44 patients in the p53 mt-like group (FIG. 5B). Thus, in this predominantly stage III patient population, the partial classifier can accurately predict not only which patients will relapse and die, but also which late stage patients will survive their cancer.

For hierarchical cluster analysis, log expression values were mean centered and normalized, and genes and tumors were clustered using the Pearson correlation metric and average linkage (Cluster and TreeView software courtesy Dr. Michael Eisen; software available on Lawrence Berkeley National Laboratory, UC Berkeley's website). For survival analysis, patients were stratified according to the p53 classifier output or, as in one case, according to p53 mutation status. The Kaplan Meier estimate was used to compute survival curves for the different patient groups and the Wald Test was used to assess the statistical significance of the resultant hazard ratio. The FIG. 4 survival analysis assesses the probability of achieving, by chance alone, the more significant Wald p-value of 0.00057 generated using the group assignments as determined by the p53 classifier (panel B) compared to p=0.012 using p53 status alone (panel A). In 100,000 iterative runs, 40 tumors were randomly selected (ie, the number of tumors that differed in group assignment between panel A and B), their p53 status inverted, and the Wald p-values computed for each run. A p-value ≦0.00057 was obtained only 564 times. The Monte Carlo p-value for this observation is estimated to be 0.0046.

For association tests (i.e., to ascertain the significance of the number of observed events in two or more groups), the Chi-square test was employed. When the number of events was sufficiently small (<5) in any category, Fisher's Exact test was applied instead of Chi-square test.

Figure 8:
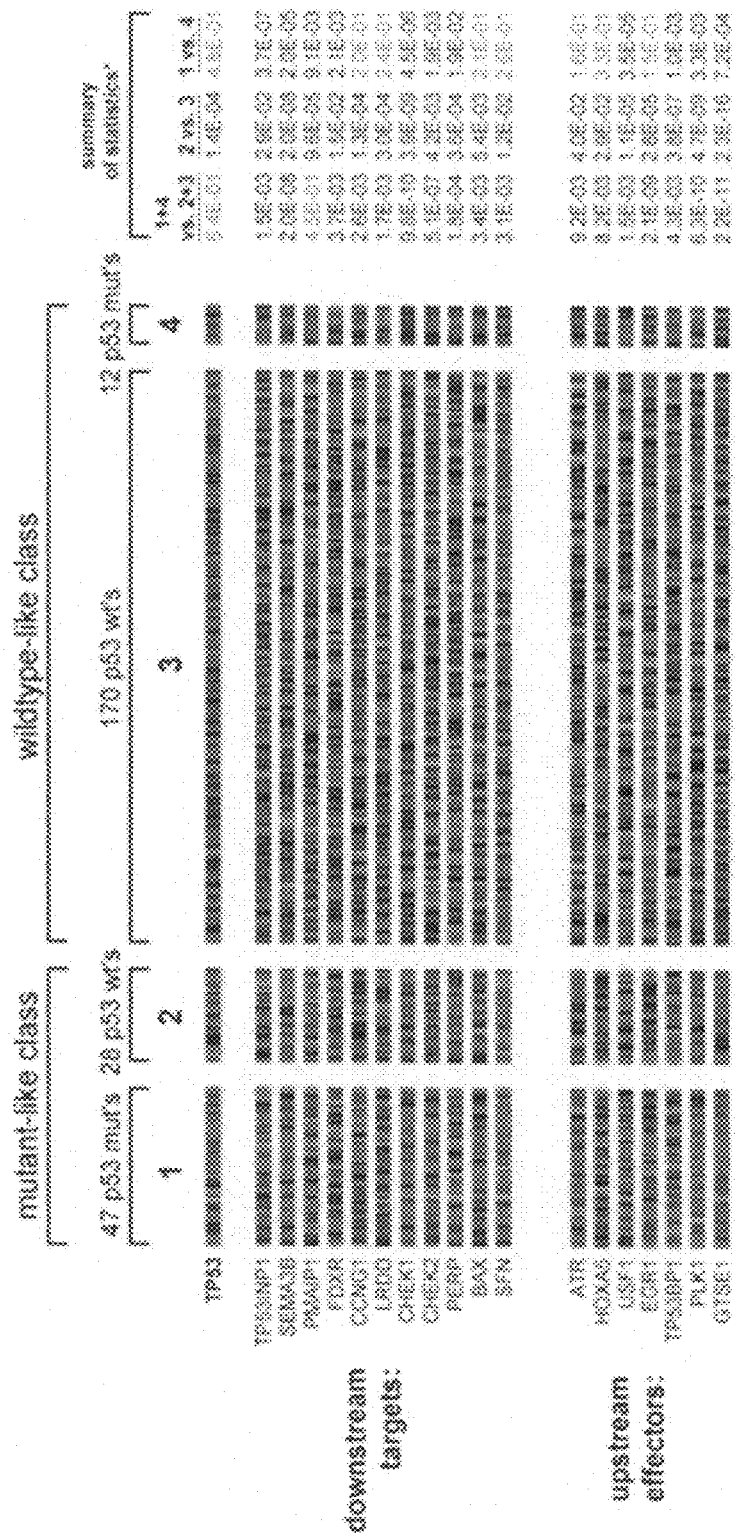
FIG. 8 shows that transcript levels of p53, its transcriptional targets, and its upstream effectors distinguish known and predicted classes in accordance with a disclosed embodiment of the invention.

For the statistical analysis of expression levels for p53 downstream target genes and upstream effectors, two-tailed two-group T tests were employed to determine differentially expressed genes between the p53 wt and mt tumors (FIG. 8). One-tailed two group t-tests were performed for comparisons between the p53 wt tumors in the mt-like class and the p53 wt tumors in the wt-like class (and vice versa) to test whether the genes were significantly differentially expressed in the same direction (or opposite direction) as that observed between the p53 wildtypes and mutants.

It would be evident to one of skill in the art that the method embodiments of the present invention are not limited to the statistical methods disclosed herein. Embodiments of the present invention encompass equivalent analytical methods. The p-value abbreviations used herein include:

$p_{wr}$=Wilcoxon rank-sum test
$p_t$=T test
$p_{cs}$=Chi-square test
$p_{fe}$=Fisher's Exact test
$p_w$=Wald test
$p_{mc}$=Monte Carlo estimate Promoter analysis for p53 binding sites was performed on each of the classifier genes with a known transcription start site (TSS). BEARR (Vega, V. B., Bangarusamy, D. K., Miller, L. D., Liu, E. T. & Lin, C. Y. BEARR: Batch Extraction and Analysis of cis-Regulatory Regions. *Nucleic Acids Res* 32, W257-60 (2004), incorporated herein by reference) was used to extract promoter sequences (3000 bp upstream to 500 bp downstream of the TSS) and predict putative binding sites using the P53 position weight matrix obtained from TRANS-FAC (Kel, A. E. et al. MATCH: A tool for searching transcription factor binding sites in DNA sequences. *Nucleic Acids Res* 31, 3576-9 (2003), incorporated herein by reference) version 6.0 (Matrix accession: M00272) as well as simple pattern search based on the canonical p53 binding site consensus 5'-RRRCWWGYYYN(0-13)RRRCWWGYYY-3' (el-Deiry, W. S., Kern, S. E., Pietenpol, J. A., Kinzler, K. W. & Vogelstein, B. Definition of a consensus binding site for p53. *Nat Genet* 1, 45-9 (1992), incorporated herein by reference.

Example 5

Figure 6:
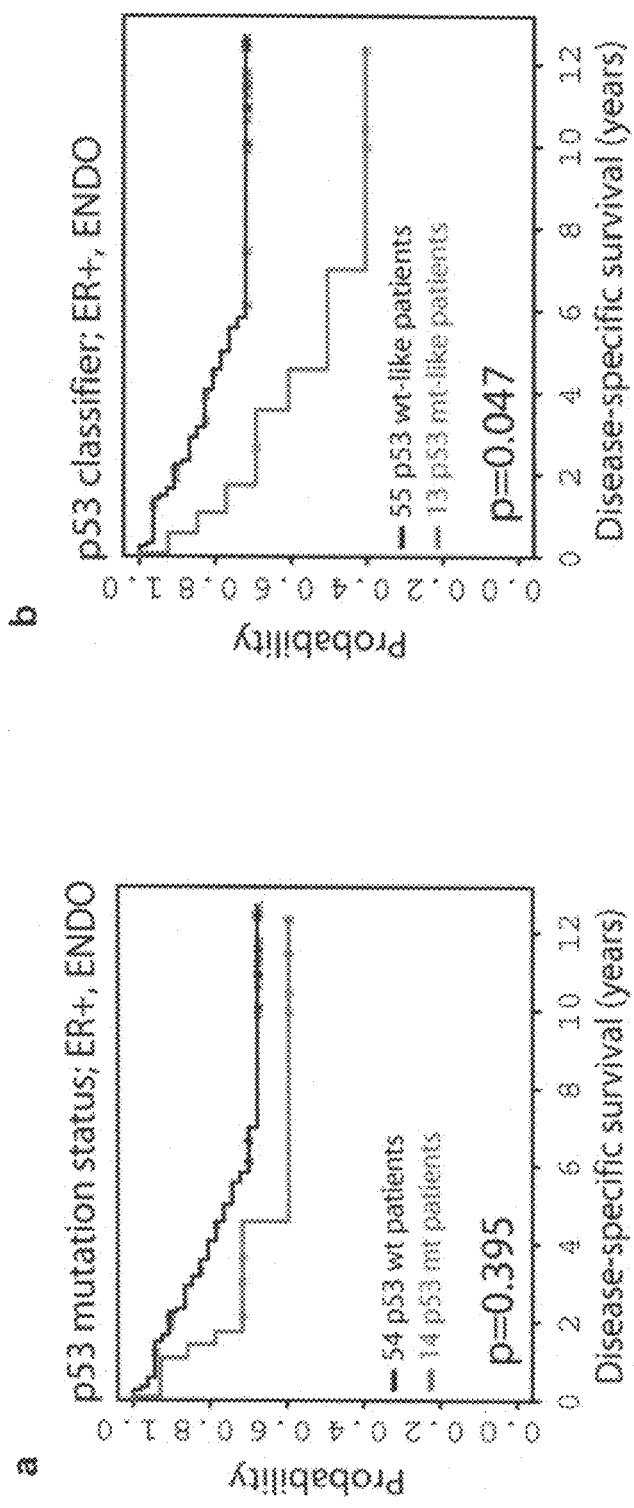
FIG. 6 shows that the p53 classifier has greater prognostic significance than p53 mutation status in endocrine-treated patients in accordance with a disclosed embodiment of the invention.

The p53-Deficiency Classifier, but not P53 Status Alone, is Significantly Correlated with Outcome in Endocrine-Treated Patients To further test the robustness of the classifier in predicting patient outcome, its performance in other relevant therapeutic treatment groups was analyzed. Recently, it has been observed that p53 mt breast tumors show greater resistance to endocrine therapy than p53 wt tumors, and this has been explained, in part, by the uncoupling of p53-dependent apoptosis in the resistant tumors (Berns, E. M. et al. Complete sequencing of TP53 predicts poor response to systemic therapy of advanced breast cancer. *Cancer Res* 60, 2155-62 (2000), incorporated herein by reference). To test the ability of the classifier to predict outcome in a hormone therapy-specific patient cohort, a subpopulation of the Uppsala cohort consisting of 68 ER+ patients who received only adjuvant tamoxifen treatment following surgery, was examined. FIG. 6 shows that the p53 classifier has greater prognostic significance than p53 mutation status in endocrine-treated patients. Sixty-eight ER+, endocrine-treated patients were classified according to (A) p53 mutation status or (B) the p53 classifier and analyzed for correlations with disease-specific survival (DSS). Kaplan-Meier survival estimates are shown. As shown in the survival analysis in FIGS. 6A&B, it was observed that the classifier was a significant predictor of disease-specific survival ($p_w$=0.047), while p53 mutation status alone was not ($p_w$=0.395).

Figure 7:
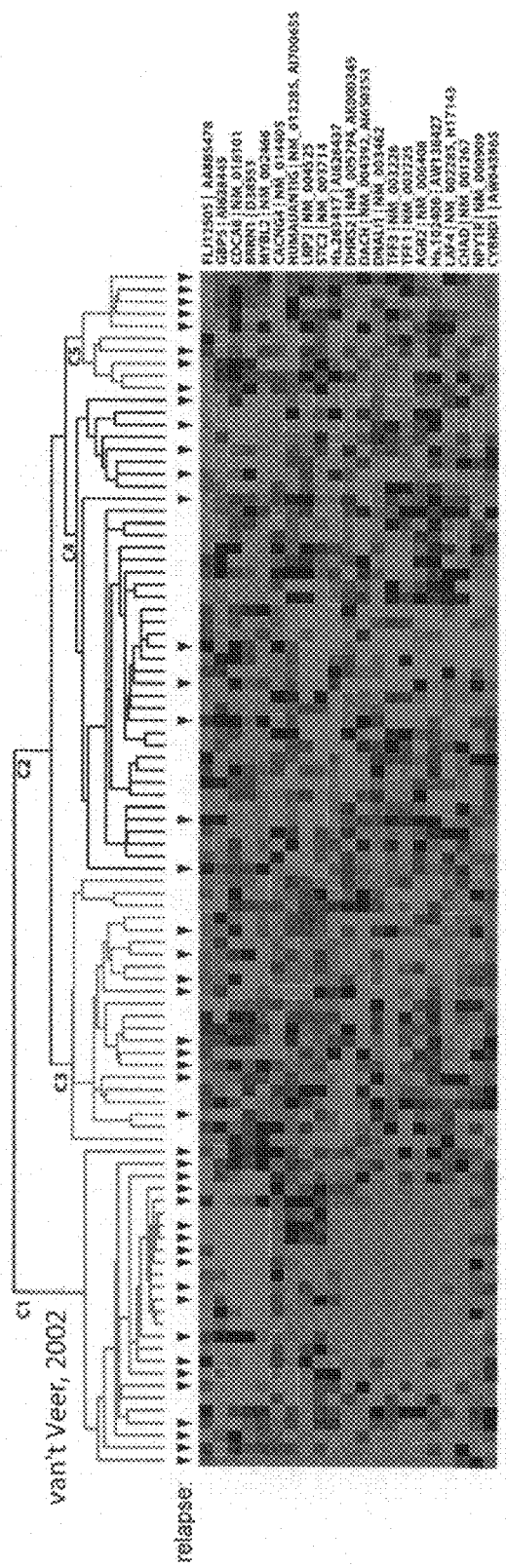
FIG. 7 shows that the p53 classifier is prognostic of distant recurrence in an independent set of early-stage locally-treated breast tumors in accordance with a disclosed embodiment of the invention.

Next, the prognostic performance of the classifier on a set of 97 breast tumors published by van't Veer et al (van't Veer, L. J. et al. Gene expression profiling predicts clinical outcome of breast cancer. *Nature* 415, 530-6 (2002), incorporated herein by reference) was examined. FIG. 7 shows that the p53 classifier is prognostic of distant recurrence in an independent set of early-stage locally-treated breast tumors. 97 tumors from a Dutch cohort (van't Veer, L. J. et al. Gene expression profiling predicts clinical outcome of breast cancer. *Nature* 415, 530-6 (2002), incorporated herein by reference) of early-stage patients treated with postoperative adjuvant radiotherapy and followed for a period of at least 5 years were hierarchically clustered using a set of probes corresponding to 21 genes of the optimized classifier. The predominant cluster nodes are demarcated by color and "C" designations (i.e., C1-C5). Black arrows correspond to tumors from patients who developed a distant metastasis (DM) within 5 years. Gene symbols and corresponding Genbank accession numbers are shown. Hierarchical clustering was performed as described previously.

Here, all of the samples were controlled for clinical uniformity, i.e., <5 cm in size (T1/T2), with no advanced disease (pN0), from patients less than 55 years of age at diagnosis, treated by surgery and subsequent radiotherapy only (with the exception of 5 patients who received adjuvant systemic therapy). From the 32-gene classifier, 24 probes corresponding to 21 genes could be mapped to all 97 tumors with survival information. Upon clustering the tumors, approximately 4 clusters with similar average distance correlations were observed that significantly distinguished patients who would develop a distant metastasis within 5 years ($p_{fe}$=2.2×10$^{-4}$) (FIG. 7). Notably, of the 26 tumors in cluster 1, which bear the molecular configuration of p53 mt-like tumors, 73% had a distant metastasis within 5 years, compared to 26% of 39 tumors in cluster 3, which most closely resemble the p53 wt-like molecular configuration. These findings suggest that the p53 classifier is prognostic of tumor recurrence in early stage, locally-treated breast cancer.

Example 6

Analysis of Classifier Gene Functions

To gain some mechanistic insights, the functional annotations of the classifier genes were analysed for clues to explain the correlation between their expression levels and p53 status and patient outcome. Surprisingly, it was found that none of the classifier genes are known transcriptional targets of p53, nor have they been previously implicated in the p53 pathway. Promoter analysis of the 21 genes with defined promoter regions revealed no evidence of the canonical p53 binding site, or recently described novel p53 binding sites, within any of the promoters.

Twelve of the genes are of unknown function. However, of the characterized genes, a number are associated with cell growth and proliferation (MYBL2, TFF1, BRRN1, CHAD, SCGB3A1, DACH, CDCA8), transcription (LAF4, NY-BR-1, DACH, MYBL2), ion transport (CACNG4, CYBRD1, LRP2), and breast cancer biology (SCGB3A1, TFF1, STC2, NY-BR-1, AGR2). Speculatively, some of these genes may contribute mechanistically to the poor prognosis of the p53 mutant-like tumors. For example, MYBL2, which was observed to be upregulated in the p53 mutant-like tumors, is a growth-promoting transcription factor closely related to the c-MYB oncogene. It maps to a chromosomal region frequently amplified in breast cancer (20q13) and has previously been reported to be overexpressed in breast cancer cell lines and sporadic ovarian carcinomas (Forozan, F. et al. Comparative genomic hybridization analysis of 38 breast cancer cell lines: a basis for interpreting complementary DNA microarray data. *Cancer Res* 60, 4519-25 (2000) and Tanner, M. M. et al. Frequent amplification of chromosomal region 20q12-q13 in ovarian cancer. *Clin Cancer Res* 6, 1833-9 (2000), both of which are incorporated herein by reference. SCGB3A1

(HIN1), which was observed to be downregulated in the p53 mutant-like tumors, is a putative tumor suppressor gene that can inhibit breast cancer cell growth when overexpressed and has been found to be transcriptionally silenced by hypermethylation of its promoter in early stages of breast tumorigenesis (Krop, I. E. et al. HIN-1, a putative cytokine highly expressed in normal but not cancerous mammary epithelial cells. *Proc Natl Acad Sci USA* 98, 9796-801 (2001), incorporated herein by reference).

Example 7

Nature of Misclassified Tumors

It was observed that a number of cancers with wild type p53 sequence status were classified as p53 mutant by expression profiling using the 32-gene classifier. If the "misclassified" p53 wt tumors were in fact p53 deficient, they would possess certain molecular characteristics reflective of perturbations of the p53 pathway, and these characteristics would be found in the majority of p53 mutant tumors. First, the possibility that p53 deficiency could result from reduced transcript levels either by transcriptional repression of the p53 gene (TP53) or by the shortening of its mRNA half-life, was considered. The t test was used to compare the relative expression levels of TP53 (using the TP53 probe-sets present on the microarray) among the different tumor classes (FIG. 8). Indeed, consistent with this hypothesis, it was observed that the overall expression level of TP53 was significantly reduced in the 28 wt tumors classified as mt-like compared to the remaining 170 wt tumors classified as wt-like ($p_t=1.4\times10^{-04}$). No statistically significant difference in expression levels was observed between the p53 mt tumors correctly classified as mt-like and all wt tumors, consistent with the fact that TP53 mRNA levels are not commonly reduced in p53 mutant breast cancers.

FIG. 8 shows that transcript levels of p53, its transcriptional targets, and its upstream effectors distinguish known and predicted classes. Expression levels of p53 pathway-relevant genes were examined. The statistical significance of transcript levels between the different tumor classes was determined by t test and is shown in a summary table to the right of the figure. The 4 tumor classes are as follows: 1) 47 p53 mt tumors classified as mutant, 2) 28 p53 wt tumors classified as mutant, 3) 170 p53 wt tumors classified as wildtype, and 4) 12 p53 mt tumors classified as wildtype. Statistical measurements in the summary shown in grey did not reach significance at p<0.05.

Table 3 shows a comparative analysis of p53 mutations. (I) Severe mutations were defined as insertions, deletions, or stop codons. Of the remaining missense point mutations (mpms; 11 in the wt-like group, 27 in the mt-like group) we determined the frequency of occurrence of (II) the most common missense point mutations in p53 as defined by the IARC TP53 Mutation Database (available online on the website of the International Agency for Research on Cancer, IARC), and (III) mutants previously shown, in vitro, to possess dominant negative activity were determined. P-values were calculated using Fisher's Exact test.

This strategy was applied to known transcriptional targets of p53, which were hypothesized to show altered transcription in p53-deficient tumors to some extent. Indeed, a number of p53 target genes demonstrated altered patterns of expression (FIG. 8). The TP53-inducible genes TP53INP1, SEMA3B, PMAIP1 (NOXA), FDXR, CCNG1, and LRDD, all of which contain functional p53-binding sites in their promoters, showed significantly lower expression in the 28 wt tumors classified as mt-like compared to the other wildtypes (all at $p_t<0.05$). Moreover, all but one of these genes were also significantly reduced in the p53 mt tumors classified as mt-like (compared to all wt tumors); and in all but two cases, these genes showed significantly higher expression in the 12 mt tumors classified as wt-like when compared to the other mutants.

CHEK1 and CHEK2, both positive upstream effectors of p53 that phosphorylate p53 and thereby promote its stabilization, are known to be transcriptionally repressed by p53. A significant increase in the mRNA levels of these genes in both the p53 wt and mt tumors of the mutant-like class was observed. It was also observed that the 12 mt tumors misclassified as wildtype-like displayed significantly lower expression of these genes compared to the other 47 p53 mutants. Notably, no differential expression of the p53-regulated genes CDKN1A (p21), GADD45, PPM1D (WIP1), TP5313 (PIG3), TNFRSF6, BBC3 (PUMA), APAF1 or BCL2 was observed in these breast tumor specimens.

Taken together, these data suggest that the classifier can distinguish tumors based on some aspects of p53 transcriptional activity that are inhibited in both the p53 mutant and wildtype tumors of the mutant-like class, yet operative in the p53 wildtype tumors (and to some extent the 12 p53 mutant tumors) of the wildtype-like class.

Perhaps paradoxically, it was observed that the p53-inducible genes PERP, BAX and SFN (14-3-3 sigma) were all expressed at significantly higher levels in the 28 misclassified wt tumors, rather than at lower levels like their inducible gene counterparts described above. However, the significant overexpression of these genes in the p53 mt tumors classified as mutant-like was also observed, suggesting that in breast cancer, these genes may be induced by alternate regulatory mechanisms in the context of mutant or deficient p53.

Intriguingly, another positive upstream effector of p53, ATR, which is thought to enhance p53 activity in a manner similar to that of CHEK1 and CHEK2, was also found expressed at significantly higher levels in the p53 mutants and p53 wt tumors of the mutant-like class, even though this gene is not known to be modulated in a p53-dependent manner. Of note, no significant differences in the expression levels of the upstream effectors, ATM or PRKDC (DNA-PK) were observed.

The expression levels of other upstream modulators of p53 activity were then examined in order to ascertain possible alternate mechanisms by which p53 expression and activity might be reduced in the mutant-like p53 wt tumors. First, it was observed that several known positive regulators of p53 transactivation were significantly reduced in both the wildtypes and mutants of the mutant-like class including HOXA5, USF1, EGR1 and TP53BP1. HOXA5, USF1, and EGR1 are all transcription factors known to bind the p53 promoter and enhance its expression. Interestingly, deficiencies in all three have previously been implicated in breast carcinogenesis. Recently the coordinate loss of both p53 and HOXA5 mRNA and protein expression was observed in a panel of human breast cancer cell lines, and the HOXA5 promoter was found to be methylated in 16 of 20 p53-negative human breast tumors. USF1, which is structurally related to the c-Myc oncoprotein, has been found to have reduced transcriptional activity in breast cancer cell lines, and has recently been shown to activate the expression of estrogen receptor alpha. EGR1, a DNA damage-responsive gene with antiproliferative and apoptotic functions, can inhibit tumorigenicity when exogenously expressed in human breast cancer cells, and has been observed to have reduced expression in human and mouse breast cancer cell lines and tumors. TP53BP1 is not thought to be a transcription factor, but rather a BRCT domain-containing substrate of ATM that is phosphorylated in response to DNA damage. This gene product is known to bind the central DNA-binding domain of p53 and thus enhance the transcriptional activation of p53 target genes. A significantly reduced expression of all four genes in the 28 p53 wt tumors classified as mutant-like was found, and in the cases of USF1 and TP53BP1, significantly higher expression in the p53 mutants classified as wildtype-like. Interestingly, it was also observed that their expression levels are also significantly lower in the 47 p53 mt tumors classified as mutant-like, suggesting a possible positive feedback loop whereby wildtype p53 can enhance expression of these genes and impaired p53 cannot. Together, these observations suggest the possibility that either acting separately or in combination, these genes may be important for intact p53 activity in the breast, and when transcriptionally silenced, contribute to p53 deficiency.

Finally, the expression of several known negative regulators of p53 activity were examined. Notably, MDM2, which negatively regulates p53 through phosphorylation-mediated degradation of the p53 protein, and whose overexpression at the protein level has been implicated in a variety of cancers, was not found to be differentially expressed at the transcript level in the experiments described herein. However, both PLK1 and GTSE1 were. The M-phase regulator PLK1 has recently been shown to bind to the DNA-binding domain of p53 and thus inhibit its transcriptional activity in vitro. GTSE1 (B99) binds the C-terminal regulatory domain of p53 causing the inhibition of p53 transactivation function as well as a reduction of intracellular levels of p53 protein. Intriguingly, the transcript levels of both genes were among the most highly significantly overexpressed in both p53 wt and mt tumors of the mt-like class, suggesting a possible role for these gene products in suppression of p53 function in breast carcinogenesis.

The spectrum of p53 mutations for correlations that might explain the misclassification of the 12 p53-mutant tumors as wildtype-like was next analyzed. First, it was observed that only one mutation was common to the wildtype-like and the mutant-like tumors: a Tyr>Cys at amino acid 220 in the DNA-binding domain. Of the 47 p53 mt tumors correctly classified as mutants, it was observed that 42% (20/47) possessed "severe" mutations defined as insertions (n=2), deletions (n=11) and stop codons (n=7) (Table 3-I) resulting in frameshifts and subsequent trunctation, whereas in the 12 mutants classified as wildtype-like, only 1 (8%) contained a severe mutation: a 3-bp insertion in the DNA-binding domain resulting in the inframe addition of a glycine residue ($p_{fe}$=0.025). Using the IARC TP53 Mutation Database (available online on the website of the International Agency for Research on Cancer, IARC), which, as of June 2003, has indexed 18,585 somatic and 225 germline mutations of p53, the frequencies of occurrence of the most common p53 mutations in human cancer (representing ~20% of all p53 mutations; Table 1-II) in the 12 wt-like mutants and the 47 mt-like mutants were compared. None of the common mutations were found to overlap with the subset of 11 missense point mutations (mpms) in the wt-like group, compared to 9 of 27 in the mt-like group ($p_{fe}$=0.029). The mpms in each tumor group was then cross-compared with the IARC TP53 Mutation Database's comprehensive listing of 418 mutants previously analyzed for dominant negative function in at least one of 44 previously published studies. As Table 2-III shows, it was found that only one of the 11 mpms among the 12 wt-like mutants had been demonstrated previously to have dominant negative activity, compared to 12 of 27 within the mt-like group ($p_{fe}$=0.039).

Together, these data suggest that at the sequence level, the 12 p53 mutants classified as wildtype-like may in fact comprise of mostly "benign" p53 mutant forms compared to those 47 classified as mutant-like, in agreement with their molecular consistencies with the majority of p53 wt tumors in our expression analyses.

TABLE 3

| mutation type | 12 wt-like tumors | 47 mt-like tumors | p-value: |
|---|---|---|---|
| I. severe mutations: | 1 | 20 | 0.025 |
| deletions | 0 | 11 | |
| stop codons | 0 | 7 | |
| insertions | 1 | 2 | |
| | (11 tumors with mpms) | (27 tumors with mpms) | |
| II. Common missense pt. mutations: | 0 | 9 | 0.029 |
| 175 (Arg->His) | 0 | 2 | |
| 248 (Arg->Gln) | 0 | 3 | |
| 248 (Arg->Trp) | 0 | 2 | |
| 273 (Arg->His) | 0 | 0 | |
| 273 (Arg->Cys) | 0 | 2 | |
| 282 (Arg->Trp) | 0 | 0 | |
| III. pt. mutations with known dominant negative function: | 1 | 12 | 0.039 |

Comparative analysis of p53 mutations. (I) Severe mutations were defined as insertions, deletions, or stop codons. Of the remaining missense point mutations (mpms; 11 in the wt-like group, 27 in the mt-like group) we determined the frequency of occurrence of (II) the most common missense point mutations in p53 as defined by the IARC TP53 Mutation Database (http://www.iarc.fr/p53/index.html), and (III) mutants previously shown, in vitro, to possess dominant negative activity. P-values were calculated using Fisher's Exact test.

The practice of the present invention may employ conventional biology methods known to the skilled artisan, software and systems. The foregoing examples have described methods for predicting disease outcome in a patient. In another aspect, there is also provided a computer system for predicting disease outcome in a patient. The computer system may comprise a computer having a processor and a memory, the memory having executable code stored thereon for execution by the processor for performing the steps of obtaining gene expression profiles from a plurality of genes from tumor samples, wherein said tumor samples may be mutant or wildtype for the p53 gene; comparing said gene expression profiles to determine which genes are differentially expressed in the mutant or wildtype tumors; deriving from said differentially expressed genes a set of genes to predict p53 mutational status; and using the set of genes to predict disease outcome in the patient.

A suitable computer system may be a general purpose computer such as a PC or a Macintosh, for example. Computer software products of the invention typically include a computer readable medium having computer-executable instructions for performing the logic steps of the method of the invention. Suitable computer readable media include floppy disk, CD-ROM/DVD/DVD-ROM, hard-disk drive, flash memory, ROM/RAM, magnetic tapes etc. The computer executable instructions may be written in a suitable computer language or a combination of several languages. Basic computational biology methods are described in, e.g. Setubal and Meidanis et al., Introduction to Computational Biology Methods (PWS Publishing Company, Boston, 1997); Salzberg, Searles, Kasif, (Ed.), Computational Methods in Molecular Biology, (Elsevier, Amsterdam, 1998); Rashidi and Buehler, Bioinformatics Basics: Application in Biological Science and Medicine (CRC Press, London, 2000) and Ouelette and Bzevanis Bioinformatics: A Practical Guide for Analysis of Gene and Proteins (Wiley & Sons, Inc., $2^{nd}$ Ed., 2001).

Additionally, the present invention may have preferred embodiments that include methods for providing genetic information over networks such as the Internet.

Additionally, some embodiments of the present invention may provide a plurality of pharmaceutical targets for designing chemotherapeutic drugs for a variety of cancers. For example, the 32 genes most correlated with p53 mutational status could serve as potential molecular targets for chemotherapy. Chemotherapy drugs (cytotoxics) and antihormonal treatments are commonly used to treat cancers. In several patients however, treatment regimens involving cytotoxics and antihormonals have been known to cause mild to severe side effects. In breast cancer for example, these side effects include vomiting, nausea, alopecia and fatigue. The future of effective treatment for cancer thus resides with drugs that are more specific for their targets. According to some studies, about 68% of breast cancer drugs in the clinical developmental pipeline are of the targeted class. Therefore, molecular signatures such as those embodied in certain aspects of the present invention will provide important leads or will prove to be targets in their own right for targeted chemotherapeutic drugs.

In conclusion, the disclosed embodiments of the present invention define a gene expression signature a gene expression signature that can predict p53 status and survival in human breast tumours (the p53 signature or classifier). In independent datasets of both breast and liver cancers, and regardless of other clinical features, subsets of the p53 signature can predict p53 status with significant accuracy. As a predictor of disease-specific survival (DSS), the signature significantly outperformed p53 mutation status alone in a large patient cohort with heterogeneous treatment. The p53 signature could significantly distinguish patients having more or less benefit from systemic adjuvant therapies and locoregional radiotherapy. Though the p53 pathway may be compromised at some level in most human cancers, analysis of transcripts involved in the p53 pathway suggests that the p53 expression signature defines an operational configuration of this pathway in breast tumors (more so than p53 mutation status alone) that impacts patient survival, and therapeutic response. In cancer, it is clear that not all p53 mutations have equal effects: some simply confer loss of function, while others have a dominant negative effect (such as trans-dominant suppression of wildtype p53 or oncogenic gain of function), while still others show only a partial loss of function where, for example, only a small subset of p53 downstream transcriptional target genes are dysregulated. For these reasons, no single molecular assessment of p53 status appears to provide an absolute indication of the complete p53 function. The embodiments disclosed herein suggest that by looking at the downstream indicators of p53 function, the functional status of p53 may be ascertained more precisely than using sequencing or biochemical means.

It is to be understood that the above description in intended to be illustrative and not restrictive. Many variations of the invention will be apparent to those of skill in the art upon reviewing the above description. The scope of the invention should be determined with reference to the appended claims, along with the full scope of equivalents to which such claims are entitled. All cited references, including patent and non-patent literature, are incorporated herewith by reference in their entireties for all purposes.

SEQUENCE LISTING (500 sequences)

SEQ ID NO: 1 - DNA, 1153 bp, Homo sapiens
gtgtcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcacgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaaaaaaaaaaaaaaaaaaaaaaaaaaaaaaaaaaaaaaaaaaaaaaaa

SEQ ID NO: 2 - DNA, 415 bp, Homo sapiens
  modified_base (36)..(36): a, c, g, t, unknown, or other
  modified_base (341)..(341): a, c, g, t, unknown, or other
  modified_base (374)..(374): a, c, g, t, unknown, or other
  modified_base (381)..(381): a, c, g, t, unknown, or other
tttttttttaaatcttcatagagacgccttagcagnaagctatcggctttgacagtacaccgaaatcctggcagtgaaccataaattgaccattaccataaaaagagctgctaaacgagaaaccatgtgctcagtataaaactaatttcatgctttcaaaagcacacagtggcttctagcaagatagtggccctgggacttgccgagacagattggtgaacacaaatggtttgctcctgatgcgtctgcttagccaagctttacgtgtactggcagtaaaagaggttctcgagccttctatcaaacaaatacacacttagctataactttaaagctgaagntattaaaacagctgcctcaaataaaatatagcnggaaaancacatacacttattatacatacacaccccatgtg

SEQ ID NO: 3 - DNA, 570 bp, Homo sapiens
ttccatggggagaatgaagccattttatttaggggaatgttaaaacaaagccatatacaatctgtaacaaatacaatacaattgtttgttccctagtcctgaataattacagtatatacaaaatctgtaaggcactggttcccccaaaagaacaaatgagtcttcttgtgaaacagacaacgaaacccctatattgccaacttttctccaaaaaatatggcattgtttttttgttttgttttacaagaggaatcacaattgctaaattaagtcacttctgatgccatttctttcatttccactgctatgtgtctgggttttctaaggcaatgtaactactgaacatgttcaagtttaaaaaactatacttctctcagtgccgttccacccacaaacaaagaagaatcagatcagaccaacaacataaaacttctaatgaatatgtatgactgtaggaacatgaaattcagtcattattaagtacttgctatacttgactacacaccaattgaaatgtgtcaaagaattccctgtaaataaaatctcagcatgttttctaagaagctttct

SEQ ID NO: 4 - DNA, 4458 bp, Homo sapiens
ctagtctataccagcaacgactcctacatcgtccactctggggatcttagaaagatccataaagctgcctcccggggacaagtccggaagctggagaagatgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacatggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcggagcctccggggaagccatctgccttcgagcctgccactgaaatgcaaaagtctgtcccaaataaagccttggaattgaaaaatgaacaaacatggagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacacatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatgagagacaagcagtaagaaacttcttttggagaaacaacagaccagatctttactcacaactcatgctaggaggccagtcctagcatcaccttatgttgaaaatcttaccaatagtctgtgtcaacagaatacttattttagaagaaaaattcatgatttcttcctgaagcctacagacataaaataacagtgtgaagaattacttgttcacgaattgcataaagctgcacaggattcccatctaccctgatgatgcagcagacatcattcaatccaaccagaatctcgctctgcactccagcctaggtgacagagtgagactccacctcggaaa

SEQ ID NO: 5 - DNA, 597 bp, Homo sapiens
tttttttttttaatgtttaaaaggtttttattaaattatacaaaaacaggcagttagaaattgtgttttcttcctgccccattgacatttctaaggccctaatgcatttgttctgaggtttgacagttgaagcccttcaccagtgctagggaaataaagcctcctcaaccttaaggatttcagtgataagagtctgaaagtctagcacttcaggtagactttggatgaactaagaggttccacagtcaccctgtcatataactgtctgacagaaataggggatgaggtctataaaatggaaagggtggtatttcgtttttattggtaatgaatgatttggaatagaagcatacagaactgcaaatttcaaggacgttagtgtacatggcctggcctttgaaatacaaggagaaagttgggtgcagaagaaataggagaaaactacaataatttctgcctcattgagtctgtgaagtagacccacttatggcacatacgttcctgtcttagaggcctggaactagcagatctcgtggaaagagttctttcccatggaaatgacaacacaggcaggtcatttgagtggaggcttaaaat

SEQ ID NO: 6 - DNA, 1954 bp, Homo sapiens
ggtgaccacacggcaatccttaccctttgtctgtccctgtctcccttgtctctgtacctctctgcttacccctagctgtttctgtgtccagccatctgtctctacctggatcccaatgatcctgaaacacatcagtaaagccttcttcatcactgccacgcacaacagacttgtgcctgggagttctatctgtgtgaatgcaactgcagaggaggaaagagtgaagcaaaaattgggagagtttaggggtaagggaagtctacctcacagaacagaggtacttcccttggggttggaaccactcgtgtttgcagtttcagtttctgggaaagaaagggaatgaacagatttatcacactggaatcttgaaaaggcaaatcgccaacacctgagacgcggtcaactctggtatgtgccagtgaggggagaacggaaggacccagggctcgcagcctcagccggtcattatggcaccttgctatggacccttccttcaagacccaccataaagcccatccagagcccttccaagaggccccgggagtagttttctccagagagggcagtggtacggggaccaagattcctctgacttatatcaaaccagaggcaactcccacacagaggctgtggaagggtaagcctgtgtgcctcaagaaaaatgcttcaaagcaaaagcaagtaagagattctagatgattcttacctgctatgaaagatgccttgatgtctgaagaggcttcggcctgatctccctgaagatgctgaaatgggggagaagcctgatcacctctgtgcaagcaaaggagtgaagattatttcttgaacacctggacaacatatctgttcaactagcttgcaccctggtggagctgggggcagcatttctggaatcctcctaaccattgttcactgcttgtagcagagtaggtgggcctcagggttagtgacaagtcctttcctgcccttcccaacacccagccaccttgctgcagtctctgtagcctgggctctgaaatacatgagctcctcgggagctgcctatccatcctacagcttagtggttagctgtttaattgtaggccaagaatttctctccccaccacagccatctaaatgagttttactagccaggaacctaaaaacacccttcgtgggcttccctatgaccccagctcgattgaccctgtaggttcaaaaggtttcgaggtggcacctaaccagaatgtgggcagaaggcagaggagagggagccttctttctgtctttatctctttatgcttatcctcattgaccatgggctgagttctttctctgggtcccctaatgtgggaatggagtggttcttgccctctgagcttacagactaagaaggcagaaaagctttacaactacagagtacatgtgtatacacacaaccaacctaaacacatcagagaatacatacttaaatcaattcacttcatatacacatctcattagaagaccaagctaaacttcacttagagggcgggcaaaggactagaaaagaatttttctcttaaaaaaaatgagtactagagcaaaattatgagtgtctaagtatcttagttatgcttcataagatctgactggggtaagagataaagaggtaaatagggctgggcgcggtggctcacatctgtaatcccagcactttgggaagccgaggtgaacagatcacctgaagtcaggagttgaagaccaacttggccaacatggtgaaaccccatctctactaaaaatacaaaaattagccaggcatggtggtggacccctgtaatcccagctacttggaaggctgagggggaggattgcttaaacccaggaggcagaggttgcagtgagccgtgattgcaccactgcactccagcccaggtgacacagcaagactccgtctcaaaaaaaaaaaaaaaaagaaaaaaaaaaaaaaaaa

SEQ ID NO: 7 - DNA, 1789 bp, Homo sapiens
tcgatgctccacgtaggagctggctcggctgccggctgcggtcagggccaccgtataaagagggcggcagacccgagcgcctaggactcgccgctgcccgcgccccgccgccgctgctgcccccagccccggccccaggcgtcccagccatggtccgcccaatgctcttgctcagcctcggcctcctggctggtctgctgccggcgctggccgcctgcccccagaactgccactgccacagcgacctgcagcacgtcatctgcgacaaggtggggctgcagaagatccccaaggtgtcagagaagaccaagctgctcaacctacagcgcaacaacttcccggtgctggctgccaattcgttccgggccatgccgaacctcgtgtcattgcacctgcagcactgccagatccgcgaggtggccgccggtgccttccgcggcctcaagcaacttatctacttgtacctgtcccataacgacatccgcgtcgtgcgtgccggtgccttcgacgacctgaccgagctgacctacctctacctggaccacaacaaggtcactgagctgccccgggggttgctctccccgctggtcaacctcttcatcttgcagctcaacaacaacaagatccgtgagctgcgcgcagggcccttccagggagccaaggacctgcgctggctctacctgtcggaaaacgcgttgagctccctgcagcccggggccctggacgacgtggagaacctcgccaaattccacgtggacaggaaccagctgtccagctacccctcagctgccctgagcaagctacgggtggtggaggagctgaagctgtcccacaaccccctgaaaagcatcccggacaatgccttccagtcctttggcagatacctggagaccctctggctggacaacaccaacctggagaagttctcagatggtgccttcctgggtgtaaccacgctgaaacacgtccatttggagaacaaccgcttgaaccagctaccctcgaacttccccttcgacagcctggagaccctcgcccttaccaataacccctggaagtgtacctgccagctccggggccttcggcggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggttctgacccagccagtcctggtgactggcctctgccttccaccggagagactactgaccttctcacctccgacccataccttctccccacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccccccccaagtcaatcagaaccacaacaggttggtcatcaggatggccaccctcccaggatcatccttcctctgttctctttccctgccacgtggaaacaatcatcagatccttgccccaccccttgcttccagaaagggttttaaagcccatgccccaactctgccagcccccacctgccaggacgttctagcaggtcatcggtgctttgctgtccatcttcccatgctgcaatttcttcctgagatttctataaatataaatgtatgtatgtat

SEQ ID NO: 8 - DNA, 1217 bp, Homo sapiens
ggcacgaggggagatctcagcactttgtccggagctgaggaagtggtttctgtgttttacagtttttccagccattcttttcttccccctcctgaagcaagcaaagagcgtggaggcgtgtgcaggcttggaagaagaactctccagaacatggaacttaaccctcttttgtataaaacatgtgctttctaaagaaaaattgtttcttattttttgagactccttgatccaccctggaacagtcgcctgtagtcctggtagctgttgtgcttggaaataacgagcgcatccttgcctcagctacctgctcacagcccatgggtggactcggccccctggggttcagacccaggtccgttcggcctagtgatgatgtcatcgtccatcccatcttcctttgcccccaggaaaggacgcatccaccggtagcggccccagctgactgtcgccgtgtgctggggatctgaaatgaggcctgccagggcccctgtgtgctgtgctccagagccttcgctcccatcagggttggcatcatctgatggcatgtccaagtgtgcccagcagcggatgctgaagcaccagagctcaaggccttcacctgctctaggccagccctgtcaccacctccactgccatgaccaggccgaaggcagggaacgccctccccagtcccgctgtccagcaaggccccgagacttttcttctgtgatttccaaaagcaaggcagccgtgctgttctagttcctctccatccgccacctcccctcccgctgccccagaagtttctatcattccatggagaaagctgtgttccaatgaatcctacctcttgcccagtcccaggcagagtaagcagggcccacctagggaccaagaaagagtaggaagaaggggacgagccgggagcaaaaccacctcagacacccgggccttctcagccttctccccgcggccagctgggtctccggggaccctgggccctgggccgcccattcctggccctcccgctgcatctcagacctgacacccaacggggggatgtggtggcctgtgcccaccttctctccctcctcccgacccgccccctcgcccccacccctgtgtgtttcgccagttaagcacctgtgactccagtacctactactggttttgggttggttgttctgtcttttttttaattaaataaaaacatttttaaaaaaaaaaaaaaaaaaaaa

SEQ ID NO: 9 - DNA, 2752 bp, Homo sapiens
cattcccacccttccttctttaataagcaggagcgaaaaagacaaattccaaagaggattgttcagttcaagggaatgaagaattcagaataattttggtaaatggattccaatatcgggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattacgatgcgctgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtcttgaagtcattcagaagtggtttgaggtttctgttttttggtggtttttgtttgttttttttttttttcaccttaagggaggctttcatttcctcccgactgattgtcacttaaatcaaaatttaaaaatgaataaaaagacatacttctcagctgcaaatattatggagaattgggcacccacaggaatgaagagagaaagcagctccccaacttcaaaaccattttggtacctgacaacaagagcattttagagtaattaatttaataaagtaaattagtattgctgcaaatagctaaattatatttatttgaattgatggtcaagagattttccattttttttacagactgttcagtgtttgtcaagcttctggtctaatatgtactcgaaagactttccgcttacaatttgtagaaacacaaatatcgttttccatacagcagtgcctatatagtgactgattttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttctgaggagtctctttcagtttcattttttctcatcccatgacttccctccgatggt

SEQ ID NO: 10 - DNA, 483 bp, Homo sapiens
ctgttcaaaaaaggttttatccaaaaaagttaatcaagacaagcaacagatactgcaaagcattatatacagcaccatagtccaggggccaaagaaatcaggaggggctgggcagtagaggaattccatatattaatgaatgtgagattaagtatagagtgaagacattaacacacaattctaatttctgttaggcagaatgctcccctaccctgatgccacagcctttcacgtttcctaaaccctagtaacctctgatctccatctgcctcatcaacacgtcaccaccctttgctcttcttccaattagtcacatgttggctgaatttatttcactccagtactttaggaccttgacagacaaatcgattacaaggtcaattcccaggatttcttcagggtgtgttcaggagtgcagatgttctttggatgacctttctactaaattagacctctgaaggagaaagctacttgccagaggct

SEQ ID NO: 11 - DNA, 2726 bp, Homo sapiens
caggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatag

SEQ ID NO: 12 - DNA, 159440 bp, Homo sapiens
gatccattattttaatagtcgaaatatctacatattaaagaggccagggaaaaataagtgaataatcaaaaactaaataaagctcaaataagatcttaaaaggttaatttcagaagcaatactgattcagcccaattcaagctacctttctccagtacttttttggaagagaatggggagagacagagagagatgagaagggagggaaccaatataatgaattaatgaattgtgtgatataatgaatataatgaacaatgaatataatgaattgtgtgatctcaaagttcaagacaatggcttcttataggtagaatgttgagactccgaccttttagcaaaggtacgtatccagggagttttttaaagggaatccaaaagtgaaaaacttcataacattggaattttcttatgtaagaaagaaaattttgtttctttgaataattttatttatctgtttcaaggtgggaatttcataaagtaggacccagctgtagattttcttcccagcctccagcaaaatcatattttatctggcatcacactttaatagttaaaaatatattttccagtagaaaagatgacaaaaacttggaattatacaatgctccttgcatagtatctgtctttaatggtgaaaagctaagtagaaagaacaatgtgtgaaagccggcatcccattatcatcagcaaatccactacattcactggatttgatatgatggtcatagaaatattttatttggcatgaagggaaaaggcatagcacgtttaagaggtgagcgtctggtaggagctcatttagaaaatgttgaggccaggcgcagtggcccacatctgtaatcccagcacttcgggaggccaaggcaggaggatcccctgagatcaggagcttgagaccaggctggccaacatgacgaaaccccgtctctactaaaaatacaaaaattagctgggcgcagtggcgcacacctgtaatcctaactacttgggaggctgaggcagaagaatcacttgaacccaagaggcggaggttgcagtgagctgagataacgccactgcactccagcctgggcgacagagagaaactctatctcaaaaaaaaaaaaattaaaaataaataaataaataaaatggggatgatggaatgacttgctttatataattgtgagtattccataagatgcatggaaaaaaatctagctaggctggtcgtggcggctcactcctataatcccagcactttgggaggccaaggcaggaggatcccctgagatcaggagcttgagaccagcctggccaacatggtgaaatcccatctctactaaaaatacaaaaattagccagacatggtggtgggcgcctgtaatcccagttactcgggaggatgaggcaggagaatcagagaggatgaggcaggagaattgcttgaacctgggaggtggaggttgcagtgagccgagattgcaccactgcactccagcctgggtgacagagtgagactcgaaagaagaaagaaagagagaagaagaaagaaagaaagagagaaagaaagaaagaaagagagaaaaaaagggagaaaaggaagcaaggaaggaaaaagagagagagggaaggaaggaaggagagagagagagaaagagagagagaagaaaggaaggaaagaaggaaggaaggaaggggaagggaaggaaggaaagaaggaaggaaggaaggggaaggggaagggaaggaaggaaagaaggaaggaaggggattgggaagggaaggaaggaaagaaggaaggaaggaaggggaagggaaagggaaggaaggaaggacggaaaaagagagagagggagggagggaagaaaggaaggaagggagggagggagggagggagggaaaatgttgaaatctttttcagtgtaaatccatgggtctcaaccctcgttgcacatcagagccatcagaacctgagaaacctttaaaaaatactaatggctaggccctaccccagattcagaagtaactggtctgggtgggtcctagtatcccagaggactctactgtgtagccaggattgagacctgctgatagaaatgaaggatggggaattgtgggataaaatgcagaggttccccgggacactttccggtgagaaacaggctcccctggcagtgcctgctgggagtctctgagctgaaagtcttccatcctctctgggctctagattggcaatgcagccaggagcagggaacggttattcataggagttaacatttctcaaaggcattgtcattcctcaagagtattaaggggtggtcaacaagacaaaaatgtcctcaataatcttggagcactgccctgaaaagtgagtcaaatgtttgaccttctccctaagcagaacagctcaggtcagggttaggttaggtcagagtttctcagccttggtggtactgacattttgggctggataattctttgtctggatgctgtcctatgcacagtaggatgtttagctgcatccctggcctctacccactagttgtcatcccctccaagttgtgacaactaaaaatgtctctagaaatttccaaatgtctccttggggacaaaatctccccctgttgaggactgctggcaattttaggaagagaagtgcccagtgagcaaagggatgtgttgggctagaaagccacaaagggcacaaagagattgcccaggagtctggttgggtctgccttgctggcctctgttccagagtctgacatgtgaaaagaactcagtagcaacttgctgtatgaataaacaaattctccatttaactcttgttttttcttttaaagtagagtcttgctctgtcacccaggctggagtgcagtagcacgattccagctcactgcaacctccacctcccaggttcaagcaatccttgtgcttcagccaaccaagtagcttggattacaggagtgcaccaccatgcctggctttttgtatctttagtagagatgaggtttcaccatgctggccaggctggtctcaaactcctggcctcaagcgatccacccaccttggcttcccaaagtgctgggattacaggcatgagccattgcgcccagcctccatttcactctcatggaaaacatagacacctgtgagcaagacaaggagtcagagagggagggctgctggcaggccaagcacaccctgggcacagggaaagggacaaaccactgcaaaaggtcccaggtggccctgcaggctgggttcaacacacgaatgaatcctcaacccatggatggaacctggctggccatgggcacagcagtaggacacaggccaggtgggctgggcacagcccggggctgctgtggggctgcattctggcccctccctgatggagccccttgcttatgctgttgcagctgtgtcccgtgatcgaggcttccttcaatggcatgtatgcagacctcctgcagctggtgaagggtaggtgctctgctctctctcccactttttcctttactacggagctggcctccagaccctgactccaccaagggaaggcctccccaagtcaggcctgagctgcaactcaggcccagaagcaggtgagacaagcatcagttgatccctgccccagacgcgcagacagaaattcgccacgactaggacttcatgagctcttactatttgtgcagttgtcaggtcagtggatgccccaagttcaaatcccagctctgcccctgacttgctccatgactttgggaaagctaatttacctcctcatcctcggtttcctcatccataaaatggggcttaaccatccctacaacataggattgttagtgaggaataaaagtctacaggaaagttctgggcacatagcaggtgtccctcttggcacagagaagcacttacaaatgcatgctaaatggatggatggatagatggatggatggatggatggacagacagaagatgctaagattacaagcatgagccatcacacgcagcccccggactagtttttatggatactttagaaaactgcagcatcaaatagttctatccatctcgttgcagtttcaaattttccctccatccaaagggtttgaggtatctgagaaattaaagcatgggttaaaaactgagatatctggtttaaaaaataaaaatcagagatgattcgaagggcaaagacggaaggaagtcatttctccctcccccagcatagcagatacgggagggcacaggctcctgcccccacatcagaactctgccatgctcaggcccccagagtggaaactggcggagaagaagaaaagtctaccaactgcactttgggatcagaagaggctcattccaagggcgaccagagaggagaagggagagcagcatgcactgagcgccacagggcatctgccatgggccacgccctcccgctgggtgttttgtataggcacatctcactgactcctcagacaactccatgaggtggcagtcatgaccccccttcactgtgatgaaagaggctccgagcaatgaagtcactgtccaagttcacagaggcagttggtgatagaggaagacttgagttctgagcgagtgtcattcggattgagccgttactaggtgccagttgtatacatgaagcaggaattactattctaccgccgtttctttccttttttcttttttttttttttaattcccaaagagttcttccaatcgtcagatatttggtcagtattcagagtaggatccagagttcacacattacattttgttgacaagtctgtagatttctctttgtaaatcacatttttttgttgttgttatagccattttcggggaccttattgactttaatatactttttttttttttttggagacggaccttttttctttttttaaagtaatttttacaggagtcatgctcatcgtctctatgtccttccgattttagtacatgtgctgccctggcgggcactataccctcattttaagacgaggaaacagattcagacgcgagaagagaccagccaaggtcactggggctcaaaccgaagtccagctggctcctccgctgccccgaggacgggcccggaggtctccctggagcggtaggcggccggtccctggccctccagcactccccatcctcggccatacaccggggcaggtgacacaccaccgccacctggcggccaagtggggaattctgacgcgaacacgagatctttggggggagcagaggagccagtttggatttcagagtagatgttaccaggcctctggcttccagcctaagcttccttgagatccaggtgctcatagggtgtccagacccagaaccacctgcatgggggacgcggctttcagtctggtaggggcggtggagtgttacatacaatagttcagttccgttccaaaccgggactttggcataaaaccgactgggttcccatgctctcatagtatggctttgaacaggtcatttccctttcctcagacttggtttcaccatctgtaaaagggggtaataataagacctacttcctaacgttatcatgcagatgaaccagctgacatgcagaggcctggcacttagtggatgctcgataaatgtcactgtcatcactgtttgcatcattattatcaacatcattattacctgctcctccctacctgcccccccatgcaacagtacagctccacctggaagcagccccccaacttccccctccaatactgccctccaccctcacagaactttcttcttgtccttgagcagtgcccatttccctcagcattgaccgtctggagtttgaccttctgtatcctgccatcaagggtgacaccattcagctctacctgggggtgagtgtcccaggaccttgagggtgaagtggggacattgctgcccttctctgaccaccaggagtcagatagcatgggcctgtgttaggagagaaaatcctggtcaccattaggacacgggctgatctagaaaaatcactgcaggctgaatatgtcccatgcaagtttgttttgttttgtttttttgagactgagtctcactgtcacccagagtgacatgggggggcccgagtggggacactgggccctcagcctttctctcaggcaagtccctgccaatccccaaacctatgacaaccttgaaacaaaagccaaggatcaagaaacacagacctaagtttctctcctagctctatgattccctggctatgtgactttgggcaagttcctttacctccctgagcctcagtttccttgtctgcaaaatgtcagtaataatggccactgaggagaggatgaaatgagaccacaccatgcctggcagaccagaagtgcccagtaactgtcagctccctgtccaatgtggagctgcacagccatgctgtggctggacgccccaaagggccagaccatcctggtagcatgaatcccagactaggtttcttttgttttgtttttttgagactgagtctcactctgtcacccaggctggagtgcagtggtgccatcacagctcactgcagccttgacctcctgggctcaagcgatcctctcacctcaacctcctgagtagctgggactgcaggcactcgccaccacgcctggctaattttctgtattttttgtaaagatggggttccgccatgttgcccaggctggtctcaaactcctgggctcaaatgatcctcccacttcggcctcccaaagtgctaagattacaagcatgagccaacacgcctggcccctggactagtttctatggatcctttggaaaactgcagcatcaaatcgtttcttccattttgttgtagtttttaattttccctccatccaaagggtttgaggtgtctgagaagttgaagcatgggaaaaaaaacgaagatatctggtacaaaaaataaaagtcagagattatccgaggggcaaagatggagtagatgttgccacacacctgagctccaggctaagcttcctggcaacaaatgcacaaaaaggaaacaggctgaatggtgtcatttccttctaggttgctattgggtaagctgcagagttaaaattcttagctgactccctgctctgtctcctcaggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtggtaaacctcagcacaaggcagagaatagggccgcccaggccacatcataggaatttcctgaacacagggtgcccctaagcaggaatcctccatcaggctcagtttaatggagatctcactccctcctctaatagaccctgcctctgacatagctctaaacctaaaatcctcccggtaacatccagccccagtcatggttctaccctctggaatctgatgcaaatgtttcctctaccaaataacagtctcgtgaaatcaaaaggcatcttagatatgcagtagtccaggggtgataaatacatctcagatagtgagtagtccagggatggcgactgtgccactgctcaccactatgacactcatggcagacatcactaatcgatcaaggctctcctttctactgagtctggatgctgacacaaccttggaatccttattaacagggcacagccgataaccaccaccagtcaactatgttgtgccacctcctcccgggtgactgacggggaaattgaggtccagagggggaaagggttggtccaacgttatgggaggatggcagaacttcagggcagctgacagacaaccaataaccaagctctcaggggactgggatggcgagaaaatagggagtggtcaccaactagcccattcatgattgcagtaaaaatgaaatcacctctctatgtcctctgagatcaggaagctgcccccagacccacaaccatcaccagcccacagtaaaagtccaggccagcaggaccccatgccccatagaagctgacctaggggctgtttttccaccaatgacagacacatggcttgggtcactgggcccacccagcttttctggggtcctgggaaaccttcctcccagcagtggggtgcaggagatgtgcctccctgtgccctccaactgaccttctctggctcctctcaccctcagcttcctgagagtgcccatcggctgaagtcaagcatcgggctgatcaatgaaaaggttggtctgtttgccatctgcagcttgaggggtgtttgctgtggtctggacacaggcctctggggaggagaatctagtgggactagtgtttcattccagcactgggacactcaaaccgcatccctgtccgcacagagatttcagtctagcaggccagtttgacctgaagcaaatcatcacatggatagtatttccattacagctgcagtaacacaggacaggttctaggggccatgagaacactctgggcccctgatacagtctgggacgtcagggaggcctccctgaagggaagggcattccagacagagggaacaggagaccaaaggctgccaggtagggagaacaacacaacattcaaggatctgcaagaaggacagggtggctggaacacgtgagggagcagggagcccaggaaggcaggcaggggccaggccacacacagagcctgtgggccatggtgggcacttgggaggccacatgtgggtctgatctccttccaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgtgagttcagttgtctgcgatattggcagcaaccagggggacccttctgtctacttttcctgttcgccctcttgctttgttaaacatttccaccactctcatcacttagcagggacaggggacagggagctctgaaccaagagccaggagctttgtgggtccaattctaaccctgtgactttcttagtcaggaatctctggacagaaactcaactcatatgcacaaaaggaattgtattagctcctataactaaaaagtctagatgctattgacttcgggaatagctggacccaggtgctcaaacaatatcctcttcattctcctctctcccacctagcagccttgttttcctctgtgctgccttcatcctcaggcaagctattccctcatggtagtgccccaggctgcattaggctcatatcctatcagcttggcaatcaccgcaggaagaacctatctttccaatagttccagcaaacatctcagggctgactctcactgaatgagcctgagtcagttgcccattcttgagccaatcagtgtgtccagaaaaatggaatatgaaaacttcctgagctgggccacctacacactagggtaagggagtgagggctctatgaatagtggctgctttcgtcgtcgtcatcgtcatcattatcattccccacagcaagcctagactgtcatctgttaaatggggagtggaggcaagtactatctcatttaacagatgaggcaggtgaggcccagagaggtcaaaccctttgccaaggtcccagagccaggaactgagattcagaccccagagcctccctgcataacccctaattccacactcggatcctcttgagaacaatggggcctgggcttctcttgttgcaggaagccagctcggaagctcagttttacaccaaaggtgaccaacttatactcaacttgaataacatcaggtaaacacacaaatcatcatgaagattctgctgatggaaatgagtcccgcctggtaaccatgggtttctttaaacaccgactttgtggctgtcaggtgaaggcggctccagggtaggcagggaggtccttccggatgctcctgctgacaaggactgcatgtgagggaatggggaggaaaatgaagtaggccttgcagcagccacggcacaggcaaaccctagccgcggccagcccactctggacacctcccaggccgtggcagtgacagtcacccggcacagaagtgcagggctccagctgcctcctgcaccctgcctgttctccctccccgccactttcctgtggccccagagtgagtgcaggggctgccagctggagcctctggggacaagtcaggcccagggctcttttgatcagcccacatagggctgggctgtttaatataaatgagttgtgcacatatcaaatcagactatctggctgccctgtgcccacaatcctacatagcaacaaactgtcgagccaggaattggggcgccctttgaaggagcttgggcctccttgtccaccacagccctgactcctgaggttgatttttctgctcactggactgctatttgttttctgtgccccctctatgccccccaccccacccctgccattagaatgcaagctccacgacgcaagggcttcatgtggttcactggagcccgcactgtgcctggcacataataggtgctcaataaatcgctgttgaatgagtggatggtgaatgagtgggacttcaggggccgctctcacaggcatcttccattgcagctctgatcggatccagctgatgaactctgggattggctggttccaagtaagtgttaacaggtggtgcctgagggcacagggggtggcctggaatggtccactctcaaaacagatattgcccaggatttgcttcaaacaaggtccccacagaagcaccatggggggctggccggtctccaccaaagtccaacttccctcgagtgtttacagagaagccaccacgtgtcagacacagctgagaacacacacacgcacacacaaatacactcacagatacacactttctttcagtgaagttttgatcctgaattagaacacaagtgcccttgactcacaatctcattctgcacacgtagacgcgcctcagtgcccctagacagccctttcctgctgggattcagaccgaaccccaatacctcagtctggcgtgttttctctggtttttatgatttgtttttcactatttttgactttttttttttttttttttgagatggagtctcgctctgtcgcccaggctggagagcagtggtgtgatcttggctcactgcaacctccatctcccgggttcaagcaattctcctgcctcagcctcctgagtagctgggactacaggcgcccaccaccacgcccggctaattttttgtacttttagtagagacagggtttcaccatgttagccaagatggtctcgatctcctgacctcatgatctgcccgccttggcctcccaaagtgctgggattacaggcatgagccaccatgcccggtgactaatattttaaaacacggagagttccacatgcaaatcaggacttctggcttccctccagaagtcagaagttcaggcaatgcagggcaaaattccctcagggcaaattcagctgcaacagagtggtggggcccctgaggatggggcatcctccaatgcaccccaatccccccatctaccaggccccaggggcggctgagttcatgccccaacccagcccatctggtccctgggagcccccacagctctgatcagcaggggacctggaattcctacatctccaccagccacctcacccatggggaggagccacacccacgaagaatgatgggggggaacttcagatgctcaaccagggtgacagtgccccttctctctctcacagcctgatgttctgaaaaacatcatcactgagatcatccactccatcctgctgccgaaccagaatggtgcatacctctgccatctgtgccccctctctccccagggcttggctttacttcccctgccctcatctccatgaatggggcccctttcattcatctcccagccatccctcagagcctacttcaaaatctgcctcctcccaagaaccttctcagcccaattcctttgctagtgccagaggctgggctcgtaaagatgaaccaagcagtgggccagacttgcagggctggaaggagacagaggcataagcagacaatgagagcaatgacagaggtgtaagagacaactggaggcgcctcagcagaccctgttccccctcttgctagtgcctggccttggtcaagctgcacaatccttctgagcctcagtttctccatctgtaaaatggggacgtagaagtaccttcttcagaggcacaaatcaggaggtgcctggcacagtcagtgcccaacactctaattcagccccaggttgaatgaggggtgggaagggtttgtaacctatacagttccacctttttaatttctttattttattagactggaaaaatctcaaagtatagaaacctctgctggggataatgggagcccctgatggttcttgagcaagagcgtaagagaatgtgaggactgcattttgtgaggggccagaagccagtgccagaggcaaagggagggtagacgaggctgggtcaatgctggggccagagaacaggcgagcagaggcagagggggctgtctgatcaggcctgccaggccggggctccccttcaggaaccctgagcctgcccctggctgcccagtctcaccccaggcccatcagtttctgaccacatttgttatttcaggcaaattaagatctggggtcccagtgtcattggtgaaggccttgggattcgaggcagctgagtcctcactgaccaaggtgagtgggtgtggccctaaacatcctgccccagggagggcacagccactgagagccctggctgggaggtggggcctgcactccaaccccagcctacaggtgaccctgggcaagtcccttcccctctcagggcctcacctcctcatctgcaagtgagaaggttggctgtgctgaggatggaaccctcctagcctggggtcagtacactttttccacccccttgtcattcattcattcattcattcattcagtaattcactaaatatttttcgagggtcttctataggcaagccatgcttctgagtgcttgaggccaccgaaatgaacaaatggaaaacactcccatctttttcaagcctaccttttagcagaagaggcagatacacaagccctaaagatgtaacatcaggctgagtggaggaaggctgagaagaaaaataaagcaggctcaggaggagagagtgatgtcagggaagggggtgctgtttcagatggggtggccagggagggcctctctgaggaggtaacatttgagccaatgcctgaggaggtgaggggtgagccctgtgggtagctgggagaagtgtcccgtcagagggacagcgtattaggccgttctcacactgctataaagaaatacctgaggctgggctcagtggcttgtgcctataatcccagcactttgggaggccaaggtgggcagatcacctgaggtcaagagttcgagaccagcctggccgacatggcaaaacccagtctctactaaaaatacaaaaattagctgggcgtgatggcgggtacctgtaatcccagctactcggaaggctgaggcagaagaattgcttgaacccaggaggcggaggttgcagtgacctgagatcacgccattgcactccagcctgggcaacaagagtgaaatccatcccccccccaaaaaaaaaaggaaagaaaataaatacctgagactgggtaattcatgaagaaaagaggtttaattggcttgtggttctgcaggctgtacaggaaacacgatgctggcatctgctcagcttctggggaggcttcaggaaacttccaatcatagcggaaggcaaaggggaagactgcacatcacatggcccaagcaggagcaaggggtgggaggtgctacacacttttaaacaaccagatctcacaagagcacactcaccatcacgagaacagcaccaagaggatggcgctaaaccattcacaagaaaccagccccatgatccaatcagcttagaccccacctccaacattgggttctacatgagatttgggcggggacacagatctaaaccatatcagatgtcaagtgcaaaggccctgaggcagggattgttggtgttccaggaaagatgaggaaggaggcccaggatctgaggcaacatccaaggcaggtaacctcataggcctgagatgcatgcatgcacacacacatatacacacacacacgcacacctttatacacctatacacatacatacacacgcacatacaaacacatacacctttatacacatacatacacacacacacctttatacacctatacacatacatacacacgcacatacaaacacatacacctttatacacatacatacacacacacacctttatacacctatacacatacatacacacgcacatacaaacacatacacctttatacacatacatacacacacacacctttatacacctatacatatacatacacacacacatacatattgcacacatacacaccacacacatacacactacacacacacacataatacacacaccacacacatacacactacacacacacatacacacacacataatacacacaccacacacatacacactacacacacaccacacacatacacacatacatacacacacatacacagagacgcacacatacacatatacacacatacacacactacacatgcacatacacatacacacacacacacacaccatgtggccagatggtctcagctcaaggccaggatcatgtccatcttgtccatgcctctgtccccggtgctcagcatggcctggcacacagtaggtgttcaataaatgcttggtgagcaaatgactctccgtggcatctgctggggagaggatctatggcagtgtcaccctcgctcccaaatactacccttaagaagaacagctcacagtcactgtgtgccaggctctggggcatctctccccctctagagtggagccaaaacttcaagaaggcaggggtttctgtctgctttgttctctgttgtgatcagtggctgcacacagtaggtgtttagtaaatgcctgctaactgagatggacaccttactgtcattagctcatgcagaggaggggcccaaagcagggggtgatcaaggcgggtgctaagtgcaaatcccacttctgccacctactgagtgcgtgactttggaaaggggcttttgccatcttcaagtctcagtgtccccatctgcaaaatggagatgacatcaggacctggtgtggcattaatgttcacacacagaccctccaccccgacccttctaagaattctgtatttgtgggttcagggtcatggtcccccggtgccagcagtcaccttatggaggacaaaaccagcataaaccacaaggcaaaaggttaaagaaacctgttttctgacttttcccctccaattccaggatgcccttgtgcttactccagcctccttgtggaaacccagctctcctgtctcccagtgaagacttggatggcagccatcagggaaggctgggtcccagctgggagtatgggtgtgagctctatagaccatccctctctgcaatcaataaacacttgcctgtgatgcctgccgtctggagtctctttgtcccggcacaggagtcattttgcccctggcaggcttggggactggatggctgagccacacctgggtcatgttcaggcacatctgagccaatctgggtgatgtctgggccacatgtggatgatgtccacagtcttgaccacctccctgtgcttcaggaatcagaaagccagctcttcccacctgccttcatgtcagcctcaagaccatcttcagtgggatggcttttagggtgggggacatatgttttgtttatcttggcagtgtggtggacagaggactctctgaacaatgtggatctgggggcagatgaactaggcttggagctctggctggcctcttaatgcttctttgactctgggatgtagtttcccctctgtgggcctcagtttccttctccgtaaaatggggatagtcattgtctctgccttggagggctttggtgaggagtaaatgagagaacagttccagatacatggtagatactcagacaatgtcgtctgtgggtggtcattactgctgttgcctggcctctggagtgttcagccttatcaccaaagtgccatcctgctcagacagtgcatgactgccttgtctttctggcctccctgatgtcagggcgcttgggacagacaatagggtccctgttctccagacctcaggcctgcccagtaccttcagttacacgagggccttgcaggaagggatagggtaggcatcccaggaaaatgcgttgctcatcatgagagcacaaacaggcataagatatacagctcacagcccagaagggcagccagggacattggccaggccaagaggcacacagaggcaccaggccacagccttgcacaaggtgcttacaccattgtcagtgaccacttacccaacagctactgagtgccagggctgtgtggaagttccccacgcatcccagctcccagccaaacagctgcccagtgccagggctatgtggaagctccccacgcatcccagatcccagccacactttgggtaggattttgttccccacacatcacattccattatttttctaaatcatattcaatctgcatttgaactcccattcacaaaggaggtgacaaagtccatctccatcttgcctagggttggactcttctggctccctagggtcatacaaggatcttttgggggcttccagggagcctggaggatggagtagcccctctagtctgggtcccacctggtcctgatgaagggatccctgtcccagtccacgtgaccctgtcagagtcaagtagctcctccaccccagccaagcggggcacagggatccttctccaaaacagcccgagccgtatatcctccgcgtcccatcacccacaccctctggggcttcctgggggtcagcagatacataaccctggcttcctcaccctttgggggagggaacaactctaggacacctgctgtagacaggctcccagctcaccagcgggactgggccccagttgtccatgctgataaccagcgtgctgacacagtttttttttttggtggggggggtgtggtttggggtttggtttggttttgtattgttttgttttgttttgttttgttttttgagacaaggtcttgctctgttgcccaggctggagtgcaatgacacaatctcagtttactgcagcctcaaactcctagattcaagttatcctcctgcctcaacattccaagtagcttgaattatagatgtgcaccaccatgcccggcccaatatgctctttataggttgcctcacctccccacctcacttccacactcccctaccagtgttccctggggtcatctcccaaatcaactacctgcactccaatcctgttctcagggtctgcttctggtgaacctcaatcaagatagccatttgctccaggcaggcactattctaaggatcttccagacctttggtcacgccaccttccccagcgcctgtggcacaggctccccccacacctgcacctgacaaatgaagaaaccaaggctctgacaactctgcaccactcccaagcagcccccaactattaccccacaccacctccttcttctctctgctcctttatcgcctacccacttgggtttccacctcccccaaaaaaagagaggggttgttctcctgtgccagcctcctgatttgggccttgaaacacaaccaccctccatgaactgctgaggctcctccaggctgggaattccacgactccactgccttgctgggctgcgggaggaaaactcctcaatttcctgctgtcttagcagcagcagcaaagagaaaacaccaagagatctcattaaatcatcgtgccttgcaggaattagtactgtgtttgtcttacagatgggagatgaagtaacaaacagctggtgatgtgatggggctggggcgggaacccaggcctcacccactttgccctgagcctcccagctgaatccacagcaggttatagatccaattttctttctttctttatgtctttttttttgagacagggtctcactctgtcgcccaggctagagtacagtggtgcaatctctgctcactgcaacctccgccttcccaggctcaagcaattctcctgcttcagcctgccgagtagctgggattacaggcatgcgccatcatgcccggctgatttttgtgttattagtagagacggggtttcgccatgctggccaggctggtctcgaactcctgacctcaagtgatccacccgcctcggcctcccagagtactgggattacaggcatgagccaccgcgccgggccccagttttctttttcttcaaaataacggtaacaaccagcagcctctgctcccagcacagtgttatctacttcctgtgagttgagcattccccttttacagatcaataaactgaggctcagagagaggcagtaacagtgtcttgcccatctccgtgtcctgcctagggcttcccttttgtggaagacacccccatgaaacctcccatctctcagcagagattagtcaatgaggtaagcatatggaggccgtggggctccggtctttttcatttagagaccagatttgggaaggaaagaagacctcagtggttccactaacaccctgcgccttcctggtgactcaggtgagcagttaacccaagagcttttctctgcccttggcagaaggaagacagcccttcacaataatattgagacccagtttgcagaaatgaaggggacctatcaactcttaaatcatattctaacccaaaaaatctgagattctaaaataagaatatcccatctaatctatgctgccaagtcatattaggttgatgcagcaacttaatactgacactagccctttgcttttgaggttagccaaaacgagaacttcagagctgccattgaccttgtgcttcctgcacagctgctgtcttctagaccccacccttcaggttgggcacggtggctcatgcctgtaatcccagcactttgggaggctgaggcaggcagatcacgaggccaagagatcgagaccagcctggccaacatggagaaaccccgtctctaataaaaatacaaaaattagccagacatggtggcacgcacctgtagtcccagctactcgggaggctgaggcaggagaatcacttgaacctgggaggcggaggttgcagtgagccgagatcacgccactgaactctagcctgggcaacagagagagactccatctcaaaaaaagaaaaaaaaaaaagaacttgcccttccattgtcagcctctctgccccaggtctccagccaaagaacacagtttaacacctgctctgtccatgcctctgagttgtgaaagggaaagacattaaccccaggaggaaaccctgtgaaaaatccaaaatccacctagagaagagtcacacctgccattggggtgcccatactagacagcaattaatgaagccgtcaatgctgacacagccagctgtgcacactcgcagtggggatgccaggattcccacatcaaaggaccctggcacagcagtttggttgggagctaggtctccgagtcttggagctgcgtggcatagtgacaccaaatttctctttcactgagtggtcagacccctctctgggccctgatttcaaatcccagctttatcatggacatgctgtgtgacccagagcaaggtacttaacgtctctgagtctcagttttctcatccataaaatggaagttaaaagaaataactttttgaacacttcctatatgctaggccctgtactgagttgccttaacgaaccttcaccataccaaaaagacataaatggatctatcattcccatgttacagacacgaaaagtgaggctcagaagagaaagccacttgcccacagtcacacagctcctgattgaaggtggcagtttgagcccaggcctgtctggctgcagagaccatgccattggtgaccacgtcatagcaaaaactgatggcttggacaacctagacagaaagggcataggtcctgagactcggcagagcttgaaagtaattttaaaattaaaaaattttttaaaagactatagagaatggctaccagaaggtggaccccagagcccccctgcctggcccttgccacccacctgctctcctccctctgcctcacccccacacaatcactcccgtgggttctatgactgccacatcctgtactaggagcccccgcagggcccctcccgagagctggggtccctaccagggctccacagctccaaggacgttccaaacggaaatgacccactctcaaaatcacagggccccacccgcctcctccctaaagcctgttggtccaggactcagggcctgcccctccagcctcagttttggccagaagccccttgccacccagtgccaagaggacctctccctccactgaagagctcctctgagccgcaagcctggccaaggggctggacttcctgcccgggtacccacccgcctgggcttctgagctcaggttaaaaaagttgtctttctgggaagctggagacagaggccaaggagagattccagataaccccattcttggagatgtaaggccaaggaggtcaacggggcatttctcaaatatttcttgagcacctataaaaacgttgtgaagtggcacacagatttttagcaccaggcgaacctgggccggaatgccggctctgccactcactacctgtgtcaccttgggtaagttatctctccattctgagcctcagtttcatcatctgtatcttgggcctgatatcaatgatctgagaccattggggtgaggactcaatgatgcgatgaagcttgtgcagccctcagcatggtgcctggcacatagtatggactccagaagtcagggtcggtatggctggctcaacccaggaagtggagagggtggaaagatgagtgtgctgtgctgagggcaatgggggaaagagatctgacttgagtgaactgatagagaaaagtgtttgacacagagactgactaagtgctggttggatgaatagtggatgcatttgacatcagcttggaagagcaaatgccacaagcacaaatttcacagcccaatcaatacaaagcagtttgtgtatgcaaacaaacacaaaaccattctctttccgttatccgatttggtcactgttttgaaatcctgtgccaccaagtagcaaaaaactggatactcaaggcaatgccaggacattctaaggcactccagcgtaggcttagccacttcaggggtctcctcgccttgctcaagggcagcgtctaccctctgggtggcttcttcatgggcatggcatggagggcaatggtagctcctctgtgggccctgtttatagtgacatctgccctagagatgtctgcattttggctggtccctgccttgcagttccagaagcttcgtttcctagtggaatgctcctgcccacccagacagcccctgcctgcagattctggggtcccagctatgccctttcagacacgtggcagggctgaggttctgctggtaggaactggtggtacaaatgcagtgtttggaatatttctctgctagctggtaaagatctgtagctttaagccccccaggtgcctaccgctaccacctctctgacacctcccccagaacctctatcccatagcaaactcaagatccagaagcctccagtgttaaaaggaagtgctaggctatgaggaatgactcacacttgtaatcgcggcactttaggaggccaacacaggaggatcgcttgagtccaagagttcgagaccaaactgggcaacatggcgaaatctagcctctgctaaaaatacaaaaattagctgtgcatagtggcatgctcctgtagtctcagctacttggaggctgaggcaggaggattccttgagtctgggaagtcgaggctgcagtgagccaagattgtgccactacattccagcctgggtgacaaggcaagaccctgtctcaaaaaaaagggggaagtaatacatcctttaacctctcacaatgtcatccaaccatattaacagctgttgggcactcactgcttgctaagtgctttgcacatattatggaacatattcctcacaacgacctagaattgtccccattttacagatgagaaaactgaggcatgaagaggtcctgtgacttgctcaggtcccaccctcaggaagtggcagggcccagctttgaagccagcccacgctctggagaagggcactccaggccgagggatccacaagcacaaatgtacagtggcaggaagtgcaggctgtgttcgaggactagcggatctggagctgggggcagaggcaagggaaggaaagctggagagatggtcctaggagaggcagagctgggagatacacagtgacagggccccggtgaggacgtcaaggctcccacctctgtgtctgcaggtcctggccaagagaatgctgctgctctggatgtcactgcttgctggacgctgctgccccaggcccaggggaaggcccagcacctactctgccttcagaggacaagaatcagtgggaaacaggtaaatgttaaggggtgagcgtcagaggcatgaactcaggaaaggccaggggtgggagacggcaccacctccctgctcaatgcttctcctgtacaggcctcccccttgccacagaattcaccttacctcacccagagctgatcctgtctctcccctgctctaacacttgccatggctcctcagtgccctcaggagaacctctgagccccttatcctggcattcaaggccctgcatctccagcctcttccactgcctccttccctgaccacccccacagacttcacagctccctcctgtgctaggctgttcctctggcctgaaatgcctttctctcctgctcaacctggtgcatctgggcccatgcttgaacgcaaagttctaaccacctcctctgggaattcctctcgatttccccaggcagaagggatctctccttcctctgagttcccacagccctttggtgacgtctcctctgcggccttatccaagtgtgctgcgcctgctgtcccatctgtctgtagggctggctgcctctgtccctaactcctgactgagctgtttgtcatccatccagccccatccccgctcgccacgctgcagcctcacttatctttctgtttcctaccacgccaggctcaccagcacctcagggcctttgcacgttctgttccctctgccaccatggctgtccccgagatcagcctgcatgatggattcctccacctcactcaggcctcagctcagaggcctcctcctcagagaggcgcttccttttcaccccatcagaaacagatcttcacccagtcatgctccgactccactgtattttttcttttgcacagatcactctggaatattgccttgcttgctgatctgagtgctcggcttttgtctctctccctaccaggaagtaaactccatgagggcaggagccacactgcttctgtcccttgagcccaggagagagtaagcactcagtaagtgctggctgccaaatgactgagtgaatttggtgaaaggttgaatgaacagtacagccccacactgaagcggggcttgcatcctcggacagttcagacctgttctcagagcactacaccctggactgcatgctcagcctgcctgtgacaggggccaggagcaaaggtgttgctgtcctggaccacctgccctttgtaggcaaacgcctctccaagaagagcagtgggctggacctgtcgcaggtcggtcggggaactgctttcagggaagagcctccccctgctgtgggagctactcagggcaggtggataagtggagggctaggactgcctctggcctttcctggtaccctgagcagctgtgttctcagcacggtgtctttggaggttctctatagcctggaaagtgctaagcaagtctacttttcttgaccctatgtctctccaagctgcttgaaatcttcctaggaagaaagtagggtctcaatctgggacctcagcccggcagccctcctgctccctacactcagcctacaactgggttttctgcaaacctacataggtttttgaaaaatatttttaatgaattgccaacatataaaaatcaagaagattttaatcaaaatctgggtttcccaattgtattagattgtgaggactgccataacaaagtactattaatacaaactgagcaccctggacaacagaaacatattgtcacaggcacagcggccgacatcagtaatcccagcactttgggaggccaagatgggcagatcatttgaacctaggagttcaaaaccagcctgggcaacatgataaaaccccatctccacaaaaaatacaaaaattagccaggcatggtgacgcgtgcctgtagtcccagctaccctggaatctgaggtgtgaggatcacctgagccctggagttcaaggctgcagcaatccatgattgtgacactgcgactccagcctgggcaacagagtaagtctctgtctcaaaacaaaacctccaggtaaggcaagagggctcgcacctgtaatcccagcacttcgggaggccaaggcgggtggatcacttgagatcaggagttcgagaacagcctagtcaacatggtaaagaccagtctctaataaaaatacaaaaatcagccaggtgtggtggcacgcacctgtaattccagctgactgggaggctgaggcaggagaatcacctgaacctgggaggcagaggttgcagtaagccaagatcacaccactgcactccaacctgggcaacagactgagactccatctcaaaaacaaacaaacaaacaaaacccaccagagccggcacagtgacacacatttgtagtcccagcttctcaggaggctggagaggaggatcgcttgagcccaggaatttgtaatgtgattgcacctgtgaatagccactgcattccagcctggacaacatagcgagacaccatctcaaaaaaaaaaaaaaatccgtgctaaaggcagatatacagcagggagcctgacccagaaaagttttcctctggcatttgaatttgttgctgcctcttccagtgggcaccagatgagtcaccagcttgtacctaacgttcaaaaaatacctaaaactcggctcctctcagctcagggaggtgctggtagctgatggtgcagaagggagcagagcagatgggtcctgagcagatggcagagggcttacctgccaccttgccttccctgactctcgctggcctgcttctcttttgcagatgcttacgctcctctactgttccctcccccattttacagaggctgacacggaggcccagagaagggaagggacttgcctgggtcgtcaagccttggagaatggaactagagctcagcgttctacagctgggctgggggcaagggaaggggttgtcccaaagctgctcccacccctcctgggctctgcccctattccagcagatccggatactcacaccccacagagtcacagaggcctggccaggccacaccaacatcctccatgcctctcacaggttggtcatagaagacgccaaaagacctgagatcaccctgcaaatcctaagtgatagcctgctgcaggtcacgttgcgctgcaaactgtacctctcactccaggagtaagtacacacgggcacttccgcatcacccatttgggtgccaggcagaccaacccctcactgccatgaatcaagaggcagccatgcagggctagcaaaagtcacatgcctcatgtcaccacacgatcctttccacttgggcgtgtttcaaagccatttttactgataaggaaactgaagcacggagtgggagaagaacctgcccaggaacacacagtaagtcggtggtgcaggttggataaaaccctctgactttcatgtcaggggacgtgagcccatctgagcaaatgggcaggacagtgtattaacaggattacccgaggaaggtgtggttcaagcacgccttggagtctggcactcctgggctgggcaacttgggcaagaggtgtccattctctgggcttcggcttcctcatctataaaatgggtataattggccaggcacgatggctcaggcctgtaatcccagcactttgggaagctgaggtgggcagatcacttgaggtgaggagcttgagactagcctggccaacatggtgaagccttgtctctactaaaaacacaaaaattagctgggcatggtggtgggcgcctgtaatcccagctacttgagagggtgaggcaggagaatcgattgaacctgggagatggaggttgcagtgagccgagattgtgccattgcactccagcctgggcgatagagcaagactccgtctcaaaaaaaaaaaaaaaagatataattctggtttcctgctgcactaggctgttgtgagagttcacctgcaaaattctgaactgcagctgattggacagaccagaggttgcaaacacaacagccaacagaggcagtgatacaaaccagtgtttgcaagtaaaacagaaatattcctaaatgccctttaggaacgtgtccactcttgtttttcttgtaaaatttggctctcttcatctagcttccacctttttttctttttttttatttttttcagacagaatcttgctctgttgcccaggctggagtgcagtggcgcgatctgggctcaccacaacctctgcctcccagattcaagcaattctcatgcctcagactcccgagtagctaggatcacaggcatgcgccaccacacccaggtaattttttttatttttagtaaagacagggtttcaccatgtcggccaggctggtttcaaactcctggcctcaagtaatccacccgcctcagccttccaaagtgccgggattacaggggtgagccaccgctcctggccaaacttcccccttttaatagagatgtgagtacaaataaatatttctttgatagacacgtggacacagagaaatatttctctgcaatatggtaaacatatcattccccttgtagggatagtgcagtaaaaatggaacctgaccactggcctggtggggaccacagcaaactagagagcacatggcccatctcaaggtcaccctcagccccagatgtttgccactctgtgagaccaggggatccagtgttgtcagatcatctgggttttccatatttttaatgaatcctcctagtttttaatttgagcccttcaggcaacggcaggctatcagcttgtgacctctggcctcaactttgggctccgcactttcatctgcccaaatacactgtccctacaggatcccgtggctcaaagtcatcaagagcattcacattggagtacggctggaacagacagggaataccaccaaggtggctttcgaggagtgaggagtgccacagcccacctggacacctgagcactgaggctctgcagcagtgagtatgtgcctgctccaaagcttccactgggcaaggctgcgtgccagccctttctttctttcttttttttttttttttgagactgagtcttgctctgttgcccaggctggagtgcagtggcacaatctcggcgcactggaacctccgcctcccaggttcaagcaattctcctgctcagcctcccaagtaactgggattacaggcacccaccaccacacctggctaatttttgtgtttttagtagagacagggtttccccatgttggccaagctgctctcgaacccctgacctcgagtgatctgcccacctcggcctcccaaagtgccagtattacaggcgtgagccgccttgcccagccagatgccagccctttctgcactgatccttcactgaaactccgggctgggactgcctctccccagctagttgtctggagtggccggagcaccgggaacagggtcatctccaaggccacagatggtacccatcagcatctccttcctccatgtcaaatgtcattgctaagagctgaggttcaagcctcagcttggacacttcctaacaatggggcctggccaagttatttgacctctaggagcctcagtttcctcaccagtaaaatggaatggctcacagtacccaaccagcatggctggttgtgggggaaaaaaatgagctaacccatgtgactcacttagcacagagcctaccacataaaatggtcacgatctatcgttcttatgtttacccaacacaaaacctccaagaatccttctatgaccactgtcaggtgtgacctctccctgctcagaaattccagagacctttatcagaaagagaaataaagagacagaggcaggtgggtgccatggcttatacctgtaatcccagcactttgggaggctgaggcaggtggatcacgtgaggtcaggagttcaagaccagcctggccaacatggtgaaaccctgtctctactaaaaatacaaaaattagccaggcgtggtggcaggcgcctgtaatcccagctacttgggaggctgagcaggagaatcatttcaactcagatgcagaggttgcagtaagctgagatcacaccactgcactccagcctgggtgacagagcaagactctgtcaaagagacagaggcagagagagaaccaggaagaaataaagagaagcaggagaaaatcagggagggagaaagcaagaaggcaagcagaaacagaaagaggggaagagaagaaagaaggggcaggaggaggaaggcagggaaggagcagccactggagcccccatgccacacaggcctagaggggcttcctcaaccctgccctgactcgccctcctgactgcagtctgccagccatggtgtgtcagaccccaccagccaccctctccacttcctctaggatggacaccctcctggcaaacaaagcccagctcctatccactgctccttccccatcctgatggaatgacaggaggtggatcgggaggacgggaggcttcgagtggaccggaaggaggcactgtaaacaaaggcgcagagaaggaaatgggccaaacgagggagaagcagggaaaccaggctcctgggtccaaagcccagctctacctcttcccgtgtgcaggatcttgagtaagtcacttcccctctctgggctttagcctcctcatctgtcaaatgatgacaatgacagttcccatcttgtggcactgtcgtgaggttcaaatgagattgtacatgttgatgtgcagggctgtgtctagcacatagcgagcctgcaaatatgtttgctgtaaccagttgcccagggaggcccttcccactgaatttcttcttccttcatttctatgaagcttgtggccccctgcagcccgggccagagagcctcaaggcctgagcacctggccccccagcccttcccaacatcagcccagggaagcgtggcagacctgctcttttggctggaagtctacaatgacatctgttctgcctccacaccagcaaggagttccacgtggacccccaggactccacagtgagtgctagaagaaggggaaaggggcggggagaactattattgctccatttttcacattaggaaaccaaggcccagatggggaatatgactggtccaaggttacgtagtgggtaggatcagggctacagccagatctcctgcctccccgctgggctgtccatcacacacaggaatggcagctctgagacagtcagaagtgagcctgtcattccacatctacagaaattcttacaccagtgggcaagggcattctttgtattttactagttatgtggtgaaaaataaatttaacttagccaggcgtggtggtacacacctgtagtcccagctactggggaggctgaagcaccagaattgcttgaacctgggaggcggaggctgcagtgagccaagatcataccattgcactccagcctgggcgacagagtgagaccctgtcagctttgttgtatgtatagacattttcataataaaatgtcaggagaaaaatcattgaaacaatacaaagttaacctgtccagataaatcatggtgagaaacctcctcttacgctgggacggaccagtggcaggcggtacatccagtagttacagctcattgagccccactgagctccctccccaaccagccagctcagagcccgtctgcaggattttaaagaccaacacacactttgccccttttccaggctgcagacctcattcagctattgtcacggattgagctggagcccaggcccagggtgggtgtgttgccagctcctcctccagaagcccagccagggtctcaggggagattctgagacaggagctgggccaggtcaggccacatgggcgtgttcccttaggccagggtttcctgccgtggactccaaaaatcactgcacctgctacacaggcattgtgaggatttaatgagatgatgtaagtaaggcacttagctcagggctcagctcaggtgaccatggccctgtgcctgccattactattcactcctgaataagacccaagcctgctggggggacacctagataatggtgggcagtgactgtacacaggtccctcccactacatcagtgcaaccctccagtaaccctgcactgtcacccccttctacaggtgagcaaactgaggctcagcaaggtgagctcactcgcccaagctcacatcgctcagtaaatggtagaaccaggattggaaccccgtccctgactccaagatccttgctcaatgtcctttctccaaagtgtttcagaacagagcccctgatagacaagcagtaacaataaccacaacagctgacaagtatatggcagtactaggtgccgggttcttttctaagcactttatacaaattaactcattgaatcttcacaacaacctctgggctagttgcaattattatccctattttacaagtgtgaaaatcaaagcacagagagattaagaaacttgcctcaggccacacagcttcccagtggtggagctggaactccggttccaaaactctatactcttacctgctatgtatgttcaggagaaggaggatgttatcccacctccaaaaagcccagggagggtaagtgacctggccaaggtcacacagcaagttgctgcagtgctagaacagaaccccagacccttgactcctaagatagccttgcccccgttcttccaagctgggagctgaggaaagccatctttagtcaatgcctgcaccttttctgctgtaatttcacccaggcttccagtcagtccagagggagcatacaactgaccatcaacacccctgatcctcccacggtccgccttgacggccacacggccaccatcatccagccgggcttgctagtgctactggggctcagcatcacctcctctgtctcagtttcctgggtgagtgtattagtctattttcatgctgctgataaagacatacccaagactgggtaatgaaaaaggggtttaagggactcacagttccacgtggctgaggaggcctcacaatcatggcagaaggtgaaagtcatgtcttacatggcagcagacaagagagaatgagaaccaagcaaaaggggtttcccctgataaaaccatcagatctcgtgagacttattcactaccatgagaaaagtatgggggaaattgcccccaggattcaataatctcccaccgggtccctcccacaacaggtgggaattatgggagttacaattcatgatgagacttgggtggagacacagccaatcatatcagttagtgagacgcaaaggtctttgttccctagggggcctgggtccactgtgagaacccctccagggccagcgagctgtgcctgctgctaaagtgttaaaatactttaacacctgcacccctttgttcacctctggtgctccacaaggacctcagcaactaaaggattctgcctccaagaccctcagctcggagcccttgccaggtggtggttaagccctttgactgcctcccttgggcgtgatggcatcaaaagccatcacaggaggaagtccagaggcctggagctcatggagcgctgcggtgtttctccactcccccagagagagggttacccaggctagagagggcggggccctgggaggaaatctggggaaatacagcctcccaaaagtttcagcttctctattctgagcccccttgggattcctatttcccgttccacggactttgaagttgagaaggtgcctcaaataagcggtcaggagggtccccaccatgggtgagccacatggcatccatggggaaacagtatcctggggtcttagttgacatgattctgcggcaaaaaaacaaacaaacaaactggtcatctctggcttgtgggaatcacttctcggcctttcttggtgaagatcatgtatctggctggtggggtaacatcctatttctggcttataaggtgatcgtgtgagttacggaggcccatagacaaccccctcaacaccaaggggtcctctggcttcaaggcaacagtaattctagagccaagtgactctcattacaaaaggctgtccctccactgggctgagtccctccagctgtgtccagccctggccccactgccatccaagagcacccagcacccacctgtgcccccacccccggcaaggcccacacatgcctggtctggatcaacatgaaccagtagctggagaagacaatgacacagggtgggggtgagggccagatgagaagggaccaagcccgaacaagcattcctgggggctgggggtcaagggggtccctccggctagaacacaaattcttctcctgttctgacctaatttcaattcttcatagaaactttttttgaaggctgcattttccctaagaaatcaggaactacatgaccgggcatggtggctcatgcctgtaatcccagtactttgggaggccaaggcaggcagatcacaaggtcaggagatagagaccatcctggctagcacggtgaaaccccatctctactaaaaatacaaaaaattagccaggcatggtagtacacacctgtaatcccagctactcaggaggctgagacaggagaattgcttgaacctgggaggcggaggttgcagtgagccgagaccatgcccctgccgtccagcatgggtgacagagactctgtctcaaaaaaaaaaaaaaaagtggagtccccaggactgctgatcccctgtgagcatctgaacactggtgtcccatccttcctcaggccagaatctgctgacccagctgaaatgtccttcctgttcctctgtcatctgttgcaggaaggacattcaggggcccttctcttacagcttttgaagagggtgtttctgcccatcacaacagtgatccccactttctctgtcacacccacataccatactcagagcagcattaaacatctccaagacagctgacttctgcctggggttggctaaaaactgcccacaggtggccaggcgtggtggctcacacctgtaatcctcccactttaggaggccaacacgggaggatcacttgagctcaggagttcaagaccggcctgggcaacatggcaagaccctgtctctacaaaaatatttttttaattaaagaattgcccacaggtaaggcagaggaggcagggtagagatgctgaaatccggggagtgtcatatgagggggctgcggaagggaccatgggtgccctcctattcttcacccggacagcaagcaatgatggaaggttagaactgggacaagtgcgcagggagggcttctcgaggtgggtggaggttggcatgatggaaatcggaatggaaaaggccctcagaggtgatggcacccagagctcacatctccaacacctgcaggggcaggcgggtaacacccaggtgaagaggcccaggtggggcctttggtgaacacgaccccgcccagtgggcggctccactctgctcagtcgaatgttctcagcacagcagaaccgcagattatctttaagagacaccagaaagctgaactttctgagatttcacccccatctttagatatccgcaacaaacctaaactcttccaaacaccattgccttggtttgggctccctcagaagcagactctgagctggggaagtgaaggtggcttcgggggaggtgatgccaggaagatggagggaggaggactgagtgctacgagtgtgtgcagagcttctctgctccgtagatctcggggcttccgacacggtttgtgtaacaatcccccatccacccatgtgatgatttggtgagtgcctgtgtccccagccagacagtgagctgccccagggcagggacccctcggtttcttgttgcatctccagcaccctgtccagtacctcgcatgcaggaggcactcaagaaatacatgcaggagaaacagctcagacctcactcatccgagaagtcacctgagatccctccccaccaggcccagagagattaagtgatttattcaaggtcacacagcaagtctgcagagctgagcccagaacactggcttccccaacagagcttctccctgagctccgactcatgttgggacttagagtgacactagaggggccggcaggtaatgacaattaggccagcaagggggtatcggaccctcccctgagctctaagtgatgatgtgggcatgggttggggcaaaggctggtcagcgcaggagagggagcaggaggggcccaggccaggcccccaaggtcaaatctgggagactcagtttgccaaaaatcaattcccagccaaatggctaactcactgaaactcaaattgcaaaatgaccaattctccaagtttaccaaatttacccatttcccaaaatcttgctttaaggataatgtttcatgtattttataagcatttgtgaatatttccttctttgatatattcaatggatattttcttattaatatgaccaaatttctagtgttttaaggttaattttttagtttattccgacttgtttctaatcctttttttaaggacattttctgtttctaccaacattttagcatttttcgggggggagcatatagtgtttggggctattcccctcaattaaaaaatagcaaaattcactaacaggtttataagaatccttcaacaaagtgaacattccttaaaatgttgctgagaagaatgtgttcagtcactgaataggttcaaggatttcccttaataaggttcttagtaaatgggtggagcagccctttagagaccagctttcccagctggagctgcttgctgttcaggggctgcctgatgggggatggagatagtccaccctgagcaggggtgggggaacacaccctgtcccttccccattctgagcagtggagcagccagggaccacctctgcccaccagggcactgaggtcccctgcccgcccctctggcagagctgctcagagaacacagcctccctgtgcccaacatcaggggtccttccaccaggcccaaagggacctctcagaggtaagcctggggaaaaagagctgcctgagacgcacatgggtggtcgtggctataagtgactttgagccctagaggtgcctcgtctcatcctgcagaagaagaagctgaggaggcgcttgtgtcccggccctcagccttcttacctcgcctcctctcaaagccatcctgcatgtgactccccacttacagatgaggaaactgaggctcccaggggctgcacgagtcccgcagggacccagaccacagggctcttggagagcatcaatgcccctacacaaatgaccttcacaatgagctccatgaagttgatgctgtaattccctcccacttaacaacggagggaactgaggctcagagagtcagagaaacgtgcccagggcagcagaaccgggatccaacaggggttcatctgacttcaaagtctgtacccttagccccaaccacccacctcccgagaactccagaccccagaacagggctgttgcctctgatgcctgctgtctgtgaaccgcagagggtggaaaccagggcctgcccaagggcacccaaataccagggaggcaaaatgcagcagagaccagagggtagaggaaaccagcgaaggaaccacagaggaacccccaggagagtttgccagctctgaatctgcccctggagctgccctgcctgcccagccctccttccttcccactgtgggctgaacctgagaagaggtggacaggggtcaggggaatgggcgggtcttagagatgcccttcatttctttaactcccacctttaaaagattcccatctgtaaacagcagagcaggagggaccaaggcagagacaatcatacggaacctcctggctgcatgaccatgggcaagctgctgaccctctctgagcctatcgttcatatctggaaaatggggataaagaaaattctggccaggcatggtggctcatgcctgtaatcccagcagtttgggaggcagaggcaggtggatcacgaggtcaggagtttgagaccagcctggccaagagaccagcctggccaatatggtgaaaccccatctctactaaaaatacaaaaaatgagccgggcatggtggtgtgcacctgtagtcccagctactcgggaggctgaggcaggagaattgcttgaacccaggaggtggaggttgcagcgagctaatatcacgccactgcactccagcctgggcaacagagcgagactctgtctcaaaataataataataataataattctccctaggagctggaagtcagggctctccttacaaacatgaggaagtgttaggaccactgtcttcagccagccctgctcaggcacttaacagaactcaaccctaatcccacacagagagaccctgcgctgcacaaaaggaggcagcaggggccggcagcagtgtgcctcatcaaaccctgcttccagccccaccctgcagacccctttcctagattcagcccctggtgtccctagtagggaggggaggcccagacgcactccagtgaggaccacaggggccactacagggcctgcaaggcctgggctgctccaaaaatgatgctgcaaatcctggccaggtggacccgtctgctcagagtgcacccagcgtgggcagggcccacctgtgctctgaatatcagagaggagcagagtcaggacccagcctgagccttgaaccagccccagcagctgtctcctaactggcctgtgagaagcaaaggaaaagaaggcaaatgagctcattggcttactcgccgagttacctcccggcttccttatgctcttgtgcaggccacacatgacacaactgcagggtgcaccacttgtacagtagtttacatgaacaatgccacctggagttgggcagtgcacaacctacacaatcttacatggctgccctgatgacccactcattcattcaccatcactcagtcagtcagtaacctcactgactgctctgtgcctggcccggtgctgggcaatgctgagacaaaaagatgagttagactcagccccggaaccctccaggagctcccattctggtggaaaacaataggtgcaggagcagacagatcccagcagcatggtcgggtctggcagaggtttgggcattgtgggtggcaatgcgtgagaggctctagctggtgaggggcccacttcagggcgacccaggcaggacaaaccccgacacagaaatgttagagggcccttgacacataggctctcaggaagagtcccagagtctgatctgttccttccctcacaagctttcctgagattccccctccccctcctttctctccccttgtccaggggtccctaactctgccctcttcatccaggggaaagtgtatccttaggacacacacggcccctctaaggtgtagtgggagcagcctcaggcagagctggtattttgggcatcaaggacaaggatggtggggaacgtgctctgcttctacccacaggattacctgctgctggccattctgggcaagtagtggcttctgaccaagagccagtccaccccccgccatgagttttccagcccctgatggcctgcaaagggccacagtgttccaaaacctcagctgcaatacagagggttcttgcctgagcaagagtcagttctgagtatgctaaggggttctgtgaggaggggagactgtcttgaaatatttaaatgcgggctttttccccctgatatttcttggcttcccgtggcccctgagaaaggaattctgaattctatattcagtgtctccaggaagggagagttcctcagaaaatggtgaagaggtgtttgagtttcaaaagtcccagccctgacaggatagggtgtggaggggacacaaggaaccatgcacaccggaaagcctcgctgatggagagggaggaaggaagcaggaaagatgaggggcttgggggtctctaagaaagcgggaaccacagaagcccagagacgcttgggagaccctgagtgcggaggaaaggagctgagggaggcggcaagacccccaggctgggagctgggtccaagtgggtggtcatgagacaaccacaccccagagtccccaggcccacaaggcatggcgcacgctcaagaacagtgccatcgtggacgcgggcccaggacacacacatgccccgccccagctcccctcgcccacgtggccctggcagggcagggcagtgaacagaaaaagatcccgccccagagtcaaaacgtgcacggtaggtgttcgccggggcagagagaaggcaaagcacagagcgccccacccacaggcacctgtcgctgtccacagcaggtaggcctggccccaggaaaaggcagatgaggagaaacttcacactgattatgataaaatccctgggagcagcaggatggaggctcgtggcagcctctgtcttgggagtgagcaagcattcagctccctggtagccctggctggcctcagaaaaccagagtttcccgggggcccttcaccaccacacagcccaaaccatggaggctttcatgggtctggggcaggatcgctgtcccgcagcagaaggttggggttcagagcgagcctcgctgtgggttctttacgtggctccctgatctgtttcatttatgaaccacaagcccaaccttgaagggaaaaaagaccccagtgggcagccccagaggtcttgacctagagggcaggaccaccctgcacatgaacttgcaaagtctcccagcccttggtgtgcatatatgacacgactaagattgggtggaggctggaagacaagctgaaccctcaccccaagcccagagatttcccacccatgtgtcagctcggtgcccagcacatggtagatacttggtacaaaatgcttgaatggagaattccttgggaccttgaagaagccgggcaggccttggcctcctcagccaggatggcctgtccaggcaccggcaagcctttcccacccaccacgaaagcccctcgatcccctcccaagatttccacagatgcatcttccacggtgcatctcactttgcagtttgcaggctcatgcacccatcttcccatcagatcttcagataacactggctggtgccagacagggagtgtgattattcctatttgtaaggtggtgaggaccacagatggataggagggtgggtagatggaaggatgggtagatggatggtggatggatggatggacgaatgaatgtaaggatagataggtggatggtggatggatgaatggatgggaggatgggtagatggatgatggatggatggatggatggatggatggatggatggatgggaatgtaggaagatggatgacggatggatagatggatggataggagggtgggtagatggatggtggatggatgaatggatgggaggatggttagatggactgtggatggatgaatggatgggaggattgggtagatggatggtggatggatggataggaaggtacgaagatggatggtggatggatagatggatggatggataggagggtgggcagatggatggtggatgaacgaattcatcatcactaatctagccccactcccagctgagacacacagtcgctggaaccaagaagagaggcaggggtcaaggatttcagattccccatgttcatacaaatatttttcagaataaataactcttacctatttattagagcaaagagctcttctaagtgataccttaaaacaaacaaaacctagtttgaaatgttacatggaatcaaactgcttttttatccaaagtaaattcataattcagacatttcactaattgacatcttcctccacaagatatccaagtgcttgaggtcaacaagagcaagccaaatctcagatggatcaagaatctcgaacatattcacattatttgaaatgcatatgattaattcccacttctgggaatttcctaaagaaataatcagagatggctgggcgcggtggctcatgcctgtaatcccagcactttgggaggccaaagtgggcagatcacctgaggtcaggagttcgagaccagcctaacatggtgaaaccccatctctactaaaaatacaaaaaaaattagcctggtgtagtggtgggcgcctgtaatcccagctacttgggaggctgaggcagaagaattgcttgaacccaggaggcagaggttgcagtgagccgagatcatgccattgcactccagcctgggcaacagagcaagactctgtctcaaaagaaaaaaaaaaaagaaaaagaaaaaaaaataatcagagatgcagacaaagatggttaccatagcactggttttatggtgaaaatttgagaacaatctaaatgtccaacaatacaagatttatttttatgataaattcctaataaaaaatttgtacaggcattaaaataatgttttaaaagagcattcataagaaaatacaagaagactaggatacaaacctatttagagatgatctgaaaattaaatgtacatatataaaataaatgagctgggcacagtggctcacacctgtaatcccaacactatgggaggccaaggcaagcagattggttgagctcatgagttcgagaccagcttgggcagcatgatgaaacctcatcactacaaaaaataccaaaaaaattagccaggcatggcggttcatgcctgtagtcccagctactcgagtggctgcgatggaagggtggcttgagcctaggaggcagaggttgcagtgagctgggatggcaccactgcactccagcccaggcaatagagccaggccttgtctcaataaataaataaactcaaaatgtaggctgtgattgtcagacagcttgagtggtaggatcgcaggttacttttattttattcttaatactgtttccaaaacttttatggtgaacatggttgacttttatgattgggggaaaatgttctcattcattcaataattgtagggataggtatcgacactttgtgccacatgagcaaaacacagcaagaatggtttctgccctcacaaaacttgtgatggagacgttaaataacccagccaataaaaagacaaaggactacaaattccaatgagagccaagaaggaaaactacagggtgccaggagagagaagaatggcagcgtggccaggcacagtggctcatgcctgtaatcccagaactctgggaggttgaggaaggcaatcacttgaggccaggagttcaagaccagcctggccaacatgatgaaaccccatctctactaaaaatacaaaaattagccaggcgtggtggcacttgcctgtggtcccagctactagggaggctgaggcaggagaatcgcttgaacacaaaggcggaggctgcagtgagccaagatcgtgccactgcgctccaggctgggtgacagagtgaggctctgtttcaaaataaaaacaatggctagggtagcctactttagaagaggtgaccggggaaggcctcttgaaggagaagctgttcgagctgagacctgcagtgtgagtgagccaggtaaaatgtggaggaaagggttctgggcagtgggaacagaatgtgcaaaggtcctggggtggaaataaggtgggtctatctgagaaactaacagaaagccagtgcagacagtgaaataagcaagaaatggtaggaaatgaggttggagaggcaggcagaggtccaactgcacagggcctcaagggctaggccaaaaatatgggcaccattctgtgcggaatggtgattcactattttaagcaggagagtgatgtgatctgaatatgtcagactttttttttttcttaagagaaggggtctcactatgttgcccaggctggtctggagctcctgggctcaagcaatcctcctgcctcagtttcctaatgtcatgcacttttagaagaaaagagattgagccagagctacaaagctacagactcccagagctttgggggaaatccagtgctgttttattgtgagacatcagggatcaaccctgagatgttcaaaccaactaccctgagggagctcatatctctgcccagtgttgttctgaagagcggtggagacaggagaaaggaaggctgaaggtggagggaactccctgcctcacatcagctatcactttaggcactcagagccactgtcttctctgattcccataagccccatcaaagagaagcagacagggacttgttagcctatttgacagacagagaaactgaggctcagaggagctggccccattcattcgtgcattccttcattcatgcatttactgcacgctaggtggagacagggatgtgcaagacgagtgagacacgccccagccctcaggcatctcatggactatcggatcaagaagacaaggggcatatcctgggaaaaggctttgctccagacatgtctgcctttgaatctcagtcctgccacttctgcagagaagtaacttctctgaaccgcagtttcttcacgtctaaatggggaaagtggtgatgctgctgaggaggaggacgggggaggaagaggaggaggagcgaggaggaagataggttgttgtaagagtggaaagcatttgctgagtgctcagtagtgggattttggaggttgtgggcaactccttctgacccaagttttagtgtgatttccatgacacaccctgtctctccatcctgggcagcgttagttctcccttatgtgaaacccaagctggctgagcccacaggcaaatgcagccatagtgacactggagctattcagagccaacctgttgcccttctataaaaagatgcccactggcatcctgaacacacgaaacaatgtgtacccagtgggtgcaaagaggcagggggtgctcagaggagaagcagcagaaccagagtgcccataagccacacgtcctctgggaaggaagggaaagccctcttgggacagacacactcaattttgacttacaaagcagaaaccacaggcctaaccctgagtattgacatctgtgagcaagtggattgaaaagaaacagccaaaactgaaacatctgcaaacacgtcttaaatacagtacttcgctttgaaacctcttacacatttgtgacaaggtttgttcacatatctactttgggagcatgtgcccagaaaactttatacccccattgaaaatgaaacttcaggccaggcacgacggctcatgcctgtaatcccggcactttggaaggccgaggagggtggatcacctgaggtcaggaattcgagaccagcctgggaaatatagtgaaaccttgtctctacaaaaaatacaaaaattagccgggcttggtggcctatagtcccagctacttggggggatgaggtgggaggatcacgtgagcccaggaggcagaggttgcagtgagccaagatcatgccactgcacttcagcctgggtgacagagtgagaccctgtctcaaaaaagaagaaacttcagagtgaggttaaaatgtctctataccggctttctgtctagtaaaatcattctaaatgatccatttttgggaggagataaagaaacataaccccccaaaatccatattttactgtttcaaacaaggtgtaaatagttgtgaaaatctagattctgtagataggagaatggcataaaatcaaagacctgagcgtggctgatgcaatagtagataatgatgatgatagtagattatggagactcacatatcctaggcagggtgacatatttcatcttgtttaatcctcacagcaaccctatgataggcatgatttcatccccactttatagatgaggaaactaaggaacaaaaatattagataatatcccaaggccacacagccaggaggcagcagaaccaagattcatatcaaggcctgtctggccccaaactctgtgaccagaaactctgccttttcctaaaccattggttcttcaccgtttatacatcacaaggcccatcaagaatctcattaaagcaacgtggggatatcattgagcccaggagtttgaaaccagcctgggcaacatagtgagatcccatctctaccaaaaacataggaaaaagctagctgggcatgataacatgaacctatagtctcagttaaggtgggaggatggcttgagcccaaaaggtcaaggctgcagtgagctgtgatggcaccactacattccagcctgggcaacaaagtgagaccctgtctcaaaaaaaaaaaaaaagaatctcattaaacgtatctctgagaagtgaacattaacaccaaattttatatgcaacttcagagggtccagggacacaaactgcctgcagtagccccccgtgacctcgtgtgactggcagagatctgacactgattacgccagaggactgagccaaggaaggcaggccatggcctccgagttccaggggcctagacagacacagacaagcacataaaaagataaaagcataaacatgtatgcagacatgtgtgcgtcactaaagaatccttaagtttctgtccctgggacatcctcggctcaacctggcctattgtgatctcctcacacagaggctattaagagttggcagactgcattatcactggtcattgtgatctcagccaagacttggccagccttgaaaaggacttcccttcaaagagtctgcaggtcaaatcgcttagggctcagggacaaactggccgttgttcccagctgataagccaccctatgtcacgtaatccaccatggggaccctggattagcagaagtcaatggctgccccacctcctaaagttgaagaggagagagacaaagaagcaggaagccccgaggcccatcagaggctgcctcccggatgtgccccttccccttcatgacctctgcggttgggttcattgtttgggttcagagaatcattcgaggcaccaaactcaagggccacacccaccaatgggtggcacaaatttcatctcaaagatgattcaatttccctcaaatgtccaagaaaaataagacccaggacagttgagtttcgtctcctacttatcatcatgaataaaactctaagttctgccctctgacatttgatgcaaaggtctacgtatctaatacaaaggtctatgcactgtctgttcagcaatgtccaaagtggggcctttgacaaatgaaaccgtagttgaggttcatggcatgagaacctcagtggagctggagaggtcctgcagcctagggaaggccaggcagcagacatgctgagcctgcttgaaggcaggaccccagtccaatgcctagcctgcaggtccctgaagcgggcattcaccaccccctgaggcaaaatcagcttcctcacctggactcttgctttgtaaggctgtggttacaccaaacagcatgataggacgcacaaaacaaaatcacaaatcttcaagtgataggaacctagatgatgactgggccttctcctgctgtacagggaaagcctcaggcccaaagaataggttctagaatttggggagccattcaatgagataacaggtaagaaggagccctgtccaaagactagatttttttttttttttttgagacagggtcttgccctcttacccaggctggagtgcagtggtgtgattaaggttcactgcagcctcgacctcctgggctcaaatgatcctccaaactcagcctcccgagtagctgggaccacaggcacatgccaccacgcctagataatttttgtatttttgtggagacagggtttcgccatgctgcccaggctggtcttgtactcgtgagctcaagcaatctacctgccttggcctcccaaagtgttggggttacaggcatgagccattgctcccagctgaatttcttaaatataaatgagaacctcagcagcctagtgacaccattcaagtctcattccaggggcaaccaggggaagcaaagtgggctgagccagttatgtaactcccaagcttaaacccctccaccttccaatcaccctgaaaacaaaaatccaaagtctaccacagtgtatccctcaggatgcatctggtcacaggcaacagaaaacaggcccttattgatgatttcacctggaaggtgttcagagcagggcagctccttgcctggtaacatctgcggatcaacatcttccttcccatttctctactgtctccttcatcttcagccaagctctcacccctagagctactcaagctcatgcccattcaggttttttatactttccaaccaccctgcatccattactcactccccaggtctttgcatggttcgatccatcatcatgtcacccacgtctgggataaaatgtcactcagcacagaggtgtgggtccaaaggaatctcaccccctcttctccatcatctttgtttctctttcttcacacatgtatcattatcaagaattgtcaggctgagtgctgtggctcacatctgtaatcccagcactttgggagtccaaggcaggtggattccttgagtccaggaatttgagaccagcctgggcaacatggcgaaaccctgtctccactaaaaatagaaaaattagctgggcgtggtaccacgcgcctttagtcccagctacttgggaggtgagaggattgcttgaacccaggaggcaaaagttgcagtgagccaagatcataccactgcactccagcctgggagacagagcgagactctgtctcaaaaaaaaaaaaaaaaatagaattgtcctgttatcagtgtcccccactaaggggtgaactgcatgagggaggacacagtatggcatgtcccctgcctgatccctaccacccaccacagtacctggcagggagaaagtgcaggggctctttgctgaaagaatgcatgtgttgcacacatgctggaaccctgacaacttcccacttcatttccagaaaggaaaagtcggtactggaaggtcattttatgtccagtaggacaatccaagcccaaatcctagaccagctccagacttctgggtgtcttggggcatgtgacccctgctctggaactctgtcctcacctacaaaatgagggtgcagaatggactagactagtggttctccaatctgggccgcctgcagagaggccttctaaaacaaattcctgcacctccacccttacttattaaagcaggatccagaagttggggaagagaggaaccaagaattaaaacctgtaacatacgcaccaaggtgataatgatgtctattgggaccttcaggttcttctgaactcagaggtactggaataaagggcaggcccaggcccatggctgccacatggactctccagagaaccttccagatgctctgcccaagcccagctcgtgcagctcccggaaccagcttcctttccctccgagcctgatccatgctcattcactcatccctgggatgagctaggagtgtcagtctctcccagctgaccatcagcagccttagggctggaaccctgtctgtgatatgcaatgttctactgctgtccagaaacactgcctggcacaatatgtgtctgtgggaatgaaggaatgaacaagagcacgcaggcccattactgtggggctttttggagcctgcaatgaattaagatgctcagagaggccgggcacggtggctcacccctgtaatcccagcactttgggaggcagaggcgggcggatttcttgaggccaggagctcaagacctgcctggctgacatggcaaaaccccatctcttctaaaaatacaaaaattagccaggcatggtcgtgcacacctgtagtcccaactgctcaggaggctgaggcaggagaatcactggaacccaggagatggaagctgcagtgagctgagatagcaccactgcactccagcctgggtgacagaatgagacactgtctcaaaaaaaaaaaaaaaaaaaaagtcactcagaggatctccagacaaggagaggcccacctccaccctgtgcagtcaggcccagagcctggaccatgaaacagaggttgggacacatttgccatagggaacagggactgccccatacagtcagtactctatgaatgcacaagaatgtcatgtatcttgggggctgattgaatccaatagacaggggccatctactctacttacttcaggcacgtttgaactgaattaactacctagacgcattcataaggttttttcctttccgtcaactctttttttttttttttgagacagagtcttgctctgtcacccaggctggagtgcagtggtgcaatctcggctcactgcaagctccgcctcctgggttcaagtgattctcctgcctccacctcctgagtagctgggattataggcatgtgtcaccatgcctggctaattttttgtatttttggtagagatggggtttcaccatgttagccaggatggtctcaatctcctgacctcatgatctgcccaccttggcctcccaaagtgctaggattacaggcatgagccaccgcatctgaccctttctgtcaacttctatactaaattatttatctgcttcttctaatcttcccagcaaccttctcccaggagaggtgaatgccccaaactcacctcagggccgcccactcactacagagcctgtgaacacttttctgtctacctgggatgtttctctgcaggatgatcatagatcacctcagtgacacccgctcatccttcagacagcagctctcacatcacctcctaagggaagccctcccagatttctcctgttccctcacagaactgggctcctttccctcagaacataccctttcttcactagtccctcaataagtagtggcgtacactgaattacttcattcacatctgtcccacgcataaaactggaagagccccaccaccagagacagggttgggtctttcccacctgccagagcctggcacatttgtaaccagagaagtgcatgatggtaatggaagccaaggaccacacaaccggcaagcggcctacccaggatctgagcccagaactttctgactccaggccaggcgtggtggctcacgcctgtaatcccagcactttgggaggtggatcacctgaggtcaggagattgagaccagcctggccaacatggcgaaaccccatctctactaaaaatacaaaaattagccgggcgtggtggcgcaaacctataatcccagctacttgggaagctgagacacaagaatcacttgaaccccagaggcagaggttgcagtgaaccaagatttcgccgctgaactccagcctgagaagcaagagtgaaactccatctcaaaaaaacaaaaaaaactttctgactccagtgcccagagtcagtggctcagcagctcatggactcagtgctgagtgccgtccatgcccagagcacagcacgggcaccagagagggctcccctagggctgctacctgccagcctctcaggtccctctgctctgtcactctctagtgccccaatggctcctaacggcttaaaatggagaattaaaatcaggagatgtcaatgggctggttcatgttcttgactttgccccacaaaagaatctgagagctagtccaaagtaaaagtaaacaaaagggtttattacaaagcaggctgggcccggtggcttacgcctgtaatctcagcactttgggaggccaaggtgggtaggtcacctgaggtcaggagttcgagaccagcctggccaacatggcaaaaccctgtttctactaaaaatacaaagattagccggtgtggtggtgcacacctgtaattccagctgctaaggaggctgaggcagaagaatcgcttgaacctgggaggcggaggttgcagtgagccaagatcacaccattgcactccagcctggtgacagaataaatttccgtctcaaaaaaaaaaaaagagtttattacaaagcaaaacaaccctctgacagctcatcaaaagtgagacagctccgtgtgatgggagggatcttcctttatgggagatttgcatgattattcatcaaggggcaagaaagaggggctgctacgaaacacgttgggggtgctttatgaggcctgcatattcagtggctgtacgcgctattacatacatcgcatgtctcattaaaatcttaaatctctacccatgggtatagctaaactaaagtttttttttagcatcaaaaagagcctaggtcagtttgaggtcattagttccaggtttccgcacctgtgcaggcctggggattttttttccctcagttcttcctcctctttgctacaggatgtctttaaccacaagcccccgatgcggttcatggaataccaagtggcttgttcttgccataaatttgataagtgtttttttaaagagaggctctactatctaacctacctcagagagacagacacctggcctgcccgcccccttcacaagaagctccaagcactccgaacatctttcaggaagacactggcaatgttgcagcaatgagaaggggatgatttggaaggcagcctgaatcacgctgcccttatcagcatgcttggattgtgtcccttcttgtctgacttttcagacagacattgggctataaaattgggatgcagctctgtcatcaacagtctggcggcaggagcagaaggaaaggcagcttccgaaaacttggacccatccaccccaggcaaggtaagaacttgctgcgtcgaacgggtgaaagagaaggtccagctctcaggtagcaacaagcaacgcacagtccatctaaggacccataacgagggtttatgcattttttgatcgctttagcaatgtccctcccctgctgaaatgcactctgcctagcacagggaaggtggttgacaattgcctgttatgcattggttttcagagaatggatttagtcctgggattctcaaaaggtttcactcaagtcaaagtctgacaatattgccatcaactcagtcacaggcatagattttttttttctgcgaaagtatgcttagatgtcatgtgagatactgaggttgaatttcccgcagatgagagtaaaattttaaaaactaatgaagctgtgttgagatttttttcataaggcctaattaattcaaactgaagaattctcactggcttcattcagattgtacccttcctcacattcctgccatagttgctcttcttttttagggatagagtctcgatctgttgcccaggctggagtgcagtggtgtgaacttgtctcactgcagcctcaacttcctgggctcaaccgatcctcccacctcagcctcccaagtagctgagattacaggtgtgaaccaccacgcccagctaatttttttttttttttttttttgtagagacggggtctcacccttttacccaggccgggatagacacttttttagggtgttggcaaatggcaaatggcttgcttttgttaatgcctatacatggcaagggcaaagattcacaacccagcctggcgcagtggttcacacctgtaatcccagcactttgggaggccgaggcaagtggatcacctgaggtcaagagtcagagaccagcctgaccaacatagtgaaacctcttctctactaaaaatacaaaaattagctgggtgtggtggtgtgcacctgtaatcccagctactcaggaggctgaggcacgagagtcacttgagcctgggaagtagaggctgcagtaagccaagattgccccactgcactccagcctgggtgacagagcaagaccttgtgggggggggggggggggggaaaggcccccaacccaattttacaaaacaagctcaccttgcctcaccaaggtaaaatgccaggggacacaaacctccacctcaccctaaacattagagggaaaaacttgggaatcacacttttggaggaaagtgagggtcagtggtggggatcaatctctgaaagtcacccagcacagctcacactcaaacaggggtgtcctgactgggtgtggaaccagctctctgcctcctgagtctcagaatcctcagtgtgagcagacatatgcacacaccccagtgacaagagatagacctgagagtgcagctgcaggattcagaactctccagttccccagttagtgactcagatggctccagggatgtgacagaggaaggtggcatgagaatatgtgacctgaaggtaacaccagtgagcagggcttggcctgtacttaaacgcaatgaccagcctggagagtaggtctatgcacagttgaaaagaagtagggaggtcaaggcgggtggctcacgaggccaggagttcgagaccagcctggccaacatggcaaaaccctgtctctactaaaaatacaaaaattagctaggcgtggtggcaggcacctgtaatcccagctactcaggaggctgaggcagaagaatcgcttgaacccgggaggcggaggttgcagtgagccaagatcatgccattgcactccagcctgggtgacaggagcaagactccgtctcgaaaaagaaaagaaaagaaaataagtaggaaaaagccctttcttcaagacactgactgctacatactgcaacattttcccatgactgcagcatacagactagaatatctacgatgggaatggcaccctcccgcaagggccaggaccctggtatgtggacgtcctacacaaacgtacattgtggcctgatggtccctggggaatgtggtgtctgaagaagccctcttttgcaggtatcagccaccacgatgctgactctctgggccctggctgtcatgttggcggtcgaggaagcacttggccagctggagctcgcagataggccttccctaatacccactttgcctgtccgttttccacctggattgctccctggaagtctgtcagtctcaaaagtccctctaaccggaaaatacccagcgaggaccaaaggaggcaggtgtccacccgtcaccaagtacttcatatctgacagcaaactcgaagactgtaagtaagggctacacacccttggtcctttcagcccctcacgcaggcttctcattcctaagctcagcggggggttctgtcttctgaacatgtgggtcccgaacatgagggggtgttggactcaccttagaagcttgtgatagaacagttgcccaggcccccctagccattctggtccggcactactgcagtgggcctgagagtctggcttcctcatctgctccaagatggcactgaggctgcttgtccagggtccacacgtaggttaggggtggtctacacaaccctggaggagggaactctcccacccggcagactgattacctcccacctcacctggagactgtgcggagagactgcccatcccctccctgctgggccccagggctcacccagactcccacaggtgctgaaacctcaatccgctttaacaggagccaggaaatgggaaatctgggccccgccatcatccccttgaccagacttgttctctccaaactccttttgttcactcactccctgagtctcacctcctgcattagacaatgaggaattctttcctccaagaaccccgcagagggtgagggcagagcaactcaggaatttaaggctgggcaaagaagtgactcccactgaggagccagaaggagcagggatttattagcaaatgaaggccagcaggaaggctctcagtgctctgacgccagcctcgcagtcatggcccacctcagccatccaggatgagaggacagggccacacagggagacctggcacatgctgcatgaccaaagggccagccccacaactacaatgcggactgctttgactcgggaagaacatgtgctttgctcttccagcagccttccttggtacaaaatacttcaaatatatagaaaaaagaccagacatggtttaaaaaaaaaaaaaaaagacagctttgtacccatcacacagtgatttggaggtaatggtggttaattttggttgctttgttttgtttttgtttgtgtttgtgttgagacagggtcttgctctgttgcctaggctgcagtccagtggcacgaggccccttcactccatgcccaaatccctttagatgtactcaacagcaggctgatctcatagtagttactaataaatggtagctcttaataagggcacaggcaaatttctctgacaccaggctgtccttggagtaggcagtagcaagcactgttttttccaggaggcaccatatacagttcctatggacccctcaattcaaatgtgccagctgcctggcaggaaagcttcttcttgctgaaccaactgggaaggccacagcaagaatgtgtctcttgacccttttcagatatgaatgccaccttgcccctgcagattgagaagattctgaagtgtgagaaggttaacttggctggtttgcttgggaccgtattatccacagtgagcgacttggacctgctgtctctattagacctcacttcaccccttgatatacttggaggtgccagcctcagtggtatcctaggtgagggaagtggcggcaagtcctcgaaacttccattgctctcagaactcactggtgctgtcagtggtctgctaccccaggggacggagggtctggtgagcctactacccactggttcagacaagaaccctgtaaaaggactcctcggtggcactggtctctccactctccagcggcctctgaaggatgtgaccgacaaagtccaagacctcaaagagtctgctcagggcgtgctgaacagcaccctgccctcaggcatcagcgatgcactcccagacctgctgaaaaatgctgacctggaacagctcttgctggggtaagtgcttccttgaccctatgtatgacttctccaccagaaacctgctgatttggatgctcatgttcaacttccaacagtcccacggattgggatgggtatattgcttgagattgatatatttcaccagaaatattctcgctctatgctgtgcctatatcctttcagggggaaacaggatcaagatttttgagcttataggcctgggcacattagacagctgaggggtcaagggactggatggtggcttggtaggctgttaattatctgcttcaaaggcatttctcctgctgtccaggctgattcgttgaaacaggactgactcttgatgctttcgctttgcagattacaggttgaaaaagtaactgtggagagcatgaagtcaaccacgacaggcgatgggatccatgtccaagccacgactacggccttcataggtggaaaagggtgagtctgtgcacacagcagtccactgggtccccctgccccagggttgtaacatccagtgagcaaagaccaggtagagacaacagagaggacagcagcatgggtgaggatggggcaaagcgggcactgcacacagctgcccctctccccaagtacaggtgggcaaggcaagagaatggtccagggagcctcatcctccaataatgtgaacaaaaatgttgacgggctgggtgtggtggctcacgcctgtaatcccagcacttggggaggcctaggcgggcggattacgaggtcaggagatcgagcccatcctggataacacagtgaaaccccgtctctactaaaaatacaaaaaaatagctgggcgtggtggcgggcgcctgtagtcccagctactcgggaggctgaggcaggagaatggcgtgaacctgggaggcggaggttgcagtgagccgagatcacgccactgcactccagtctcggtgacagagcgagactccatctcaaaaaaaaaaaaaaaaagaaaatgacaggacccactcaccccacccaccccactaagccactagggaaggcaaaactaggtcatgaaaagtgctgaaagaggcaaggttttagactcagttagtttcacttacaggaatctgtccaaaaaacctaagtacagatacatttaaacacaaagacataggggtattcatgatgggaatttaaaaaacaaaaaacctgaaacaaaaagcaaataattaaaccaagtacaagattagaaatgctgacaacatttataatggtatacagaaatgcttgtgaagttgttttttttttgttttgtttttgagacaaggtctcactctgtcaccggggctggagtgcagaggcacaatcacagctcactgcagcctggatctcctaggttcaggtgatcctcccacctcagcctctcaagtagttgggaccacaggtgtgtgccaaggtgctcagctaacttctttttttttttttaattttttgtggagaccaggtcttgctatgttgctcaggctgctctcaaactcctgggctcaagcaatcctcctgcctgggcctcccaaagtgctgggattacaggtgtgagccaccacgcccagctattgttagttttattttattttattttgagatggagtctcattctgtcgcccaggctggagtgcagtggcgtgatcttggctcactgcaacctctgcctcctggattcaaatgatttttctgcctcagcctcccgagtagctgggactacaggtgcacaccaccacacctggctaatttctctgttgttgtagtaaagatggggtttctccatgttcatcaggctggtctcaaactcctgacctcaaatgatctgcatgcctcggcctcccaaagtgctgggattacacgtgtgcaccaccatgcccagctattgttggtttttaaactaacaatagcaaagtttactttgctgaaacttctaactttcctgctctgtggagtttgcatttcataagcagggggaaatgcatattaaccaatgaaggtcagaatatccatgaaaggaaattacagacaagatgggctttggaatgtgggaaggaatgagggcctgccaggctgacagcgcatgtacaggaaggtaaggaatgtgactgttggccaggcgaggtggctcacacctagaatcccagcactttgggaggccaaggtgagtgggtcgcttgaatccaggagttggaaaccagcctgagcaacatgacaaaatcctgtccctacaaaaaatccaaaaatcagccaggcatggtggcatgtgcctgtagtcctagctgctagggaggctgaggtggaaggatcacttggataggaggaggcagaggttgcagtgagccgagattgcaccgctgcactccagcctggcaacagagtgagactctgtctcaaaaaaaaaaaaaagtgacacagatacacacacacacacacacacacacaccttactggtagaaacacttaaacaagggccattcacctgaaaaataatgaatgtggcttctcctggaaagtcagagatctgggtgccctgagcctaactgcatggggtccacgggcagccggagctcagcagcagctcctccttcaccaggtgcctgccctcagggcactgcaaaccccaccatgcccacggtcccgcaccacagtggagttggggaggtcaacagccacgtgtcctcaggctcctcccacagcaataccttcaggaccacctcaccctccacctccccagtcagacctccaaaggcattgaaatgggtgtcggtctcatgtgattaccgagatgttttttctgctttttcactctaggctaaagcccactttaacaaaaataccgtcactgtgcctggaagttctctctcttcagacactaaaaatgtcagcgtttccctaattctgtcctacgcgatgctgaaggtcatcatcactcacactgccaagcagagctctgtgcaggtaagggtcgtccacagggcccggcgtggctcagcactttcctcaagctcagccggtcagcctctgacagcaagaaggtgggggtgaaagtggattctgaatgttctttcaggttaatacacgactgccatgggatgcaccttttcccttcattgtcatgtaaatgggtcctggtttatgttggtggaaagcagagaacagggacttggggagaaaaatgtggtctgaagccgggtgaggtggctcatgccagtaatccccacactttgggaggccgaggcaggcaaattgcttgagtccaggagttcaagaccagcgtggacaacatgttgtcaccttatctcagcaaaaaattagccaggcgtagtggtgcatgcctgtaagtcccagctacttgggaggctgaggcaggaggatcaccagagccagggaggttgaggctgcagtgagctgtgattgcatcactatattgcagcctgggtgacagagtgagactttgtctcagaaaaaaaaaagtgggggaggaggggttctaagtgccatctgtgtgctaggggcaaaaccaggtgtctttacataaccaacatcatttcatcctcaaaacagcactaggatgtagggtttcttatccccgttttacagatgacgagagtgagggaaggaagcaccaacagtcacagaatgagcaaaaaacataaggcagttgttcatttgctaccggccctagaagtggcagagggaatagtagcaatagtaacaatcataattgacttttctctatgtgccaggctctctttgaaacaaaatataattttttttaagagtgtgtcccaaagtgatcaaatgatcaagtgcagaactctcttcccacaaaggcatacagagagacaggcttcagattggacaaggtgtaatagaaaagtaagattttacatgttgcatgcccccaccatccttcaaagaaaggaaacattatcaaggtgaatgtttagaaataggccttgtctgtcatggtcacaccagctgcaccagcacccaggtgaccaacttacaccagacgataaatatttgtatgtatgatctgaatgatgcgagagtgtttcatactgcaacatcctgcagcccttactcaacacactctaaatgactacttctttccaacagagaaataacctggatgcaagaatcaccaaactaacctactcccaccggccagacataaaatctaagccagctactgggttaacatcaccaaggacggtgggagctttgtcaccgggcaaacggtgagtgctgagaaatgaatcagagcagagttgagaggaagaattgcaaggagcagtgtttagtgggtttagttactccctaaactctgaggctcagagtgtctgggtgtccctaggatgagggagtccagccaggctggtgggctcagcccccaaagggagaatggagtgagcaggttggcttaggaggataaggccaggcagacaaccctctgacctgggaccctgttggccatcgcgcactgtgacatgtttgctgagtagccaggccaaggtgttattgttaactcatgttcattttgtattaattcaggaattaatcatctcattcgtgagcaagatttcgaaagacaaactgatcacagacatcaaacttctgaggtactgtctgtaactacataatctgcctgtctatataagagatatctaaggtctgataaaaatcgcataaccggctgggtgcagtggctcacgcctgtaatcccagcactttgggaggccgaggtgggtggatcacaaggtcaggagttcgagaccatcctggccaacttggtgaaaccctgtctctactaaaaatacaaaaattagctgggtatgatggcaggtgcctataatcccaggaggctgaggcaggagaattacttgaacccgggaggcagagtttgcagtgagctgagatcatgccactgcactccagctctgggcaacagagcaagactctgtctctaaggaaaaaaaaaaaaaactacataagcaaaataatcacaaggttcttgggaagtatctgcaaaattacagagaaatcaggatggagttttgaactcacatgctgttgttcatcttacattgactctttctgctcagtagtttccaatttataagtgactttaaggagcaactgacatcctacttagctctacaatggagttgtattttcacctgaatctaatatttctctgtactttgtttcctgacagctctgaacacaatacaacaccccccaagtttcttatgttttcaatatatttattgatggtatgtgagaaaagattgtagtgccaggtgctcagtgccatacacactctggaaagaaaaggtcaggaatggccaggcatggtggctcacacctgtaattccaagactttgggaggacggggtggttggatcacctgaggtcaggaattcaaaactggcctggccaacatagtgaaaccccatctctataaaaatacaaaattagccaggcgtggtggcgcatgcctataatcccagctactcaggaggctgacgcaggagaatcgcttgaacccaggaggcggaggttgcggtgagccgagatcgatcgcaccattgcactccagcctgggcaacaaaagcaaaactccatctcaaaaaaaaaaagaaaagaaaaaatgtacacatcgattgtatgtaaattacacatacctcaataaagctgttaatagtgtgtatggtatacaatcatttgtataaaataatcacaaatataaatcattttatacacagagattatctctgaaaagatacattagaaaatgattaatgtgctggattttgtaaaagggaactaggggattagtaggcgggaaggtgattgattacagatacctactgtattgtttggattatttaccatatgtatgttttaccttttgtttgtttgttgtttttgagacagggtctcactctgtcacccagactggagtgcagtggtgcactctcagctcactgcagcctccacctcctgggttcaagccattctcctgcctcagcctcccgaatagctgggattacagagatgtgccaccacgcctggctaatttgtgcatttttagcagagacggggtttcgccatgttggtgaggctggtctcaaactccagacctcaagtcatccacccgccttgacctcccaaagtgctgggattacaggcgtgagccaccacacccggcctgttttacctttttataaaaattgaaataatttcaaaacctgctttaagtgccttctgaagaaaggactagggtaaggaaccatcacagataaatgttctcaatagaagacggaccctaagagtagaaaccaatccttgagcgctgaaccagcacctgaggaagaggttcctgttgtgcaggtaaatgaagaaggtctaaaggacatcatggccagacacacaataaaagccccagtatatcctaatatacacaatctgtttgagaagtaaaatcttttgatgatctctcccatttgataagaccttataatgttccatggactgtgctaaactctctagaagcatgattgtgtcactgaattccacgtgagatatgcatgtgattatcttcatgtttcacatcaaaaaaccaagccaggctgggcacaatggctcatgcctgtaatcccagcattttgggaggccgaggcaggcggatcacttgaagtcaggaaggagtttgagaccagcctggccaacacagtgaaactctttctctactaaaaataaaataaaaaattagctgggcgtggtggcaggcgcctgtaatcccagctacttgggaggctgaggcaggagagaatcgcttgaacccaggaggcagaggttgcagtgagccaagatcgtgccactgcactccagcctgggtgacagagcgaggctccacctcaaaaaaaaaaaaaaaaaaaaaaaaaaaacacacaagacagagaagaggagaagagtaaattaactactcaatttcagacaactctcaagcaataaagtggggatgtgaaccaaagtcctctgactccaaaaattccatgctaccatctcttggatatttttttcatgatacccacagaatgaaataaccttggtggtgaagggggctgagaaccactactcgaaacctactaataggtccaagggaaaagagacataatttttttaaagcctaaaaagtaatgacatctttttttttttttttttttgagactgagtttcgctcgtcgcccaggttggagtgcaatggcgcgatctcgactcactgcaacctccaccttttgggttcaagctattctcctgcctcagcctcccaaattgctgggattacaggcacccaccacgatgcccagctaattttttttgttatttttagtacagacagtgttttgccatgttggcaagactggtcttgaactcctgacctcaggtgatccacctgcctcggcctcccaaagtgctgggattacaggcgtgagccactgtgccccacctggtaatgacattttctaaaactccaagtgctgtcagacctcacaggctgaaaaagaggtccactggtggcaaaggccagggaggctttggagggcaaggaggcttccaaggaggcagaggaggaagaagagaccacagctacaggaaagaagatgaagtttgaaaagcttcttctatccttgtcttttcctcttccatttgaaaggactcgggtttttactctgtgcctgatccatcacagagccttctgaggacattccaagattgtctacagtcctgtggtccacttggaaattcagacagataatatttcaaggggatagttggttttgactgaatactcatgaaaacttttaaagaaatgagtgatagagctaacccatatctgtaagttttgatggtttttcttgttttttatttttttgagaaagggtcttgctctgtcacccaggctagggtgtggcggtgtaatcgcggctcactgcagcctctatctcctgggctcaagtgatcctcctgcctcagcctctcaagtagctgggactacaaggcctgcaccaccacacccagctaatttttttttttttcctgtaaagtcaggaaacctgccacattgctcaggttggtctccaactcctgggctcaagcaatccacgtgcctcagcctcccaaagtggtgggattactggtatgagccaccatccccagcttatgttttgaattaatagttgttttttttttttttttttttttttttgagacggagtcttgctctgtcccccaggctggagggcagtggcatgacctcagctcactgcagcctccacctcccaggttcagtgattctcctgcctcaccctcctgagtagctaggactacaggtgcctgccaccatgcccggctaacttttggatttttctttagcagagtcagggtttcaccatgttgaccaggctggtcttgatctcctgagctcaagtgatccacccgcctcaggctcccaaagtgctgggattataggtgtgagccaccgcgcccagacaatattgtttcatctcatgtaagaaaacatttttttccaacaaataatttttttatgttgggggttgtaaaggaaagcagagtgttttatcaacttttttgcttgagtggctttagaacaatttaaaagtcaactttggtgccagataaaaagaggtccatgagggaaatcctcaggtaaaacatgcaaaataaagtgcagcgataggcagctaagtcagtggcatccaatgcaaatgtcagaaaggtcgagagcagttttcccaagcaaatggttctccccaccttcctctccttcagtctctgcctcctagggcccaggggagaaaacctgagagggagcagtgtccacaggagaaactgggtggggaaacacttaacacagactgcagggaaaactccagaaacactaaccaaggtaaaaacgaagtcaaagtgagagacaaagggttaaccttagtttaggtaaatttaatgactgtaaaagctgttcacatagcagctttaaagagacacgttttccactgacataaagttgcttcgccccttgcagcttatctccaccttcatgacctgtttcctcagtggcaggcaatgtctccccttcctgttggggaggattgcccaagtcagctctgaggccatcctctcaggtcagcaatatgcagaagagtccctcagagtggtcctgcagagaacatgtcccctaagtgtctgagaactggctgaggtgatctgaaagaaaaccaggcagaagaaggcaaaataactaggactgtagcactgggacttcatgtggagcctctagaggagaagcccccaaaaggaatctgatggaggcgaccggctggcagagaccacatggctcctgtgtgcccccgatcctggcaggaagcgaggtctcatggaatggcaatggatataatttaagaagtcaaagcaggtcagtcccagccacttctcccttttctcttggaagatggctcctcctcagctctaaccataaaattcaggtgaaactgcccatcacaggccctgccctcctaactccaaggctgatccagtcaaatccttccttaggatatttacagccaacatttggtgagaaatgttctctctcctccaattgagagctaaaagaatgtgaccccaaagttatctgtggtcacatgtcttatcataagagcaagtcagtccattagtaaatccttactaagtacatattttgtacccggaattgccctaggtgctagaagataaacaaagataaacaaacagaaacaaaacaggcattttccctgcccttaaaggaacttctgtggatgctctagggcatcagtctgtgtcctgccagcttctggttctgaggcgaagcagatatgagaacaagacagggaaggtggcagtagcagaactgggcagtgtgagaagagaaggcagaagaaaggaagaaatggaaggagacaataagagaagcatatcgccagtgaaagggagaaagaaagagagaaagaaagggagagaaaatcccacagccatatagctgatctgtgagtccagggaagagacccaagaaactcgagcacatgtaagttaaagaggcctgagccgtcagagatcacaaagaaaatgttgatctccaacagggaacactctctactcactcgaaatcactccacctcctggcctctctgcagcgagaaactacatgccactgcatactccaaactcaccaaattcccacaaagaacgcttccagggcaggagaataggtaagaagaataagaaggcattagtaaggagcagtctaaaatccaatccaaagtgcccttccattgtactggttgagaggggatttttattttactaaaatgtgtctctaggaaaaaactttattaccacaaatatccaaaccaacactcatttcacagtgcaagccaaaagcccaaaaggactcctcaccttcaccagcacatagtccccaggctgggctctgaccctgagcccagggttattgacatcctccatctctgcatcagggaagatcaccttaaggtttccatcattcctgccacacaggtcagtggcagagcgtttactgagctgcagaaagaagagagaagagttcgtggatttgtcacagttgtaagttcttggagggtagaaactgtgccttctctgtctcggatccccaagagtctgacccacagagcattccttaaccaaggaatcactgaagactcagtgtttgctgctgcttcaccagcaagggcagtgtatggcccacaacagaaacactgtaaagttttgctaactatattataatgaatcaattaatcaataagtctgtgcagaactgccttctgcaggaatggacctccaacaggcctaaagccagagacttatgagcgatgcatttggaaaaccaactttcacttcacccagtctcatactagtcacttatgaatgaatgttctgggattgtttggcctgcattacttgccctcactgaatagacagactgaaaggcagaatctccaacacaacacacagaagacagagccaggaagatactaacatcactatgatgggattaacttctagagtctacggaaacccttctcttccagccatggtaaagagacagaaacaagtttacccttcagccttataaataataaccagcaaattgggtaaaatatatgaaacaactgttttcggatactggacaagagatcatacaagactgtgagctgtgagagaaggaaaacaaagtgagccccccaatcacccctgctttctgccagaaggtacatgccagacgggagcctgtgaagcaggaggggagagctcaagcacagcacagtggtcctcccctgcactgaagagagagggatcaatgttcagggagactgaaatagttagaaactgtgaagcaaattctagagagaagggagcaaagcggaaaaagaatttcagaaatatgcagggggtccttatgagtcttcactgaacactaacacttgcatgtgtagcataaaactccatgaagtcaggcaaagagagtaacctgggaactgtccactgaacagttcccagaactcacatgtggcctggaatccactaccaaatagaagagtttatggatttgtcacagtcataagttcttggagggtggaaattgtgctcatcggttccttgggatatattcactagcaattcctgacagaaggccacatcttagtagtgaaactaaactatccagagaataaaaaagtttttctggccaggcgcagtggctcacgcctgttaattccagcactttgggaggctgaggcgagtgaattacctgaggtcaggagtttgagaccaacctggacaacatggcgaaaccccgtctctactgaaaacacaaaaattagccgggtgtggtggcgcacatctgtagtcccagtgactcgggagactgaggcaggagaatcgcttaaacctgggaggcagaggttgcagtgagccgagatcacgccactgcactccagtgtgggcaacagagtgagcctcagtctcaaaaaaaaaaaaaaaaaaaaggaaggaagggagagagggagggaacaatctctgtgacctctgggacaatatcaagtggtgggacatatgtgtaattcaagtacggaagtggtggaggtgggtggaagaggaagcggagcaaaaaaatctgaagagtaacaggtgaaatttttccagatttgatgaaaactataaccccagaaactaaaaagcctcaaaaaaatcccaaagaaaacacaaaggggtaaacacaaagaaaaccacccccagccacatcaaattcctaaaaacagtgataaagcaaaatcttaaaagcagccaaagaaaatggcatagagtaaagaagaatgaccacaaacctgtcagaatcacgtatgtcagaagtcaacagaatgatatctccaaaatgtcaacctaaaagtcaacactcggtgaaaatatatttttaaaaggaaggtgaaataaagatcttttcagacaaacagaagctgagcagcatcactgccaaaagacctgcattacaagcaatgttaaaggaagcctttcaagcacaaacaaaacgatgcccagtggaaacgtgaacgtacacaagggatgaagaatgccagaaatagtaaatcagtgggtaaatacagactttctctcattttttaaagttcctttaaaagataattgtttaaagcaaaaataacaatgatttagggatacaaaagtaaaactctgtaaaaatagtacaaaaggaggaggaagggacagaagtatatcattacaagaatcttacattatatacactgagtgagtggtacccagtttggggttaaaataatgggccaaagagaatccaaagggcacataatctgccattagaaaatcaagctctgacaacatgctatattcttaagtaatcaaagacacagaaaggagttcagtctttaaatgaataccactttagggaaacaaccttcagctgagatttagaggctctactattccctacaaaatacttactagttacaaaaggaaaaagagtaactttacagtcaagaaggctggcagacagtatcttccatgttttcaaagttagcatcatcagtaatgagacaaatcaaaattgtatgccacctcacaggatatgattagaatacaacatcatctctctggtattcctgccaaagaatgcataacctgaatcttatcatgaaaatacatcaaattatggacattctacaaaataactggcctgtaatctttaagtgtcaaggtcatggaagtcaaagaaataatgacgaaccatcctagactaaaggagactagagagacatgacagttaaatgcaacatatgatactaaaccaaatccttttcctataaaggacagttcgaagacaactggaggaaacttacatggggtctcaggattagatggtagtaatctaacaaggttaatttcctgattttcatagttgtactacagttatctaggagaatgtccctgtttgtacaagatacacattacagtatttgggggtttggggacatcagggcagcaacttactctgaaatgattcaaggggaaaaaaagttctttataatacacttggaacttctctatgggtttgcagttgttttacagtaattttttttttaaaaaaagagagttcaggccactgcagtggctcatgcctgtaatcccagaactttgggaggctgaggtaggaggattgcatgaggcaaggagtctgagaccaacctgggcaacagagcaaaaccccatctctacaaaaaatttgaaacattagccaggcgtggttgtacacattatagtaccagctactccggaggctgaagcaggagggtcgcgtgagcccaaggagttcaaggttacagtgagctatcattacaccaccacactccagccagggagacagaacgagagactttgtctcaaaaaatataaaaaataaataataaaatcaattaaattgagatttcaggttccatgatttgaaaaaaaccaagtgtaaaagaacattcatgagacaaacagggaaattagaacactgagcaaatatttggtaatattaagaaaattagaagtgctttggaaatctaaaaagaatattaagacatttttgtcaattattgtcaggtatgataatagcattttgtttataatttttttaaagtccttatcttctagacatatatactgaaatatttactgaagaaatagcttttttttttttttttttgagatggagtctcgctgtgtgacccaggctggagtgcagtggcgcaatcttggctcactgcaacctctgcctcccaggttcaagcaattctctgcctcagcctcccaaagtcactgggattacaggtgcctgccaccacacttggctaatttttgtatttttagtagagacggggtttcaccatcttggccaggctggtcctgaactcctgacctcatgatccacctgcctcagcctcccaaagtgatgggattacagacgtgagccaccgcgcctggcccgaagaagtatcttatacttgctttaaaatcacccaccaggagcagtggaaatgaaacaagattagtcaagtattgacaactattttttggctttttttttgtttgagacggagtttcacttttgttgcccaggctagagtacaatggcgcgatctcggctcaccataacctccgcctcccaggttcaagccattctcttgcctcagcctcccgagtaactgggattacaggcatgtgccaccaagcccagctaattttgtatttttagtagagacggggtttctccatgttggtcaggctggtctccaactcccgacctcaggtgatccacccgcctcggccttccaaagtggtgggattccaggcatgagccaccgtgaccagcctctttttttttttttttgatacagactctagctgtgtattttttttgatacagactccaggctggagtaaggtggcacaatctcatcttactgcaccctcgacctcctggattcaagcaatcttctcacatcagcttcccaagtagctgtgactacaggtgtgcaccaccacacctgactaatttttattttttatttaatttgtagagattaggtttcaccatgttgcctaagctggttttgaactcctgggctcacgcaatcctccagccttggccttccaaagtgctaggatcacaggcttgagccaccatgcccagcagtattgacatttgttgaggctggttaataggtatgccagcattcattatactattctctatatgttttttgttgttgtttatttgggtttttttgaaacagagtctcactctgttgcccaggctggagtgcaatggcccgatctcagctcactgcaacctccgcctcccaggttcaagcaattctcccacctcagcctcctgagtagctgggactacaggtgtgcaccaccatacccaactaatttttgtatttttagtagagacggtgattcaccatgttggccagactggtctcgaactcctgacctcaagtgatctacccgcctcggccccccaaagtgctgggattacaggcacaagccactgcgcccagcctctatgtttaaaattctctataatgtaaaaaaaaaaaaaaaaaaaaaaaaaaagggcagggtgattacagactctggagagagagctgtatctaattctgactctgccacacactagctgtgtaaccttagggaagttatgctctgtctctgagctcagtaccctcatgcacaaaagggagctagtaacagcacctttctccaaggacagtggtggcactctgtgctgatggccataaagtgcgcagttcctggcagacggtaaatgctgagggatgtgagccattatcatcttttctgccactctggacatagcaacttggtgttttaaactggccatgtctggaggaaagaaagtctcctctaagagaaagcaatgactccaactgctagccttgaaaaacccatttattctctagccccaagtaagtaatggctatgttggatgaataagaaagagctttgtggtcgagagctgtggctcacacctgtaatcccagctctttgggaggccaaggtgggtggaacacctgaggtcaggagtttgagaccagcctggacaacatggtgaaatcctgtctctactaaaaatacaaaaattagctgggtgtggtagtgggtgcctgcaatcccagctactctggaggctgaggcaggagaattgcttgagcctgggagacagaggttgcagtaagccaagatcatgccactgcactccagcctaagtgaaagagtgagactccatctcaaaaaaaaaaaaaaaaaaaaaggccgggcacggtggctcatgcccgtaatcctagcactttgggaggctgaggtgggtggataactttgagaccagcctggccaacatgatgaaaccccgtctctactaaaaaaaatacaaaaattagccaggcatggtgacacacacctgtaatcccagctactcgggaggcagaggcaagagaatcgcttgaacctgggaagcagaggttgcagtgggccgagactgtgccactgcactccagcctggtcaaaagagcgagactccgtctcaaaaaaagaaaagaaatacttaggtgtaaatctaacaaaacatggacaaaatctgtatactgaaaactacaaaaactttgatttaaaacatcagcctgtagtcccacctacttgggaggctgaggcaggagaatcacttgagcccagcagtttgagtccagcctaggcaacataatgaggaaaaaaatcaaagatctaatgttctgaaacataaaaaacaacataacacacacacatatggcctcaccccttccactagcaccaactgggtacagcccacagaggtctgattggcttttgttgcttcttctcggaagatagtgatgagttcctccaaacgccttaattttacctcttccgggacatcatccttcagcctatgatatgcccgtgtcttctattaaaaaaaaaaaaaagagagaagatggaggtcaccaaggacttgtagaatctattcttaatgcacagagggcgaccatgttcattctacctacaagtaacagacacatgtacagaaacccaagccagaggcaagaggtttctctggctctgggagcattccaagataaaaaggtagtggagtcatatttttgcaagggttaaattctaaatttagcacatgaaaatcatagactcaaaattactcttgatatttatcctaacgttacacttgtacatataccaaatgactcacatatactaggttactcagcagtactatttatgaagacataagatgcaatgcagcctaaatatttcaataggcaagtagtcacagaaattatggtttatctatacaatggaatattgtgcggctgttaaacagaatgatagttctatatgtactaatgtggattgttctccaaaatctactgttacttgaaataagcaaagtgcagatcaacacatgtaactttagtgtagacagaatacatacaggcatgcttataaacacacgaaatatgcccagaaagttacaaaagaaattgctaagtggttgccttcagggaaggaactaaaaaaactaggcaacctgggaagaaggaagaaccactcatgtacagcacttaaccttttgaattttattcaagcatgtattacctagtccaaaagaaaaaagggaatttatccttaaaacacctttaaatcatccaaaaccacagtgtgtattatatctttatgacatgagctcatgctcagtacagctggagaaccactgagctagacaaaaatatggaataaaaggaatatctatataccaaagtttggacattcaaaccaatctaccttgaagagaagtatccacggaggaaaacggagaatcctaaaaatattgcagagtttactccattctgtcttactactaacaacaataacttacctctgttgtgcatttactatgcatgaaacacaattataactgctttaaacatattatcttacttaatccccagaacaaccctatgaggttggtaccaatgttggaaaccaagacatttgcccaatgtcacgtagttattaagcagcagaggcacaatttgagtgcttgctctcatccactaggttcttgattaagttcctataaccttaacccttaggaattaggtcccaaagtgaacattcatattcactgaccataagatgcttctgccacaagctgaaaacccatttcccatccctaggatttttttttcttttttgagacagggtctcattctgttgccaaaccggagtgcagtggcacaatcttggatcaccacagtttcaacctcccaggctcaagtgatcctccgacttcagcctcccaaatagctgggatcacaggcatgtgccaccactctcggctaatttttttttttttttttttttttttttttggtagagaagggtctccctatgttacccaggttggtctcaaactcctgggcttaagtggtcctcccacctctaccaatcctagtattaaaaagaatttctcaggccgggcacagtggctcatgcctgtaatcccagcactttgggaggccaaggtggtggatcacctgaggtcaggagtttgagacccacctgaccaacatggagaaaccccatctctactaaaaatacaaaattagccaggcgtggtggcacatgcctataatcccagctactcgggaggctgaggcaggagaaaaacttgaacccggaaggtggaggttgtggtgagctgagatcgtgccattgcacttcagcctgggcaacaagagcgagactccgtctcaaaaaataaaaaaaaagaatttctcttgggaggctgaggtgggtggatcacaaggtcgagagatcaagaccatcctggccaacatggtaaaaccctgtctctactaaaaaatacaaaaattagccaggtgtggtggcacgcaccagtaatcccagctactcgggaggctgaggcaggaggattgcttgaacctggaaggtggaggttgctgtgagccaagatcatgccactgccctccagcctggtgacagagcgagactctgtctcaaaaaaaaaaagaatttctctggcatatttgtgatgtccatggaaaagaagcaaaatagaaggggccaggcacagtggctcacacctgtaatcccagcactttgggaggccgaggcgggcagatcacgaggtcaggagattgagaccatcctggctaatgcggtgaaaccccgtctctactaaaaatacaaaaaattagccgggcatggtggcgggtgcctgtagtcccagctactcgggaggctgaggcaggagaatggcatgaacccgggaggcagagcttgcagtgagtcgagattgcgcaactgcactccagcctgggcaacagagcgagactgagactccgcctcaaaaaaaaaaagaagcaaaacagaaactaacagctcctctgaagcttcatctctccaaaacactaaaagatacatgaatatgatacatacattggcacagttacgctgcccacagaacactacgcagtggctttaaaatgaattagttgaggtgtcatgactcacgcctgtcatctcagcactttgagagagcgtggtgaaaggactgcctgagccaggagtttgagaccaacctggacagcatagaaagatactgcctcttaaaaaaacaaaaaaattagtttggttgatggcagctcagtaacaatgacaataaagtcatgggttcagtcgtttgtcagccagcttttctgagccccctggccacagggggccttcaacctcctgcccaaacacaagcacattgccacaaaggtgactgagggaatgaggagtgaaccgtgcaaatccatgcctacaatcaagaaaatgacagccaaccaggactatccttctcttcaggaaaagtgcactaatctctccttctttcctaatctccttctgctttgcctgggaatctgctttgtttcctgggaagcctccaagtgagttcacttgcctaggaaaacagaagttaggaatcactgaggatggctgggaagatgaccaggggccccggtaaaataaatcacatctgcagaccaaaaaggagttctgcatgttaagaaacaattttaggtttctcgtaaagaaaaggttttctccttccatattcaaattgcaaacaatctaaacataattttaaaatattttaatgaggaatactggcacagtaatcatgtatcatcaaattgctgaaccgtttcagagtagacagagtgtactagaaaaatgaacggaagtgaatcgtaagagcctgtggtttctcaaggactgccttgccgccactctcttttctgccctgttctctacagtcaccacccccaaactggtcaggaatgatgtcagtcctccccaaccccagggctcacctgtctcatgctgtaggcaaagaggaagcccatgttgtactgaacttcccggagcaaagagactgtctggacgtgatcttcctccgtctcaccacaaaagccagcaatgaaatcgctgctgaggctcacacctgtgatacacagcaaaggatgacaggtgactgcctgctgtttaccttcaagggaggccttcagcatatgtggattacaagggagggatagcaactgtaaggtcctccctaggactattcataagtaaaacaaaatagtacagagtaaggcgggataggcctgttcacccacagcattccatgacagagatcagcttcttggcctacatttcccctaagcactagaaaaggtatttccacttccaatgctgcatttagggacacagtagggagtccacattttcatatcagtcctcttaccagtgaaaaccttgtggtgcttcatacaaaaatatatttctgaatttggtttgatacaatggtcatctaagacagtagcagccgttgcatgcggtagctcacccctgtaatcccagcactttgagaggccaaggtgggcggatcacttgaggtcaggagttcgagaccagcctggccaataggcaaaatcccatctctacaaaaaatacaaaaattgaccaggcagggtggtattcaagtgtagtcccagctactcaggaggctgaggtgggaggatcacctgagcccagggaggtcaaggctgcagtgaactgtgttcatgccactgcattccagcctgggcgacagaatgataacctatcccccaccaaaaaaattattccagtgacccagtgaggtgagtactattaactccattttacagatgagaaagctgcatcccacagaaatgaagtctcttatctgctatcacacagcctgtaacagtggagcttgacccatagccacatacctagcctctgcattaccctgccctatcaaaacgaaagtatttgtccataaaagttaaaataattaggccaggtgcagtggctcatgcctgtaatcccaccactttggcaggctgaggcgggcagatcacttgaggtcaggagttcgggaccagcctggacaacatggtgaaaccctatctctaccaaaaaatacaaaaattagctgggcatggtggcctgtagtcctggctacttgggaggctgaggcacaagaatcgcttgaacctggcaggcagaagctgcagtgagccgagattgcgccactgcactctatcctgggcaatagagcaagattctgtctcaaaaaaaaagttgtaataattagaaatttgaggaaaaatgtatacaccctcaaccaaatctaaactaaatgactacagagtattttattaggaggaaggggacagtgaaggggaatatggaataagataatacgaaaggaattatctctaaaatttacagtaataagttgccataaagctagttagaaaaagtacacattttactgctgatctgtacaatcatctttatacctacatttcctcatttcatcaagacttctctgaagcatatctgaaaataaacaacactgtaactgctttcttttcccacctaacctggaagttccccaaaggcataatctaagtgttattctctccatattatgcttaaagtattctaactcaaaagtgattttaaaatgtatctgtaaaatcggcctcaaaaagaaagtcaaatgtggtataaaatatagaaaatgaagatgaataaataagaatagtaagttcttatttctaaaaaaaaaaaaaaaagatatcaattgttctcaaatcagaactaatttagacataactttgtcaccttacaagataagataaggtctttcctctatgtccagatacaaagaccatagaaaaggaatctctatagccttgaggccacaaggtgatccacacctaagtacttccagcaggactaagacaacaaaaaatcagaaagacataaaagaaagaatacgaggagagagaaagagaaagaagaagagcacaaaagttatgaaactgtgtcacaaggaaatgccaaaggtgttgactgtatctaaccacaaggctggtcactggtagagtaacatgctcagcagaatgagtttcttaaatgtacctggaatagattctctaatatggtgaactaactccacataagcttctcttgaatatctgcaataaagaacaaaaggaaaaggcctacataaatccaacctttttaaatgaatgctataaaaagataacactatgaatttccacatgtaatcacttctcatccacatggcagggcacacgagtaaattaaagtatccaaaagagcccttttgatctaagctgtatcttctaatctaatctagagcctatgaatttttatttaaggacataaactttttttttttttttttgagacagagtctcgctctgtctctcaggctggagtgcaatggcacaatctcggttcactgcaactcaaattcctgggctcaagtgatccttccacctcagcctcttgagtagctgggaccacagatgtgcgccaccacacccagctagtgtgtgtgtgtgtctgtgtgtctgtatgtgtgtgtgtatgtgtgtagagactgggtttcgccatgttgcccgtgtgtgtgtgtgtgtgtgtgtgtgtctgtgtgtgtagggactgggtttcaccatgttgcccaggtgtgtgcatgtgtgtgtgtgtgtgtgtgtagggactgggtttcaccatgttgcccaggtgtgtgtttgtgtgtgtagagactgggtttcgccatgttgcccaggtgtgtgtgtgtgtaaagactgggtttccccatgttgcacaagctggtctattctcaaactactgagctcaggcaatctgcccaccacagtctcccaaagtgcttggattacaggcagaagccacagtgcctggccagcataaactattctaaatagctttttttatttaactaataaatctagacagattaaacattttagaggacctctaaaatactatgccctgtggaaaacaagacaaagcactaattccatacagcttgccttgggacagattctcccttcagtctcatctgtgtaatacttattattctcaaagaaagtgaacacatagagcgacatttaaattccaagatgtaacaaaaccttaatgttaacattaaaaaattaaaatctcagagtgtgccacaccataggtgcttaattaaaaaaaaacatactaaacagtgaaaatggatgacccagtccttagcctatgttatggagttagcgaagcaagctccagtgccctgtggcttagtcatacaataaatacttactgtcacacagtggctgctcagtaaatatttatgctttttaaactaaacagtgaaaatgggtgaccagtccttagcctttgcttatgaagtgagcagaagcaaactccagtgcccagtggcttagtcatacaataaatatttactgagcagctactttgtgccacacactatgctaggttcttggcaacaaggacactgtttggtcattaaggaaacatggaaaagtgagggatgccccctctccaagcaagcctgaccccctccgcatggcctccaacacacggctgcttccactctgggctggcaggtggatctgtttacagatgttatctctctcatgaatcagctgcagaacctgatgaaacagaacacattataggtaatcacaatctcaccaaagaaccttacagaaagcaataccgctcttactatgtatcctccaaggtcaattttcacataattaagaggctaattaaaccagacacacaaaatcacctattccctaacttttgttcaagccccattctatttgtctcagacacttcacctgatggcatctctgctttcaaagagtagagagaagaaagtaagcagaggtcagattaaagccatgggagctgaatacaggtagtgctgacactagggtcagcaggcaaagcaggaaaaaaatggcacttctttcagctagcttacaaagcagtcactttctattttttttttttttgagacagagtatcactccattgcccaggctggagtacagtggtgccatctccactcactgcaacctctgtctcctgggttcaagcgattctcctgcctcagcctccccagtagcagggattacaggcacaaaccaccacacctggctaacttttgtatttttagtagagatgatgttgcccaggctggactagaaatactgacctcaagtgatccgcctgcctcagcctcccaaagtgctgggattacaggcgtgagccaccacgcccagcccaaactagtcatttttaaagataccatcaggtcaggtgtcatggctcacctctgtaatcccagcactttgggaggccaaggcaggaggattgcttgaggccaagacttcaagaccagcctggacaacatagtgagaccttgggtctattttttttaatttttaaaagaagaaaaaagaaaaaaaaagataccatcaaaaaactgatactaggggaaaatatttgaaaacatattgacaaaggatttgaaccaagaatacataaagaggctgggcgcagtggctcatgcttgtaatcccagcactttgggaggctgaggtgggcaaatcatttgaggtcagcagttcgagaccagcttggccaacatggtaaaaccccgtctctactaaaaatacaaaaattagctggacatggtggtgtgcacctgtaatcccagctactcaggaggttgaggcaggagaatcacttgaacccgggaggcagaggttgcagtgaggccagatcacaccactgcgctctagcctgggtgacagagcgagactccatctcaaaaaaaaaaaaaaaagaaaaagaaaagaaaagaaaacataaagagaacacattccagtctctctcctccattgcaagaaaggctcctttgcagtggtcaaaaaaataaaggatatgtaaagaacttttacaactcaataagaagacaatccagaggaaaaaagatgaaagtcggggccaaaagaaagacttttcactgaaacaaaaaacctccaaaaaaaggtttcagatgtgggctacctactccatgccaggcactgtgctaagtacctttgacacaatataggcatacctcagagatatcacaggtttggttccagatcaccacaatgaagagaatattgcaataaagtgagtgacacaaattttttggtttcccagtgcaaataaaagttatatttactctatactgcagtctattaagtgaaagcaatgtacataccttaatttcattatatttatattttttaaatatatcgagatagggtttcactctatcaccctcgctagagtgcaatgaaactgtagctcaccccaaccttgaactgctaggccaagcgatcctcctgttccagcgtcccaagtaactacgactacaggcatgtgccaccatgcccagctaatttttttatttaaaaattatagggccgggcacagtggctcacgcctgtaatcccagcactttaggaggccaagatgggtggatcatgaagtcaagagttcgagaccagcctggccaacatctctactaagtctctgctaagaatacaaaaattagccaggcatggtggtgcatgcctgtagtcccagctacttgggaggcaaggcaggagaactgcttgaacctgggaggcagaggttgcagtgagctgagatcgcaccaccgcactccagcctgggtgacagagcaagactcagtctcgaaaaaaaataaaaataaaaataaaaaataaaaactataaagttgttatgctgcctgggctggtgtccaacttgtaggctcaagtgattctcctgcctcaacctcccaaagtgttgggattacagggatgagccaccactgaatattttaagctcactgttgagacctactgcttaggaaaaaagattcctttctaaatatgactgctcattgacaacgcacctggtcatcccagagctctgaaagagatgtacaaggagattattagtgtcgtttttatgcctgctaacacaatatccattttgcagcccatggatcaaggagtaatttcaactttcaagccctattattttaatttttagtttatataagatcaattcttattatttaagaaatatatttcataaagctatagctgtcgtagatagtgacttttgtgatggatctgggcagagtaaactgaaaacattccggaaagaattcatcattctagataccattaagaacattaatgattcatgggaagaggtcgaaatgtcaacattaataggagtttggaagatactgatttcaacattcatggatgattttgaggggctcacgacttcagtggaggaagtaacatcctctttagcatcattcttaagggccctaggattttcagaatggcaaatcaacactggcttcaacttaaagtcaccagctgccttggcccctaacaagagagtctggctgggcacagtagctcccgcctgtgatcccagcactttgagaggcctaggtgggagaactgcttgaggtcaggtgttcaagaccagcctgggcaatacggcaagaccccacctctaatttttttaaaaggaaacaagagacagagtcagcctgtcctttgaagctttgaagaatggcactgatttctcttctctagctatgaaagtcccagatgacatcttcttccaacagaagactgttcatttacactgcaaatctgttgtttagtagaaccaccttcagcattgatcttagctagatcttctggataacttgcacagcttctacatcagcactatggcttccccttgcactttgatgttagagagatggcttctttcctcaaaccttgtaagtcaacctctgctagcttcaaacttttcttcttcagcttcctcacctctcttgggcttcagagaactgaagaggggccttgctctggattaggctttggcttaaggaagtgctgcggcttctttgatcttctctccagatcactaaagctttctccatatcagcaaaaaggctgggttttgttgttagtggtttttttgggttttcttgtttttctttttgagatggagtctcactctattgcccaggctggaatgcagtggcacaatctcagctcactgcaacctctgcctcccgggttcaagcaattctcctgcctcagcctcccaagcagctaggattacaggtctgcacaaccaaacccagctaatttttctatttttagtagagacagagttttgccatgttggccaggctgatctagaactcctgacctcaggtgatccacccaccttggcctcccaaaatgctgggattaaaggtgtgagtcactgcgcccagcctgtgagccatcacacccggccaaagaggttgtgttgttttcttatcattcatgtgttcagtggagtagtacttttaatttccttcatgaacttttcctttgcatttacaacttggctggttgacataagaggcctagctttcagcctagctcggctttcaacatgatttcctcagtaagcttaaacatttctggcttttgatttcaagtgagagccctgcgacccttcccttcacttgagcactttagaggccattgtagggtgattaaatggcccaatttcaatattgttgtgtctcagagaatagggaggcctgaggaaagggagagagatgggggaatggccgtctgtggaacagtcagaacacacacatcatttaccaatttaggtcactttcttatgtgggtgtggctcatggtgttccgaaacaattttaagaataacattaaatagcactgatcacagatcaccataacagatgtaataataatgaagtttgaaatattgtgaaaattaccaaaatatgacacagagacatgaagtaagcacatgctgttggaaaaatggtgctgacagacttattcagagttgccacaaaccttccatttgttaaaaataactccataatatctgcagagtgcaataaaacaaggtatgcctttgtatctatttcacaacaacccaaagcaggaggtaattgttaaccccttattaaccccattttacagataaagatgaaaagttgaaaacatcacatgctcgctggtaaaacagtggaaaagctgagatttgaacccgggtctgaggcgaaagtctgggctgtttcccagagcaccacatcacctccttcctgtccaccccacaccaccattaccgccccaccaccattattaccactcagctgcccactttgtaacaaatcctctctgtacagccctcacggtcccgcaggtggtcttaacctcccgctgaatatcagtcctacctccactcccaccttggcagacttttttttcgagacagggtctcgctatctcacccaggatggagtgcagtggtgcgatctcggctcactgcagcctcgacttcctgggctcatgtgattctcccacctcagtctcccaagtagctggaactacagtcgtatgccacctcagtctcccaagtagccagaactacagtcgtatcccaccccacccagctaattttttgtatttgcagtagagacggggtttcgccatgttgcccaggctggtttccaactcctgagctcaagtaatccacctgcctcagcgtctccaagtgttgagattattggtgtaagccccgtgcccagccactggtggacttcaaatcttcaaaggaccagcagatctggagggtgatgcagcaataccccacaggatccctaagcaggactccaggtctctgctgcatccctactgggtccagcctttggcatgctcaagaatactaatatcagtttgtcacagctaacctgacgctcacctcatcaggaaaatccttggggtggggagaggtaaaacggatcctcatttcaggatctactctggagacctgatccagaagatgagcaaaacgaagtcctccttgcttggttttatagttggtggtaaagccacgactgagattggtaggcactgcactgttgaactggacctccgaattgtcccgaaaactattaacattctgaccaagaagtgtcacttctttcagcccctaaacatgggaaaatatattggaattttaaaacttttgggtagcttcataaaaaaacactaattaaaaattagctgaaattaacatatcttttgttttaaacaaaagaaaaatcgaacctaccaagagtcacctataagtgtgttgtgtctataaccgaataatttcaagcttagacatcttacctaaagagctaaacctaataaagccttatataaaaattaatcttcaaaacattatttagaatcaaaactggaaacaaactcaataatccacaataatggttaatttatgatagatctgtcatttgaatgttatacaccatgactatataaagtattctcaccagaaatatttaacctgaactaatcaagcttttacacctaacttccagttactagaattcacagagatatattaaatgacaacatgaggaaaaaatcagacaaaggagactcatgtctgatctcttcaaaaagttaatgcatcatttaaagaaaacaacaacaacaaaaaataaaagagctgttttagatttttttcttcttcttcttgagacagggtctccctctgttgcccaggctggagtgcagcagcacgatcatagctcactgtagcctcaacctcccaggcttaagcagtcctcctgcctcagcctcccaagtagctgggactacctttttttacttttgtagagatgggatttcaccatgttgcacagactggttttaaactcctaaactcaagcaatcctcccacctcagcctcccaaagtgtctggcttaaataactattgattttcatacatatgataatgatatcatggttatgaagagaaaaattgttactcatagaagatacatactgaagtatctaggggcaagtgtcctgaggtctacaaattacttcaaatggttcagaaaaaatacatttatgggtgcatggagataggtgtatgacaaaatgttaacaatcacgtttttctattatactagtctttctatttgtctgtttgaaaatttatattataggccaggtgcagtggctccctcctgaaatcccagtactttgggaggccaaggtgggcggatcacacggtcaggagttcagaccagcctggctaacatggtgaaatcccttctctactaaaaatacaaaaaattagctgggcgtggtggcaggcacctaatcccagctactaaggagggtgaggcaggagaatcgcttgaacccaggaggcagaggctgcagtgagccgagaccatgccactgcactccagcctgggcaacagagcgagactccatctcaaaaaatagaaatgttatattataaagtttcacaaataatggttgctaaaaaagacttgttttgtaactttgacataatttacagacaaactgcaatattaaaagaattcccatatactctttgcccaaattcatcaaatgttaacactgcaccccatttgtttatcattcacattcagacactcatatacactctctctcaacacacatatgactacattttttttaagccttctgagaaaaagtcacagatatcatactcttttacttccaaatattttagtatatatttcttaaaaacaagggcattctcctatataatttcaggacaattatcaaaatcagaaatattgatacaacactattatctactttccataaatcaaatgttaccaatagtccaaataatgttttgttgttgttgttgttgttattgttgttttttgagacagagtctcactctgttgcccaggctggagtgcactagcgtgatcttggctcactgcaatctccgcctcccaggttcaagcgattctcctgcctcagcctcctgagtagctgggactacaggcgtgtgtcaccacgccaggctaactttttgtattttttagtagagacgggttttgccaagttgcccaggctagtctcaaactccggagctcagacaatctgcacaccatggtctcccaaaatgctaggattacaggtgtgagccaccacgcccagcccaaataatgttctttataacatttttttccctgatcagaatcccaatcgaggaccgtgcgatgcatttagttgtcataactccagtctccataaaggctatttatttgtgtaagttgtgacatactgttaatctaaaaagcaggatatactaaatgcaatgtggatcctagattggatcctggaaacgaagtaagacattagtggagaaactggcaaaatccaaataaagtctgaagagagttaatagtaacataccaatattaatctcttagtttttgctttgtttgttttgtaatagagacagcagctcccagtgttgcccaggctggtcttgaactcctacgctcaaggcaccctcctgccttggcctcccaaagtgctgggattacagcaccaaaaaatgtaccaaagaaagatggcaatgctcgaggaaactctctttgcaactttcctgtaaatgtaaagtcattccaaaacaaaaagtttattaaaaagtaggatataaaactaagtaaaatacacacacatatataaaaagacatacaaaccaaatgcagaatgacttaaggaacaattggggaactccgaataaggatgaactggaatgagacagtatttagcaatttttgttaatcttactggaagaactaatggtattaaaaatattcttggccagacacggtggctcatgcctgtaatcctagcactttaggaggccaaggcgggtagatcacctgaggtcaggagttcgagaccagcctgcccaacatggtgaaaccccgtctctactaaaaatacaaaaatgagctaagtatggtggcgcatgcctgtagtcccatttactcaggaggctgaagcaggagaatcacatgaacccaggaggtggaggttgcagtgagctgagatcgtgccattgcactccagcatgggcaaaaagagcaaaattccgtctctaaataaataaataaaataaaataaaaatattctttagcagcacatggtggtacgtgcctataatcccagctactcaggaggctgaggcaggaggatcacttgagtcccgggggcagaggttgcagtgagccaagatcataacactgcactccagcctgggcaacagaacaagactctgtctcaaaataaataaataaataagtaaataaataaataggccaggcacagtggctcacacctgtaatcctagccctttgggaggctgagccgggtgaatcacctgaggtcaggagtttgagactaagcctggccaacatggtgaaaccccatctctactaaaaatacaaaattagctgggtgtagtggtgcacacctgtaattccagctacttgggaggctgaggcaggagaatcacttgaacctgggaggcggaggttgcggtgagccaagattgtgccattgcactccagcctgggcaaaaagagcgaaactccatctcaaaaataaataaataaataaataataaaaagatttttaaatgtttaaaaaagaaaatatccttattttttagagatgcatactgaaggatgaaacaacatgctctactttgaaatacgttttcaataagaaaaaaataaatgaggccaggcgtagtgggctcacacctgtaatcccagcactttgggaggccgaggcgggtggatcacttgagatcaggagtttgagaccagcctaacatggtgaaaccccgtctctattaaaaatacaaaaattaagccaggcacagtggctcttacctgtaatcccaacactttgggaggccgaggtgggaggaacacctgaggtcgggagatcgagaccagcctgaacaacatggagaaaccccgtctctacttaaaaaatacaaaattagccaggcgtggtggcgcatgcctataatcccagctactcgggaggctgaggcaggagaatcgtttgaacccgggaggcggaggttgtggtgagccgagatcacaccattgcactccagcctgggtaataagagcaaaactctgtctcaaaaaaaaaaaaaaaaaaaaatcagccaggtgtggtgccaggcacctgtaatcccagctactcaggaggataaggcaggagaatcgcttgaatctgggaggtggaggctgcagtgagccgagatcataccactacactccagccaaaaaaaaataaaaaataaaagtaaatgaaacaaatatggcaaaatgcaacaattgttaaatttaggtgattgttagctggggcagaggggtcattatactattccctcttttcagtatatttaagtatttttcatataaaaagattaaaaagactttttataaaagttgcttatttagaagacttccaatagataaccattgtttgaatgaataaacggacattctgttaaaggtacaatattctatactctttgcaactgtagtctaaaaaatctaaatgaaagaaaaaaaatctttaaaaattactaaacaagcaaaattattaagtgactaacagatactttaaaatacaagtaaaatcttaattttccacaagtctatggccttgaattcactaagattcactttaatgttattaagttccttcttttataggcaaatggcctagaaaggttggggagttttgtcaccatctcagtctatttaaacagaatgtctctatcctgaaggagtgagttttggtactgagggagagctggaaggggagaggaaggagacaactttagaccaggaagcacttggagaggtggggtatggaaaatgcctcacagagcaggggagcagctaggggccaaatcaaggaactgattatctgggggtagggcaagagaagacagcactgccagaatgtgaggatgatagcaaactggtgacttagaactagagcagggaggccaggcacagtggctcatgactgtaatcccagcactttgggaggccaagacagtaggattacttgatcccaggagttctagaccagcctgggcagcatagtgagacctcatctctacaaataattaaaaaattcactgggcgtggtggcacctacctgtagtcccagctacttgggaggctgaagtgggagaattgcttgagtccaggcaggtgatgctgcagtgagctctgaccacaccactgtactccagcttgggtgacagagtgaaagcccgtctcaaaaataaaaaataaaaaaagaactggggcaggggctaccctggccctctcccatgattcctgagccaaacaagtaaggaagcagggagacaccactgttaggaaaagccaccatattcccacctattgtcctcttctgcaggggtagcagattcaggcccggggctaaggaaaagacctcctcaaaagctgaggaccagctcccagtgggagaaagaagagcagatctcccctgtggcttctgatccaccttactcccctcatctattctgtccctcaactagtgagctggctcagtgataaaatgaacaataaatctgggagtttttcctggaagagacaaattcataatttctcaaaaacttagctatgtgccaggtaatttaaaaacttttcctccaatccttctaataaccctgcaagcaaggtattattttattctcttttcacagatgaggaaactgcattacgacgacagttaaattgacatgcctaggaaccaagccagaattcacactccatcacctgactgtaatctcatgccctctccatccaccatgctgcctccatagtggagctctgtaatttgtgggcaataaaccaatgatgtacacaaaagtagttctttctggccaggcatggtcctaaactttaataagtcagagacagcataggctcaaaactacaaaggttatcctcatcctcccccaaacatgttcacagcaagaaagcctggagaactcttcacctgctcagaaagcttcttcacttcctctagaatggaggcaataggccgactcctctccctgccccgggtgaaaggaacaatgcagtagctacacatgttgtcacagcctcgcatgattgacctggagaagaaagtaccagaacttagtaacagtagcagggtgtgctggtatgacccaaggagcaggactcagcttcaatagcattattctttggctctgaatcctcttgccacaatgctcacactggaccaatctgagatctaagcactaaagtagaccttttttatctttaaaaattggtatctaatcacaaaatataaaccaaactataaccagtgggacaatgactagcctgaggaagcacagcggtgaggagctagaatatacacttaccacacttggactttctactgtttttttgttttgttttgtttgagacggagtctcactctgtcaccaggctggagtgcagttgcaatctcggctcactgcaacctccacctcccaggttcaagtgattctcctgcctcagcctcctgagtagctgggactacaggcgcctgccaccacgcccggctaatttttgtatttttagtagagatgggatttctccatgttggccacgatggtctcgatcttttgacttcatgatccacccacctcagcctcccaaagtgctgggattacaggcgtgagccactgcacctggcccctctactgtttttaaattcttttttccagacagcctgaatatgtttgtacctactgtttttatgagtatattatctgaactttttacatccagaccagaaaaaaataaatattataaagtgtgtgtatatgtgtgtatatagggcaaggagaccctggatttaaaacacagaattctacatttctcacgccttcctgatccaactgttaggtatcgaagttaaatcgctctctttaattcacatcctgtatgtgaaagcctcaatctatctgaaggaaataattacggctatgtatcaaagacgttcactgaagaattatgtaataaatgttagctattattcttactaagcattccaacaagagaatattatatagccattaaaataaacagaggttgacaaacttttctgtaaaaaaaaaaaaaaaaccctatagtaaatatttgagacttagcaggctatagtctctgtcccaagtatttaaccttgctttagtggcaaaagcagccagaggcaatatgtgaataaatgggcatgcttgtattccaataaaaccttatttacaaaaagaggtagtaagctatttggcaacctctgttacagaaaatttaatgccatggccaggcgcagtggctcacccttataatcccaggattttggaaggctgaggtgggaggatcacccaagctcaggagtttgagaccagcctgggcaatatagtgagaccctatctctgtaaaaattcaaaaaaaaattagccaggtgtgggggtgcacacctgtagtcccagctactcaggggactaaagcaagagcccaggaggtcaaggctgcagtgagccctgatcatgacactgcactccagcctggatgacaagagtgagaccctgtctcaaaaaaaaaaaaaaaagtgtgaaaggaggaagaggcttattccctatctcttaggcagtgactcacacaaaggcagacgtggcactggcgcttgtctggactggcatgacatcagcataggtctcgtccagagagagcagcacgttggcagcttgctggcccgactcagcaacagccagcagccggggaaggtcccggtaggcatcaggaccagccaaaatatctaccattttctctctgttgagaatctcctccttcaacctctcagccatgcagcctggaagggaaaaagaaacaagcacctttccccaaatccacctggtgtttaatggcttcttcttattccactttatctgtagctgggattagagaccagggcacagaaaacttctctaagaattgagtatcatccttcaaatttaaccaacactcccatcgcactggagcctgtatcttcctatataagaaaaccacagaaaagggttccagagcaattcaattaaatgcccagaaaaaaattaaaccaccagccaggtgcggtggctcatggctgtaatccccacactttggggggccgaggcaggcggatcacctgaggttgagagttcaagcccagcctgaccaacatagagaaaccctgtctctactaaaaatacaaaagtacccaggcatggtggcacatgcctgtaatcccagcaacttgggaggctgagggacaggagaatcgcttgaacccaggaggcagaggttgcggtgggccaagatcgcaccattgtactccagcctgggcaacaagggtgaaactccgtctcaaaaaaaaaaaaaaaattaaaccaccacccacaaacctttcaagacatgaaccatgtcttctttcaactgaaaattacttagtgctgaaataaaaagtattctgtgtctggaacttacttacccacaactacacttgaaccctttccctctcttctagcctataatacttgctaaaacctgtaagaaatgagtaagccatttatgctgttatcttccatatccttaaaaaaattatgttattaaagttataatatcttaaagtccactttattacaaataccctttgaaaacacttaacagctattcttgtttgtatgcccatgttcatagcactattatccacaatagccaaaaggtgcaagcaacccaagtgtctattaatgaatgaagagatatttgcatctacgcaaagccagttaaataaataatttttcagctccctctccctctccctctccctctccccctctccctctccccctctccctctccctctccctctccccctctccctctctccttctccctctccccacagtctccgtctccctctctttccactgtctccctctccctctctttccacggtctccctctgatgcccagccaaagctggactgtgctgccgccatctctgctcactgcaacctccctgcctgattctcctgcctcaacctgccgagtgcctgcgattgcaggcgcgcgccgccacgcctgactggttttcgtatttttttggtggagactgggtttcgctgtgttggccgggctggtctccagctcctaaccgggagtgatctgccagcctcggcctcctgaggtgccgggattgcagatggagtctcgttcactcagtgctcaatgttgccaggctggagtgcagtggcgtgacctccgctcgctacaacctccacctcccagccgcctgccttggcctcccaaagtgccgagattgcagcctctgcccggccgccaccccgtctgggaagtgaggagcatctctgcctggccgcccatcgtctgggatgtgaggagcccctctgcccggctgcccagtctgggaactgaggagcgcctcttcccggccgccatcccgtctaggaagtgagcagcgtctctgcccggccacccatcgtctgagatgtggggagtgcctctgccccgctgccccctctgggatgtgaggagcgcctctgcccggccgcgaccccgtctgggaggtgaggagcgtctctgcccggccgccccgtctgagaagtgaggagcccctccgcgcggcagccgccccgtctgagaagtgaggagcccctccgcgcggcagccgccccgtctgagaagtgaggagcccctccgcccggcagctgccccgactgggaagtgaggagcgtctccgcccagcagccgccccgtccgggagggaggtgggggtcagcccccgcccggccagccgacccgtcagggagggaggtgggggggtcagcccccgcccggccagccgccccgtccgggagggagtagggggcagcccccgcccggccagccgccccgtccaggaggtggggggcgcctctgcccggccaccccttctgggaagtgaggagcccttctgcccggccgccaccccgtctgggaggtgtacacaacagctcattgagaacagaccatgatgacgatggcggttttgttgaatagaaaagggggaaatgtggggaaaagatagagaaatcagattgttgctgtgtctgtgtagaaagaagtagacataggagactccattttgttctgtactaagaaaaattcttctgccttgggaaaaaaaaataatttttcaatgaacaaacaaaatgtactacatatacacaatggaattttttttttttttttacaacggagtattactcagccttataaaggaaggaaattctggccaggtgctatgggtcacacctgtaatctcagcactttgggaggccaaggagggtggatcacttgagcccaggagttcaggatcagccctggcaacatagtgagacccacatctctacaaaaaataaaaaaattagtcctcgtggaacgtgcctgcagtcccagctactcaggaggctgaggcaggaggattgcttgagcctgggaggttgaggctgcagtgagccatgatcacgccactgcactccagcctgggcgacaaactgagaccctgtcaccaaaaaaaaaaaaagaaggaaattctgacacaggctacaacaggtaacctcatgaaccctgaggacattatgataagccaaataagacagtcacaaaaaagacaaaattgtatggttccacttacatgaggtatctagagtagtcagattcataaacagaaagtagaatggtgattgccaggggctgagggaaggaggaatggggagcgtgtgttcaatggatatgtagtctcagtttgggaagagaaaaaagtcctgcagatggatggtggtgatgggtgcaaaacaatgtgaatatacttagtgccacagaaatatactattaaaaaggattaaaatggtaatttcatatatattttactacagttttttaaattattcttgggatttctgaaattcttattagatatacaccctgaggcttctacagtgaaggaactgaaatggaacagaacatttcagctgacccttccatcctcctgcgtcaattactacatggatctgataactaaatatgctccatctgtgtgtggacccatcgttaggagagattaatttaactattccacaatggagatagtctgtttttccataatgttaaatacattaactaaattctgagacagaaaagggtagagaaatgtctccagtcatatagatcagaactgcccaacataactttctaataagatgataggcctggtgcagtggctcacacctataatcccagcaatctgggagattgaggcaagaggatcacacttcagcccagaagttctagaccagcctgggcaatatagcaagaccctgtttctacaaaaggtcaaaaaattagctaagtgtggtggtacacacctgtagacctagctacccaggaggctgaggtgagaggatcatttgagcccaggagttggaggctgcagtgagccatgatcatgccactccagtctgggcaacagtgtgagactctgtttttaaaaaaaaaaaaaaaaaaaaaaaggatgacagagtgtgctggatggaaaaataattgcgctgtacaaactggtagcccctagtcatgtggtcatgtgtggctactgagaagttgaaatgtggctaatggaactaaagaagtgaattttaaattttatttaattataggtaaatttaaatagccacatgtggctagtggttaccatattggtgaggcagacctaaatcttcacttgagcttgcttcaggagtcagaatgaaaggtacccacattagaaatttgtgctgtcaggccaggcacggtggctcatgcctataatcccaacactttgggaggctgaggcaggcggatcacccgaggtcaggagttcgagaccagcctgaccaacatggggaaacccgtctctactaaaaatacaaaattagccaggcatggtggtgcaagcctgtaatcccagctactcgggaggctgaggcaggagaatcacttgcacccaggaggcagaagttgcggtgagccaagatctcgccattgcactccagcctggacaacaagagtgaaactccatctcaaagaaaaaaaaaaaagaaattcaagctgtcccttcagactccaactctacccataactctgtgctaccatgagccgcattagactctaggcaggatataccactttctgagcacctattacttcaaggaactacggaaagccctttcatgaactttatctcatttaatcctgtcacctctggcagtaagtacaagaattgcatgggatatataagatttcttcagacactgggaatccagcctctaaaggaaacactagcaaataaagccacataaagtccaagtttcaaagctgacaaaatgtgcaaattaccagatacctagaattccaatcctcagaggaacccgggagcggggccgccttgtcttcaaggctttaagctgatgtaaacggttccagatggtctgctcagccttctccctagagagatcaaaggaggcaagactgaaccaaaaataaaccacagaggtatctaagagagtaggtcagtgggaagaaaataaaaaccaccttcaaccctttaaatcaagcttttccaacctgcagcccacgggccacatgcagccaggatggctttgaatgcagcccaacacaaattcataaacttttgtaaaacattaggagatttttttgggggggattttttttttttttttttttttagctcatcagctattattagtgttagtgtatcttatgtgtggcccaagacaattcttcttcttcttccaatgtggcccagggaagtcaaaagattggacagccctgccttaaatgtgtatctgccattcagacttacggaaggtaggtagggggccacctgaagaagcaacacttgctataatttacctttcctaaaatgacatccttcctacacatcttcaaatcctgaaaagcctttaagccaaactcaaaaacaatctacttcacaaggccttccagttctcctctgttggacagtttgtcctccctttaactgcccttcaactttttttttttatgattccagatcctaatgcccttctactttaactagatttttccctatacttagcaatttctccttttttttttttgagatggagtctcgctttgtcaccaggctggagtgcaacagcgcgatctcggctcactgcaacctccaactccctggttcaagcaattatcctgcctcagcctcctgagtagctgggattacaggcgtgcaccaccacgcctggctaatttttgtatttttagtagagatggggtttcactatgttggccagactggtcttgaactcctgacctcatgatatgcccactctggcctcccaaagcgctgggattacaggtgtgagcaaccgtgcctggccagcaatttatcttttatttttctttgtagatacagggctttactttgtgcccaggctggtcttgaatagttcactgtagccttgaactcctggactcaagtgatcctcccacctcggactccaagagtgctgggattataggtgtgacctactacacccagcctcattgtttgattttttttgaactagcattttttgccagatgttggagctatttgttcatctatcttagttcccatatcagactaggctccttaaagccaggccatggaagaagggttcatttcggaatcacccaaagcacatagttcagtgtcaagcagcagaggcctacagaacaaaaatgtcagatgaattaattgacagtatagccggatagggaaacattaacactagcatgtcttgaacacagaaacaaagtgagaaaggaggtacgttcacctctgatgggagtcacccatctctactcaaaactccccaagcctatgactacatcctaccccgggcagctatattataaacatatgccattagttacaaaacaaagctcaggaagagctgagtggctcggcacattcttggtgtcctcatctataacagcaccaaccacacagggttgttgtgatcattaaatttgttaatgcattatgttactcactcagaacctgacaccacggtacatgcccagccaatgtcagccagttgtataaagactatctccactgtgggaaaactgcaagtcctactgccatggggccactggctcatctccatagacagccaggccaggcactgttagctctggcattattacataaaatacattcactcctaggaaaagaacaaattcgcacctgatagagcatgtgacaaggagaatcacatctgcctgaatggaaagaaaggaaaacaaggaaaattacataatatcttggatattagccttgtacaattcctgccctacagctctttattatttttttttcctttttttttttttgagacagagtctcactctgtttcccaggctggagtgcagtggggcaatctcagctcactgcaacctccacctcccgagcggttcaagcaattctcctgcctcagcctgggattacaggtgcccaccaccacgcccagttaatttttgtatttttagtagagatggggttttaccatgttagccaagctggtctcgaactcctgacctcaagtgattcacctgccttggtctcccaaaatgctaggattacaggcatgagccactacacccggcctattatttttctttaactatttttttcctttttttttttttttaatagagaaaggagtctcgctcacttgcccaggctgaagagcaatagcataaccatagctcactgcagcctcaaactcctgtcttcaagcaatcctcctgccttggcctcccaaagtcctgggattacaggcatggtgacccacacctggacattttaaccatttttaagggtacagtcctgtggcattaagaacatctgcaatttcataactacgcattttccataactttttcatcttctgcaactaaaaccctgtactcgttaaacagtaactctccaacttccctctccacagccaattcttaacttagctccttgtctgaaggcgcacatcaccataaaagtttcaaaaacagctggaacaaaagtacaactcagtcccatggtgaacacttcacccaagggaactctctctcaccagggggcaccctgctcctgaaactacacctaagaactggcacaaatgcagaatcttgcccaggtccaggaaacaaaggaaataggaaatgcatgtacctcttggaggttactggtccgcaggtagccactcttctgtaagatggaccaggctatctctgtgtcattcacattcatctggcagccataggtctcgaggtagactgcagtgagaggttggggggaatccatggtagacagacaacaaggggtctcgtgtctcaaaaggtctccttcccaaatgctctagaaatatctgaggcatctggttatccactaagtcccctattgcttcaatcttaagataacataaattgccagatgtacccccaagttaatgatagaccttcagaacaaaagaaataccatattaggctgggcacagtggttcatgcctataatcccagtactttgggagactgagacaggaggattacttaagcccaggagtttgagaccagccagggcaacatagggagaccctgtctctacaaaaaatttaaaaattaggcaagtgatacatgcctgtggtcccagctactcaggaggctgaggtagaactgctcgagcccaggagactgaggctgccgtgagccatgatcacaccactgcactcagcctgggcaatagagtgagaacctgtctcaaacaaacaaaaaaatataccacattatatatccacaccaattacaagccatgttatcttttaaatggggaaaacatgtacctgagaatcaaggaaatatagttataaaaacaattagaaaaggaaggactaggccgagggtggtggctcacgcctgtaatcccagcactttgggaggccaaggcgggcagatcacttgaggtcaggagttcgagaccagcctagccaaaatggtgaaacccaggtctccactaaaaatacaaaaatcagccaggtgtggtggcgtgcacctgtaatcccagctactcaggaggctgaggcaggagaatcacttgaagccaggaggcagaggttgcagtgagctgagatcgcaccattgtgctccagcctgggcgacagagcgagactcaaaaaaaaacaaaaaagaaaagaaaaggaagggctaactgatagtgttcatcagcctgaagggaaaataagtttaaatccacatgttacactcctcctcaaaataaagaggttttccagcctctggaagtagcagcagtggccagagggtacataaagtcacaaaattaaaatgaggcatcttcttacagtaacttcatcttaaatgaaagcaaggctatattatgaagtaaaactaattttgtacacagttgtaagaatatgaatttcacattctggcagcttcaaactatattccaagatcaacccccgtccccaccagcaggtcttatttccagactccaataaattccaactaaaagttaagagctgaatgataatcagcttttgatcaaatgattctcccacctcagcctcctgagtagctaggactacaggtgcacactatcatacctggctaattttttattttttgtagagacagtgtttcaccatgttacccagactgttcttgaactcctgggctcaagcaatccacccatcttggcctcccaaagtgctgggattacaggcatgagccaccgtgaccagtcgagtttcttgatattaatattacttggtggagtctaatgattcccacagccttcccacactgttaaccttccaagccagttctgtaataaaagaatcatgccaggaatgacagagaggagcaaggcaggaagcccaaagggataagcgaagtaaaaccaaccttttctctgccttccaagaagttcatccatcatgagatagggaggtgggtcttccacttctgaagacagcttctcctgaggagctgaggcactttttaaaaaatgttgaaaagtcggtccagcagccagcctggagctgaaatccttccgagctccatcctcctgcctctctggactgggacacatggtactagagagactgctgtgtgccctgcacatcctcagcgacagccaagacacagaggccaatggtccccaccccagagacctctgcacttggaggacacactgtaaagggtgcatggcactaaacagcccacagtctgcaaaagaatgacagacatcaccagcatttattgaacactatggacaggacactgctgtgagcacttcaagtgtatacatctatttacccctcacaaaagcccatgaagaaggtactcctaataatatgacctctgttttacagttgaaaaaaactgaggcaacttgcccaagaccacacaaaggagtgccagagatgagatgcaaatccaggcagtcttttcaaaacaaggggtggtagagatgagatggaaagccctgacaaaatgacaaaatagcaccttgtgccaagaccagttcccaaggctttaagtgtattaactcattaaatctttacagcaatcctaggaagcagatactattattgttcctattccgaaagacataggttgaggaactcacctaagctcctacagccagtaagcagtcaaacaaggactcagataaaaatctgtatggatgcaaagcccgtgccactacccatcttgctacactgcctcttaataaagtgaaaaccactcactgtctgagggcatcttcctttgagttccttcagaaggaaagcaactaatgtgagggcattgtatgcccgatcagtgactccttctacccttcaagagtcttggctggatgcagccgctcatgcctgtaatcccaggactttgggaggccgaggcaggaggatcacttgaggtcaggagttcaagaccagcctgaccaacatggcaaaaccccatttctactaaaaatacaaaagttagccagatgtggtagcaagtgcctatagtcccaactactcaggaggctgagacaggagaatcactggaacccaggaagcagaagttgctatgaaccgagatcgcaccactgcactacagtttggacaacagagcgaaactccatctcaaaacaaaaaaaaaagagtttcaaactactaccttcaaactttccacccagaccctctcacacttggcttagcaaataacacaacctttatagagaacaatttgccactttccatcaaaattacaagtgtgcaaaccatctgacaaagcatttccactcataattatcctgcagataaatctatacacatacaaaatgacctatgtataaagacattcagtctaggcacagtggctcatgcctgtaatcccagcactttgggacgctgaggctggtggatcacttcaggccaggagttcgagaccagcctggccaacacagtgaaacctcatctctactaaaaatacaaaaaattagctggatgtggtggcacacacctgtattctaagatacccgggagactgaggcatgagaatctcttgagctcaggaggagaaggttgcagtgagccaagatcacgccactgcactctagcctgggcaacagagtgagactgtctcaaaaaataaaaataaaagatattcaatgcaacagtgtttctaatagcaaaggaaagggaaagatctaaatgttatcaataaaggactagttaagtaagttctggtgcatccatacaatgaaacaagatacaactgttagaaaccaaggctggtggccgggtgcagtggctcatgcctataatcccagcattttgggaagctgagacagaaacatcacttgagccaggaattcgagaccagcctgggcaacatagtgagacctcatctctataaaaataacaaaaaatagccgagcacagtgatgcacacctgtagtcccagctactcaggaggttgagatgaaaggattgcttgagcccaggagatcaatgctgcagtaagccataatcgcaccactgcactccagcctgggtgacagagtaagaccctatctcaaaaaaataaaaataaaaataaatgaggctgaacctatacatgacaaaggcaaggaagcaatatgctccatgctacctacattatactactgttgaatctgtggggaaagagggtgggaatattgaggtacctatttgcaggtacatacaatatctctagaatgcataagaaacaatagttgcctcccaggaagacttaggtgactaaggtataggagatgaagccatactatttactttttttttttttaattttctgactaaggaagaattctaggatcaccatatatttttactggaccccacatctatggcctactacactccagccatgccacacttctttgtattaatcttcactagcttataggattttacacatgctgttctctggctggtatttatcttctctctagtggcctatggtactttcagctttcttcctctgggaagcctgctctggccatcacccccgaagtctaggtggggtcctcctctgggttcccaaagctctattctatctctccatcacaagactcatcacactttgctgttaattattactgacacttctgccagccctagtaaactggcaggttcctgcaagcagggaacaagtatcattcatttctacaccttcaccatctcccattgtggtagctgcctcacggcaggtgctaaacatcagtggttcccaacctttttggtactaggaattggtttcatggaagacaatttttccacagacatggaagcaggggtgtgttgaaactgttccacctcaggcatttagattcttacaaggagcatgcaatcttgagccagtgcggtggctgacatctataatcccagcactttgggaggccgaggcaggcggattgtttgagctcaggagttcgagaccagcctgggcaacatggcaagaccatgtttatttgttgtctctacaacaaattaaaaaataaaaaattagccagccattgtggtatgtgcctgtaatcccagcaacttgggaagctgaggtaggaggatcacttgagccagggaggcagagattgcagtgagctgagattgcgccaccacactccagcctgggcaacagagagagagagaacttgtctcaaaaaaaaggaaatggaatgcacaaactagatgccttgcatatacgcagttcacaatagggtttgtgttcctgagaaactaattccgtggccaatctgacgggaggcagagctcaggcagtaatgccagctttgctgctcacctcctgctgtgcaacccggttcctcacaggccacagacaggtaccattctaccacctagggttaggggaaccctgctatacacgtgtaaagagcagatgtggcccattacctttccaatgagatgacctgccacatctgctactagcacttaggagcaatgccaacccagtttcaagagtcagagaagaacagccttaaagtgtgaactttaaaatcgcccctttctactccataattgctgtgtgacctttggcaagacaaatttctgtctctgagccgccaattccacatgtgtaaaataaggataaaagcagcacctaccaccccataagtgttattaagaataagatattaaaaacccaacttgagatacagtaagcgttcactaactgcacatttacagcccacaccccctttcacagagagtattagagcatcctggttaagagtatgaactccactaaaaatacaaaacttagccgggtgtggtggtatgcgcctgtaatcctagctacccaggaggctgaggcaggagaatcgctggaactcgcggggcaggggctacagtgagccgagatcgcgtcactgcactccagcctgggcgacagagcaagactcccgtctcaagaaaaaaaaagtatggaccctggagtcagaatctgaccccactgctgccaagccagctaaaccttaggcacctgtcttaaactctgggagcctctagatggggataatagcacctatctccataagcctaccgtaggatcaaatgcaataatacaagcaaaatgctttgcataacgcaatgtagaagcctctctggaggctcgaaattaattctgacagtcggcaatgaggctggaacaacagcgtacaacatcccaaacattttattggctggttacaatgcgttaggcatggtgcaaagcattttccgcgaattattacctataaccctcatagcaaccctgtgaggcaggctgtactgtcaaccccacttcacgggtggcgaagcgaagccttgaaagaagtggaggtgacctgtccaaggtcacacggggttaggcggcggggttagggtacgaacccctacagcctgacgccaggccccacgccataaccaccgtgccatcctccctcttgaacaccgtgcgcttcccgggatccgcggcccctcctgccccaggcgccagtcaaaagcgggtgcgcagcccaccccggcggccgcgctgctcacctcccgcagcagcaacagtgcccggggtcccgcagcgtaagttctgccggcaagtcggatcccctcacaggtccgccgctgcgttcatacacaagcgacttccgttccgccgctacttcaggccgggtcatgctaacggaagtgcttcctttttacagtccgggtggacccaaagctccgtggcggtgctgaactttagggcagccactagccacggacttaagcggcaattgagctcctcaaagtgggtgagtgcaaatcaaatgtgcgctaaatgtcagatacactggatgtggaagaagaaatgtcaaatagtgtcaaatagttcatatatataatgtttatattgattatgtgctgcaataattgttgggatatattggattaaataagtacatttgttgaattagttttttttatttgtagctatggtggtagaaatatttgaattaagttcacctgttgtttctttttactttttcaatgtggctagcagggggaaaaataatatggtgtgatcatggctcactgcagcttccgcctcccatgctaaagcaatcctcccacctcacactcccaagtggctgggactacaggcaggcgccaccacgcccagctaaaatttttttaatttttttgtagagaccggtctccccatgttgcccaggctggtctcaaactcctacctaggcgcaagccatcctcccaccttggcctcccaaagtgctgggattgtaggcatgagccaccgtgtccggtccttactgggaaattttaagtcacctaagaggttcacgctctatttctattggagggtgctgccctgtaggttaatgacttcctgattcacatctccagctggaccctccctgcagtaccagagccatagctcagctgcctacttgacaccccttcttgagtgtctgatgaccatctctaacttatacagaactcttcatttccacacatgcaccttcaccaaaaacctgtacctgtcattctggcccatctcagtaaatggcccaaccatccttccaggtgcactaggaggaactgaatggtcattttcttcacctccctggatccccacattctatctgtcagtaagccctgtcaactctaactccaaaatgtcaaatctgtctactcggtagctacaactacccaggccaccattgtctcatcagaaacaatcacagtagcctgctaatggtcaccttgtctcctgagaacagtttcccacacatagcctaagggaatttgtgtttgttttattaaatcaaattatatcacccctctcctgaaaactctccgtggcaggccgggcgtggtggctcacatctgtaatcccagcactttgggaggccaagatgggcagattgcttgagcccaggagttctagactagcctgagcaacatgataaaaccccatctctacaaaaaacacaaaaattaccccggcatggtggtgggtacctgtggtcccagctactcagaaggctgaggcagggaggattgcttgagccagggaagttgaggcggcagtgaaccatgacctcaacactgcactccagcctgggtaccagaatgagaccatgtcttgaaaaagaaaaaaacaaaaacagccgggcacggtggcttatgcctgtaatcccagcactttgggaggctgaggtgggtggatcatgaggtcaggaattcgagaccagcctggccaatatggtaaaaccccgtctctactaaaaataaaaaataaaaaatagctgggcatggtgccgcgtgcctgtagtcccagctactcgggaggctgaggcaggacaattgcttgaacccaggaagcggagattgcagtgagccaagatcgagccactgcactccagcctgggcgacagagcaagactccatctcaaaaaaaaaaaaaaaaagaaaagaaaagaaaaaaacaaaaacaaaaagcttaagagctttccattgcccgtgcaataaaatccagatttcctactgtatcctaggggcctgcatgatgtggcccctgctttttttttttgagacgacgtctcactcactctgtcgcccaggctggagtgcagtagtgcaatctcggctcactgcaacatccgcctcccaggttaaagcgactctcctgcctcagcctcccgagtagctgggattacaggcgtgcaccaccacgtcaaactaatttttgtatttttagtagagcagggtttcaccatgttggccagattggtctcaaactcctggcctcaagtgatccgcccacctcgacctcctaaagtgctaggattagaggcgagcaccaccacgcccggctgatttttgtttttactagagatgggttttcgccatgttggccaggctggtctcaaactcctggcctcaagtgatcctcccacctcagcctgccaaagtgctggaattacaagcatgagccaccatgtctggccccctgcttacttttacttctccaacccatgtacttcttaccacttacttctcctactgtgttctttctagttgactatacttcaactacataattttatcttgctccttcaataacccaagcaaatgtttatttcagaccctctgtccttttttttttttcttttcttttttgagacggagtcttgctctgttacccaggctggagtgcaatggcgtgatgttggctcactacaacctccacctctcgggttcaagcaattatcctgccacagcctcccaagtagctaggattacaggcacgcaacaccatgcccacagagcttctcttcttactattatctttctggaatgctcttctccaaaattgtttcgtggctggccccttctcatcctttaggtctcagcataaatatcagctcttcagagagaccctctctgaccacttcatataaactactctatcacttctcttattattttcttcaccatatttgtcactattcaaaatgttggcattacttattttcttatcattgcctattccctggactatcagctagggagggacacgtcgtgtcttgttcatggctttatccccatgatctacacagggtctgactcatagaagggcttaatgaaaatttgttgaatgaataaatgactgctttctgtcttagtttgggctccccagaagcagacctgagacaagtatttttttttttttagaccaagtctcactctgttacacaggctggagtgtagtggcccaatcttggctcactgcaacctccaccacccgggttcaagcgattctcctgcctcagcctcctgagtaactgggattacaggcaagcgccaccacacccggctaatttttgtatttttagtagaaacagggtttcaccatattggccagactggtctctaactccccacctgcggtgatccacccaccttggcctcccaaagtgctgggattacaggcatgagctactgtgcccggctactgagacaagtatttgagtgcaggtagttgatttgcaaagtaatctcaggaaacactggtagggtagtaggggagtgaaacagggaggggagacagccaataaacattgttaacaagcaactttcttgcaggcatctaggtcttaatcctgctggagaacactgggaaataatgcagaacactgtgctggttaattatttgtgtcaacttgactgggccacaggttgcccagatatctagttaaacgttatttctgggtgtttcttgaggaagagattagctttggtggactgagtagagtagactaccctccacaatctggatggacatcatctaaccccttggggacccaaataggacaggaagacagagcaaggttgaattctctgtctgcctgactgcttaagctgagacattggtcttctcctgcccttggactgggacttaaacaccattggcactcctgattctcagtcttttagattcaaactggaatttacaccaccacctttcctcggtgtgcagcttgcagatggcaaattgtaggacttctcagcctctataatcacttgatccaattccttatgataaatctcattctagatgtagaaatatacatatagtggccaggcacagtggctcatatctgtaatcccagcactttgggaggccaaggtgggaagatcactggaggtcaggagttcgagaccagcctggccaacatggtgaaaccacatctctaataaaaatgcaaaaattatggccaggcgcagtggctcacacctgtaatcccagcactttaggaagccgaggcaggcggatcacctgaggtcaggagttcaagaccagcctggccaacatggtgaaacccccgtctctactaaaaatacaaaaaaattagccgggcatggtggcgagcgcctgtaatcccagctgctcaggaggctgaggcaagagaattgcttgaggccaagacaggaggattgcttgagttcaggagtgtgagaccagcctgagtaacatggcaagaccccatctctacaacaaattaaaaaataaaaaattagccagccatggtggcacagtcctatagtcttagcaacttgggaggctgaggtaggaggatcacttgagcctgggaggccgagactgcagtaagctgggatcccgcaactgcactccagcctgggcaacaaagcgagaccccacctccaaaacaaaaaatagggcggagggtggtgttccaagtgaaggcaccagactgctgatggccagaaggaaaaggagtgagtctttggtggtttgggatgttgctgaaaatttagtggataagctgagaaaatttcattttcacaaagaaacaatgctaccattgtaagtaagctaaaagtgattgcctcaaagttaagttacctggtctctcttttttttttttttgagacagagtcacgctctggggcccaggccggagtgcagtagcgcaatctctgctcgctgcaaactccacctccagggttcaaatgattctcctgtctcagcctcccgagtagctgagattacaagtgcacaccaccatatctggctaatttgttgttgttgttgtttgttttgtttgtttttttgagaccgagtctcactctgttacccaggctggagtgcagtggccgcgatctcagctcaccgcaaccttcacctcccaggttcaagcaattctcctgcctcagcctcctgagtagctgggattacaggcaggtgccaccatgcccggctaatttttgtatttttagtagcaacagggtttcaccatgttggccaggctggtcttgaactcctgacctcaggtgatccgcccacctcagcctcccagagtgctgggattacaggcatgagccatcacaccaggcacatcatctttgttttatcttgtcgctacattaaagaaactgaacctttcaaaagtttaaaaaaaaaaaagttctgggcttggcacggtgtcctagcactttgggaagctgatgcaggaggatcacttgaggtcaggagtttaaaaccagcctggccaacatggtgaaaccctatctctactaaaaatacaaaacattagtggggcatggtggtgggcgcctgtaatcccagctactcaggaggctgaggcaggagaatcgcttgaaccgggaggtggatgttgcagtgagatgagaccctgcctgggtgacagagcaagactccgtctcaaaaaaaaaaaagttctccatcattgccattgtcattgtgattttaggtagggagtcataaccactgcccactcacatccagccagcacatcgcagtttccgaagtaccaaacacattccactccacctcccttctgcaggaaagggtcctgaagctctctaagatggctttgacatgggtccacaaattctttgacattcctttcttcaagaggtggagcctaattcccctccctttgagtgtggactgaacttagtgactcatttctaatgaatagaacaaagcagaagcaacagtgtaaggcttccaagaccgggtcataagaggcactgtttgtggcttcctccttgccctctcttctgtctcactgtggggaaagccaactgccatatcatgagaaaactcaagcagcagctctagggttagccctacatggtgaggaactgagacctcctacccacagccatgtgcatgagcagtattggaatggatcctccagccccagtcaagccttcagatgactgcagccctagccgacaacttgactgcaacctcatgagcgaccctgagacaagaacagcccagcttagcccctctcaaatttctgacccacagaacctaagagataatgaatatttgtcattttaagctgcaaattttggataatttgtcacacaacaatagataaccaatacactgtctttggcccatgtagtaaaggtctgttcttctccagggaaaggtgccctagtccttggtctggtccatcttgggactgcaggggccaccccaggacccaaaggccaaggcacagaccacatacactgggccgggctgcctgtgtgctcacaggctgtttatttatccaagagtaaggaggagagagacaggatgaagagaaaaaccagactccccacggtggcagggctgaggggaaaaacaaacagaaaatctcctcttctttctcttgctgctgaccccagggtactccagcttcagatgggacctctgggggtggcttaggggcctcgaggaggcccggcagctcagctgttggctggggtcaggatccgcacaggggcaggtcccagactcggaatggcttctgtgtacacaaaatatctctctgcaaaaggcactggtggaggggggcagcaggaaggccaccccatcacaggcagagtccactctgtcctgcgtctgggtcctgggccccaagaccaatccagtctccctcagggttggggtttcggaggcccttgttcctctcctctcccttccctcagcccaggggtgagcaggcagtcggtggaggcccagctcaggccatgtcatggacacccctcttcagggctagtgcatccggcgacttctaggccaacagcccgaggcgggtgactttggccgacaggaaggagtggatgatgaagactatggttttgggacacgagtgcaggtccagctgctggagggtggatggagagaagagtcagggccctggccagcctggcctccgagagtgcacaccccctcctccccagggtgcagaggcagcccctcactcacgatctcgccttcagcacctccaaaatccaggaaaaggagactggcaccgtcatctgaagacatctgcagcttctcgaagggctgtcgcaggagcacagctcgggctgcacctggctcagccgcccacagtgtgaagcccttgtcgatgtgcacagacaggctgcagggacgcccattccacgtgcaggctgcagggagggcacataggtacaggcacagctggcacctcagagactacaccccaacctccaacccccaccgcagcttacaaagtggggcctgaatgcctccagggatgggaggctcactgtttgtcgtggcaccagtacacccaccctgcagagagtcatcacccccaccctcagaggacctacacccacttccagtcccacttccagcagcacaagtagaaagggggagcttaaaatgtgccatggacaggaggctcactgctgataaaggcatcatcagatctaccaagcaccgcccttggagacctgcagagttacccggctaaatttaaatttcagataaacaatgactaatttgggcatacttctgtgaaaaaagtattcattgttaacctgaaattcaaatgaggctgggtgtcctgtatttatttcctctggcaaccctaccccaagtgccatctctcacatcctcaccagcagattgacaaaactggggcaagaaaaccccagggagaagagtctctgcctgctagggcacctgcacatccaaaacagagggcccaaacccaacttccttttttttttggagaaacagtctcactctgttacccaggctggagtgcagtgggcgcaatctcggctcaccacaacctccatctcccgggttcaagtgattctcgtgcctcagcttcctgcgtagctgggactacaggcacctagtaccatgcccggctaatttttgtattattattttttttttttgagacagtcttgctctgtcgcccaggctggagtgcagtggcacaatctgggcccactacaacctccacctcccagattcaaacaattctgcctcagcctcccgagtagctaggactacaggcgcccaccaccatgcccggctaatttttgtatttttagtagagacagggtttcaccattttggccaggctggtctcaaactgctgacctcaagtgatccacccgcctcagcctcccaaagtgctgcgattacaggcgtgagccaccgcacctggccaatttttgtattattagtagagacagggttttgccatgtttgccagactggtctcaaacttctgacctcaggtgatccacccaccttgacctccaaaccccattttctatcccctcctgaagtgccctaaagaaggaagcttgaatgcccctggggataagaggcttattaccagagggacactcccagatcctcccagcacacctgtagacacctcctgcacaccctcggcggcccggtgacagccatccacaagctggcgggtccaggcagccagctcctgcggtgactccacgctgaacaggtgagtgtccacaccgtgacgcgtgcccgtgcgcagggcaaaagagagctctgcatcgtagggcactgagcccttggaggggcctgagtgcaccagtctgggggttgggggcagagggctgagcatgaggcctcaggccggaggcaaatagttctgggcaaaggggccagtgacctgggaagaaaccctgtaaatcctttaccacctaacaggacaggacttgccagggggcactgattgactcagcaggagacatctcctgccaccctccccgtcactcccttggctctggctatactggtgtcatcacacacacctagcacatgcctgcctcagcacctttgcatatgctcttccctctgcctatacatgcttccctgattatctgcacggctcactccctcacttccttcagatgttagtttaaatgtcacctcctctgagaagccttccctgacctcccagtccaaaatagcacccttgtcactcactagccttactttttaatcatggtaccagaaattatactttttattatttgttttcgttggtttttgactgtctttttcactagaatgtcaactaggttagaaattttgatcttgtgttcaccactgtattcccagtaactaaaaccatgcctgcccacagtaggtgctcagtaaacttttgttgcctaacttgaatcacttgattaggcagacagtccaggacctagttatccctagtagccagcaggctcctgacacacgggccagagccagcctgaggtaaggagacatgggggacaaggacttcagacccctgcagcttgactctcacttgctgtgtggccttggtaagccaactgcccctctctggggcagaaagttctgccccatatccctctttgttcctccctccacccactctttctcctatagctcagttccccccgccacagactgctgctgacacccgccttcgactttccagccctgagctgcagaccctcgagtccccaggcttcctatccaagctccctctccatcccacacacactctggacttaactcagcatcttgctccagcctcctccctttccacccccacccccagtcccacgctcacccagacacaagctccaaacctcctgttcattccggacccctccttcacccgccccatctggcaagcacggagccctgttaattttacacccatgtggtttccaatgccaatgctgcctttcttccccatctgctcctgccacccacctccacctcccccagccaccatcatctctcctgcatgactgcagcacctccccacttccatcctgcactctccgctgcattctccacgtggcagccacagggattctcttaaagcaaccagagcacctcgctccccagcttaaacccttcaacactaccaaactcttaagctaaagctaacattccttaatcaggcaatagaagctcttcaagatcaggccctgccaactcccttctctccatttcctgcatgaattctggttatcacaaactcatagctccatgaacatgctatagcccttcatgcctctgtacttttgaccatgatgttctctctgcatgggatgctctttcaccctttcttaaacagaaaacttctactcatccatcaaagtccagctcaaatgtcacctcctccctgaagccttcctctactaccccaacagagttaagtggctcctacaaaccctgcactgtaatggctgttcctgggtctgtctccccagccagacaaggttctctctggaggcagaaactgttggggtcagctctgtgccctctgaaccatgcagcacaaggcataagtgtcagcgaatgagtggctaatggggaccttatatccttttgttccaagcacccattttacagatgaggaaactgaggcccagacagggcagagacttgcttcaggtcacctggggaatagctgagggtggacagggctggagttcccagcttctggggccctgctggagcatctcctggcaagttctgggggagacatactgcccctgcctgtgggtacctggtggcgatgagtggggcagtacgggctggccggctcagggcctcgcgggtctcggggagagacaagtagaggagcagttccttttcagttagcagggccagggtgggggctgtgcccccactgggcagctgcagagaacaaaacagcagtgaggatgggtgggggaagagagggcagagggccagggcagggtgaggtggccaggggcactgggaacagggccagctccaaaggagcggaagagagagagggataggtcccaggcccagcaggtacctgctcagttagccagccaatctgcttgatgtcctggctcccagctgtgctggtggctgccaacagtgcctgcagctcatccttgacccgcggcgtcagagtattgacctgggcttggatggcagtcgcccacgacctcgcactagcctcatccttggccctcaggaagagggtgtcttgaccatctgccgagcagatctccagatacctgcaggcacaaatgggtggagacaaggacctgaccattaggctgcagctgcccaaccctggcccaagaaaccccacccaccaccaaaccaggagaaaccagggggatgtccgtgagagaatcaggagcaaccctcactgctgggctccagccacagttgctggggcttcatggggcataggaacaagcgagtgtgacatatacacacgtgttcatatattttgtggggtttttgttgttgtttttgaaacagagcctcgctctgtcacccaggctgcactgcaatggcccaacctctgcctcccaggttcaagtgattctcctgcctcagcctcccaagtagctgggattacaggcacacgccaccacacccatataatttttgtatttttaatagagatggggtttcaccatgttggccaggatggtctcgatctcctgaccccgtgatccgcctgcctcagcctcccaaagtgctgggattacaggcatgagccaccatgcctggccttatttttttatttttagtagagatggggtttcaccaagttggccaggctggtctcgaactcctgacctcaaatgatcaccccgccttcgccctccaaagtgctgggattacaggcatgagccaccgtgcccagcctacacgtatgcagatacacacaaatatacacacacactgaaacatgcatgatggtgtaatagggcctaaattattgctgtgtggctattcctaatcttgcccctttctcctggtttctaaggaacatcctcttctgggccagctcccaggttctccttgttgcacagaaccaaactaattcactaataagagcaggggaaaaaaaaaaaaaaaactaagctggacatggtggctcacgcctgtaatcccagaacttcgggagactgagccaggacgatggcttgagcccaggagttcgagaccagcctggacaacaaagtgagacactcatctctaaaaaagaaaaaaaaattttttttttaattagccaggcatggtgacacgtgcctatagtcccagctacttagaggctgaggcaggagaaccacttgagcccaggagtttgaggctgcagtaagctataagggtgccagtgcactccagcctagatgacagcacaagacctcatcttaaaaaaacagaaaaacagacagggtgtgatggctcacgcctgtaatcccagcactttgggaagccaaagcgggtggatcacctgaggtagggagttcaagaccagcctgatcaacatggagaaaccccatctctactaaaaatacaaaattagctgggtgtggtggcacatgcctgtaatcccagctactagggaggctgaggcaggagaatcgcttgaacccagaaagtggaggttgtagtgagctgagatcgtgccattgcactccagcctgggcaacaaaagcgaaactccgtctcaaaaaccaaaaaaaaaaaaaaaaaaaaaaaaaaacagaaaaacaaaacaacaacaaaactaaagaggcttgaggccaggcatggtggctcacacctgtaatcccagcactttgggaagctgagccgggcagatcacttgaggccaggagttcaaaaccaacctagccaacagggcaaaaccccatctcctctaaaaacacaaaaaattagccagacgtcatggcgggcacctgtggtcccagctacttgggaggctgaggcaccagaatcacttgaacctgggaagcagaggttgcagtgagctgagatcacaccactgcactccagcctgggtgacagagcgagatcccccatctcaaaaagaaataataaattattgttttctaaaccactaaattttagggttggtttgtgatacagcaacagatagccaaaatactagcagaaaagactctttggcttttgtcttatttctgcctggaatatgaacacaattcttgggatgcagccaccatcctgcctccacgaagaagaaaaccgcccataattaaaatggtagagcaggaagctagaagcctagttccttgatggcatccttgagcatctacagcagcctgaatagctgacccctggacttctttttaaacatgtgggaaaattaaccccttttatttaagtcattgcttgttggagtttctgtacttgcagcccagtgcaatcctaacactgagtaaaagtttgaagcagttttcattatattttggttgccaggctgtatccctatgactgggatactgcactgacagtgggccatatggaaccccagttatattgaggttacctatgtaggtactcaggcatgtacatgttaaaacacacatgcacacacatatgtgcatacacatacaaataacatataaacaaacacacatgtacaaatctatactcatacatgcaaatgctctcatatatacatacaagcacttgcatttacatgtcatctacacgtgcgcacacttagaaacatatacacacgtttcaggtaatgtctgggatcaggctgggaatctaaggttctatgagtctctagaaggactaatactacttcaccttcacactcacagaaggcccttccgggccgggcatggtggctcacccctgtaatcccagcactttgggagcccaaggtgggtggatcttgaggtcaggagtttgagatcagcctggccaatgtggtgaaaccctgtctctagtaaaaatacagccgggcgcggtggctcatgcctgtaatcctagcactttgggaggccgaggcaggcagaatgcctgagctcaagagttcaagaccagcctgggcaacatggtgaacccccgtctctgctaaaatacaaaaaaaaaaaaaattagtcaggcatggcggcgtgcacctgtagtcccagctactcaggaggctgaggcaggagaattgcctgaacctaggaggcggaggttgcagtgagctgagattgtaccactgcactccatccagcctggcaacagagaagactctgtcccaaaaaaaaaaaaaatacaaaaattagtctattaaaaatacaggcgatggctcatgcctgtaatcctagcacttcaggaggccaaggtgggcggatcacctgaggtcaggagttccaaaccagcctgaccaacatggtgaaaccccatctctaataaaaatacaaaattagctgggcatgttggcaggtgcctgtaatcccagctactcagaagtctgaggcaggagaatcgcttgaacccgggagaaggggaccgcagtgagccaagattacaccactgcactccagcctgggcaacagagcgatactccgtctcaaaaacaaaaacaaaggctcttttttagagcatcggcaagtgacctgtgaatcaccagtttttgcctcatgggggcaggcaagaggtgtggcatcgagtgagaccaagagatttggatgctggacgttaaccagccctcccagccaatgttgggcatttgcttggcattgaacctaggctgtcactaggacccacagcccaagcttgtaatgcatatagcagttaagcatcacctccaacaatgcatatcccacttgaccaaatatgctccatttagccaccaccatcactcaggtatcttgcaccttccaaagcagaaaggactaccaggattgaggcaagtgccaccctttctggttgtgtgatctcaagtaggttacttcccctctctgtcctcatctataaaatggaggtgagccgggaacgatggctcatgcctgtaatcccagcactttgggaggccgaggcaggcagatcacctgaggtcagcagtgcgaaaccagcgtggccaacatggtggaaccccatctctacaaaaaatacaaaagttaggcagggcacagttgcttacacctataatcccagcactttgggaggctgaggcgggggaatcacctgaggtcaggagttcgtgaccagcctgaccaacatggagaatcccgtctctactaaaaatacaaataattagccaggcatggtggcaggcgcccgtaatcccagctacttgggaggctgagggaggagaattgcttgaacctggaaggcagaggtttcagtgagccaagatcatgccattgcactccaacctgggcaacagagtgagactctgtcaaaaaaaaaaaaaaaaaaaaaaaagttagccaggtgtggtggtgggcgcctgtagtcccagctacttaggaggctaaggcaggagaatcacttgaacccaggaggcagaaattgcagtgagccaagatctttgcaccactgcactccagcctgggcgacagagcaaaactctggctcaaaaataataataaaataaaataaaatggaggtgaaataataggactttgcccattgggcctctgtgagagctaaataatattgcacagggaaagcactcaacacagtgctgggtacacagtaaacactcagtaaatgttaggtggtttcagtattatcaatgaactgttaaaggctgctcagatgtgaaggatgtaaccttccatggccctgataaaaaggttaccagacatctcagagctccagcagagtgggaagagacgagaggatcagtgagtccaacaacctcatctcacaatggagaatctaaaggtcagtgaggaaaagggcctagttcaaagaggaccaggactggaacgcagggttcttcctcagaccaagttcatccccagatgtgagctgcccagaggaagaagtgagaagcaaagcacaccatcatctccatggcttcactcaggcttccagtcaatctattttttaagcacctactatgtcctggcattgtgctggtcattcgtacaacacagaggtgtctttccattggtcccaccacctgacgccagggcatctgtccatctgagttgctcccaaccccagccttacctgggctccgggtcattgggggtgcacctcttcgagacatatgccatcttcaaggacatgtgtttggcctcgctgaagttccggggtgtggggccaggggaggaaggctgccgctgaaggggtgaggcaggaggtgagtcccagccgaccgaggtcccaccagtagagttcttgaaatacggtgagacgtccttcatatacttgactgattgggagagacatcagcagtcaccactgtgacatgggctcccagcacatatcacaattgtcactaatttattaagagtttaatttacgtgtcactattagacccttagtaagcaagagtccagtagtgatattaacaaattcttctaagttaaagtctctgacagggcagtggagcagaaaatactgtatcccttctctctatccctatatagagatagggcccgcctatatcccttctctcattttccccatggttaatagacatacagccacctggaagaaagactctatttcccagcctcctttgcagtgaggtgtggccatgtgacttttttttttttttttttgagacagtttctctctgtcacccagactagagtgccatggtgtgatcacagctcgctacagcctcaatctcccagatcaatcaatcctcccacctcagctccccaagtagctgggtctacaggtacgcactaccacacccagctattaattttttgtagagatggggtcacgccatgttgctggtcttgaactcctagacagtgtatacaagaaggtggttacaagactttcccaggctgggcatgttggctcatgcctgtaatcctagcactttgggaggccaaggcgggcagatcatttgaggtcaaaagtttgaaaccagcctgaccaacatggtgaaaccccgtctctactgaaaatacaaaagctagccgggcgtggtggctcgcacctgtaatcccagctactggggaggctgaggcaggagaatcacttgaacccgggaggaggaggttgcagtgagccaagattgtgccactgtactccagcctgggtgacataacaagactctgtctcaaaaaaaaaaaaaaaaaaaaaaaaaaaaaagactcccaggctgggcatggtggctcatgcctgtaattccagcactttgggaggccaaggcagtgtggatcacttgatgtcaggagttcaagaccaccctggccaacaaggtgaaaccctgtctctactaataatacaaaggttagctgggcagggtggtgcatgcctgtaatcccagctactcgagaggctgaggcatgagaatcacttgaacatgggaagcaaaggttgcaatgagccaagattgcgcactccagcctggacgatgaagtgcgactgcctcaaaaaaaaaaaaatgatgactttcccaagaccttgtctctcttctcccaacaaggatataccctctgtgggtgcctgatgcctgctagcccgtgggcagcctctcttcctctgctctcaaccacacctgctcccagggccatctggcttgctagctatctgacgtctgcagtcaaagcccagccaacgtgccctgtgagtggacagcccaggaaggagttaggaagtaattcttggcccacctccctggaagaaccagataagaagctatttctgtcgcaggagatgcctctgaggctcagataggattcaaagcaaatggaggcaaataagagggagttacaaaccctattggggttgggatagaagcaatgttgaaagaaaccagggtcaggtttttttgggagaagcaagcctgggtctgacttttggggactaggactcaaatgacttatcatcactgtagcaacgacttaccccaggactgactattggattatgtctcaaagggcagcagaagtgggacatatcacagcctacttgacagccaaaaaccatctcccctctttttcctttgctaagagaaccctgagccctagaggctcagcttctccccagcttagagggagaatcttgattggtcaaatcaaatcatgatcattccatcctttttgcttgtgattggtttagaaaggggcaaatgatacagttctggccaatgagatgtgaggaaaaaaacactgccttccttttctcctcctttagcctttcaaagttgctgggagggagcttgttcctagtgcaacgacagccactttttttttctttcttttttttgtgacagagtctcactctgtcgcccaggctggagtgcaatggtgcagtattggctcactgcaacctctgcctcccgggttcaagcgaatctcctgcctcagcctcccaagtagctgggattacaggtgcgtaccaccacacccagctaatttttgtatttttagtagagatggggtttcgccatgttggccaggctgatcttgaattcctgacctcaggtgctccgccggcctcagcctccaaaagtgctgggattacaggcatgaaccactgtgcccagcctactttttgaccacaaagtttgggatccacacattgaggatggtgaagcagaaagatggagagacctgagttttcgatgataccatgagcccctaaattaatcttccctggagccatgctgtctcaagatgttcgggaggataacacattttctttgatgtttaaacctcattgaattggattcctgttacttgcagtcaaaagcatcctgacaaatacagcccccaatggtgcaactgctacatctccttgctacaagtggccacgtcctgctcaaagccctgctctgcctcccctgcaccctttgcctaacttcaatgccctctaggacatgggccctgcccacaggtcctgtcttcctccctggcttcacttcttgccatatccctaatctcaccctctggtccaatcacactaactactcagaggctgtatgagcttccaaacttccacactattgaaaatgcagttcccggccttgtgcggtggctcatgtctgtaatcccagcactttggtaggccacagtgggtggatcgcttgagctcaggagtttgagacgagcctggccaacatggtgaaaccctgtctttactaaaaatacagaaaaaaattagctgggcgtggtcgtgggcacctgtaatcccagctacttgggaggctgaggcaggagaattgcttgaacccgggaggcggaggttccagtgagccaagattgcgccactgcactccagcctgagggacagagcaagaccccgtctcaaaaaaaaaaaagaaaaagaaagtaaaatttaaaaaaaaattagccaggtgtggtgacacatgcctgtgattccagctaatcaagaggctgaggcaggaggatcgcttgaacccagcaagcagaggctgcagcaagccatgattacgccattgcactccagtctggtaacagagtgataccctgtctcaaaaaaaaaaaaaagagaaagaaagaaaatgcaattccctctggagtcagatgctcttggatttgaattccagctccagcactgtctaactgtgtaaccatggacaaggtcatttacctctctgggcctcaatctgctagtcagtaaaagatgaatagggctgggcacagtggctcacgcctgtaatcccagcactttgggaggctgaggcgggaggatcacctgaggctgggagttcaagaccacctggccaacatggcgaaaccctgtctctactaaaaatacaaaaattagccaggccatggtagtgcacacctgtaatcccagctactcaggaggctgaggcaggagaattgcttgaacacaggaggcaaaggctgcagtgagccaagattgtgccattgcactccagcctgggcaacaagagtgaaactccgtctcaaaaaaataataataaaaataaaaaataataaaataataaaaataaaagattaataactacagccagacatggtggctcacgcctgtaatcccagcactttgggagcccgaggcaggcagactgcttgagcccaggagttcaagaccaggttgggcaacatagcaaaaccttgtctctaccaaaaacacaaaacattagccaggcatggtagtgtgcgcctgtagtcccagctactcgggaggctgaggtgggaggattgcttgagcccaggaggcagaggttgcagtaagccaagattatgccactgcactccagcctgggcgacagagcaagaccctgtctccaaaaaaaaaaaaaaaaaaaaaaaagtctgcctcagagagatgtcaggattaaataaaatgttgtaaggcatgtggtgagtattaaggactcaagaagcaggtgtttctcacttatcagcctttcttgcccatacttcctaggtctccgattctgtgtgttagggttgtctcctccacaaaactgggaactcctaaaagaaattgccgggcacagtgcctcacgcctgtaatcccagcacttgggaggccgaggcgggtggatcacgaggtcaggagatcgagaccatcttggccaacgtggtgaaacctcgtctctactaaaattacaaaaattagccgggcatggtggcgtgcacctatagtcccagctactcaggaggctgaggcaggagaatcgcttgaacccaggaggtggaagttgcagtgagctgagatcgtgccattgcactccagcctgggcgacagagcaagactctgtctcaaaaaaaaaaaaagaaaagaaaaagaaagaaactgggcttgctcttcaaacccagagttggctgggcagtagctcacgcctgtagtcccagcacttggggaggctgaggcaggcagatcgcttgagcctaggagtttgagagcagcctgggcaacatggcaaaaccctgtctctaccaaaaatacaaaaaactagctgggcatggtggtgtgcatctgtagtcctaggtacttgggagggtgagatgggaggctaaggtgggaggcttgcttgagcccagaaggttgaggctatagtcagcctggataacagagcaagacccatttcaaacaaaccaaccaacccagaatcagtgttctgtgaatggaaaaatgaatgccagggcaggacaggctcatttagcaggagggaagaggtgccatagcccaggagacaggcccagctcagaggtcacctcagaagaggtgatcagatgctcagtctggatccatcacacccatcacctccgcagtcccctacgcctcactcccctgtgattgtctgtgtagggtctgtgtccccaactaggctgagagcactttgagggcagggacctggtctgactcttctctgtgtccccagaatccagcagagatctcatacgctacatgctcagcaaatgaacatttgtcaactttgaagccagagaaactgccagatcccctgctcgcccagccatcccagatctgggtccccctcctttcccacaggaacatgctataaatggacagcataccagctgatgccagaatcagggcttgcatttcacaaaccaagtggcctgtcccagagtgggggtggggtcctgggggccccggagtgtggccataaatagcccaactctgaggcctcctcccctctctgatttctgcctgagtcacccgacaaggcagggtggggctgccaaagcctatggcctagagagctgagggcacgaccacagccctgtggccagcattctcgagactccaaagataggcccggccagtgcccccaccctccccagccaagcccctggcctgggagcctgataagcagtgacacatgggcccttcctcctcagggaagctgaggcacctataaacagaggccccaatttccagggagctccagctctgccaaggagggaagccaggatctggctctggccccaaagagccaggaatagattccactggaaacacatggaagagaaacagggcaggatcactcatcaggcccagtataagtggactgggggtcacatatgcgttgctgagagaagggaacacatctgtttgggcaacaggatctccagtacttatcccagtgcttaataaatgtctgtgactgaatgtcctggctgaagggaagcctgtcctctaagctcaagctgttccttgtctgttcagtgggtggtcatttacttaccgctgcttgaaattagatgatagagccatttgtttactagcccatggcctttctcccctaaccagaatgtcagttcccggagagcaggggctgccctgttttccagttcactagggtatcctcaccatcaagaatagtacctgacggccgggcgcggtggctcacacctgtattcccaacactttgggaggccgaggcgagtggatcacctgaggtcgggagttggagaccagcctgaccaacatggtgaaaccctgtctctactaaaaatacaaaattagctggatgtggttgcgcatgcctgtaatcccaactacttgggaggctgaggcaggagagtggcttgaacgtgggaggcagaggttgcagtgagccaagattgtaccattgcactccagcctgggcaacaagagtgaaacgccatctcaaaaaaaaaaaaagaaagaaagaaaaaaaaagaaaatagtacttgacatataccaagtaagcagtaaaagaaatctgggccaggcacagtggctcacacctgtaatcccaggactttggaagccttaggtgggaggattgcttgagcccaggagtttgaaaccagcctgggtgacatagggagaccctgtcttgaaaaaattaaaaaaaaaaaaattttgagacagggactcactctcacccaggctggagtgcggtggtatgatcacagctcactgcagtcttgacctcctaggcttaagcgatcctcccacctcagccttccgagtagctgggatcagaggctcatgttattatgcctggctaatttttttattttttgtagagatggggttttgtcttgttgcccaggttagtctcaaattcctgggctcaagcaacccacccatctcaacctccaatgtgctgggattacaggtttgagccaccgtgcctggcctacaaaaaatttttaaaaactaggccgggcacagtggctcgtgcctgtaatcccagcactttggggggccgacgcgggcagatcacaaggtcaagagattaagaccatcctgactaacacggtgaaaccccgtctctactaaaactacaacaaattagccagaagtggtggcacacgcctgtagtcccagccactcgggaggctgaggcaggagaatcgcttgaacccaggaagcagaggttgcagtgagccgagatcacgccactgcactccaccctaggtgacagagcgagactccatctcaaaaaaaaaaaattagccgggcatggtagagcacacctgtagccccagctactcaggaggctgagatgggaggatcacttgagccagggaggtcaaggctgctatgatcatgcaactacactccggcctgggtgacagaacaagaccctgtatctataaataagtacgtaagtaaataaaagaaaaaaatgtgttagatgaataaacactgaaagccctggggcttctcagtgtggagcaaaaacattgaaagtgggtctggggccgggcatggtggctcacacctataattccagcactgtgggaggccgaggcagggggaatcttttgagcccaggagttcaagaccagcttgggcaacatagcgaaaccccatctctactaaatatacaaaaaattagccaggtgtggtagtgtgcagctatagtcctacctactagggaggctgagatgggagaattacttgagcctggaaggcagaggttgcagtgagccatgattgtgccacagcactccagcctgggccacacagtgagaacctgtctaaaacaaaaaggaaagaaagaaagtgggccctggagtgaggcaggcttgtaataacgtccttgctctgtgaccttgaacaagtgacttgacctctgcgagcctctgtttccttattttaaaaatggaagggccgggcacactggctcccgcctgtaatcccagtgcttcgcgaggtcgaggcgggcagatcaactgaggtcagaagttcgagaccagcctggccaacatggtgaaaccctatctccactaaaaatacaaaaaaaaattagccaggcatggtggtacatgcctataatcccagctacttgggaggctgagacaggagaatcgcttgaatcagggagacagaggttgcagtgagccaagatcgtaccatggcactccagcctgcgtgacagagcaagactccgtctcaatcaatcaatcaataaaacattaaaaaaaaataaaagtaaaaatagaagtaaaatatatctactttaaagggtattaaaagattcagctgggccaggcgcagtgactcacgcctgtaatcccagcagtttgggaggctgaggtgggcagatcacctgagggcaggagttcaagaccagcctggccaacatggtgaaaccctgtctctactaaaaatacaaaaaaattagccaggtgtggtggcacacgcctgtaatcccagctacttgggaggctgaggcaggagaatcgcttgaactcaggaggcagaggttgcagtgagccaggatcgccccactgcactccagccagggtgacagagcgagactccttctccaaaaaaaaaaaaaaaagattcagctgcaggttgggcacagtggctcatgcctgtaatcccagcactttgggtggccgaggcgggcggatcacttgaggtcaggagttcgagaccagcctggccaacatgatgaaacctcgtctctcctaaaaatacaaaaattagtcaggcatggtggcagacacctgtaatcccaactacttgggaggctgaggcaggagaatcacttgaacccgggaggcagaggttgcagtgagccaagatcgtgacattgcactccagcctgggtgacagacatctcaaacaaacaaacaaaaacaaaaaaaaagatttgtctgggctcagtggctcacacctgtgagcactttgggagttcaaggcaggacgatcgcttgagcccaggagtttaagagcagcctggccaacatggcaaaactccgtctctaccaaaaatacacaaaattagccaggtgtggtggtgcacacctataatcccagctactcaggaggctgaggtgggaggatcacttgagcccaggaggttgaggctaaagtgagctgtgattgtgccactgtactctagcctgggtgacagagagaaaccctgtctcaaaaaaaaaaaaaaaaaagccaatttaaaaataaataaataagtgaaagattcaatacctgtaaagcaccttctcctgcctggcatagaacagggctgtctggagatagcagtgtggttatgatttctgctgctgttcctagtgtgacagtataaggggataggcatgtaatgtggtgacaggcagacaaggatttgaatccaggccccgtaatatcacttgcatgaggcaaggtctctctgagcctcagtttctttgcctatataatgggcactgatatgtcaaccctcaacttgaacttgaggattcaagttccagctgcccacccatccacccaggatggtgtgaagaggacttgggattccaacaggccctggaagggatgacctttaaggtcttgctggtctagcaaggctgaactataaatagtccccagactctggcaggccctataacagggatgaccagcagagcccaggggttgccacactttgggggataaaatctcaccttaccacacccttgagtagtacaggggttacaacctatacaaaatcccaaaagcatgtgacccttttgacctaacagcaacccttccaggaaccacccttcagatgagtgctcacaggtgcacagaaggcttatagcgctattgtccatcctgcaagaggctagggacaacttgaatattcatgaataggggctgctaaaaacaagatgtgaactccctgactggcagacactcactactcagtcttgttcatagctatatccttggtgcctgcatctagtcctggcacagagcaggggctcagtaaatatatgttacatgaataaacaaatccatgggatttttttttttaatttgtagacatggggtcttgctatgttgtccaagctggagtgcagtggctgttcacaggtgcatcatagtgcactccggcctcgaattcctggcctcaaacaatcctccaacctcagcttcaggagtaaataggactacagatgtgtagtcctccagcccaataatgggacaccacataaccattaaaaagaatgaggggccgggcacagtggctcacacgtgtaatcccagcactttgggaggccgatggtgggcagatcacctgagctcagtagttcaagaccagcctgggcaacatggcgaaatcccatctccacaaaaagcacaaaaatttagctgggtgtggtggtgtgcacctgtagtcccagctattcaggaggctgagatgggaggatcgcttgaatccaggaggtcgaggctgcagtgagcaatgattatgccactgcactccaacctgggcaacagagtgagacactgtctcaaaaaaattataaaataaaaaatattaaaaagataaaaaagaatgagacttacatgttctcaacttattacgtgataaaagcaaatatggaaacttactggaagaaaatgtgtgaaagtatcaacactggttatctctataagatgatccctttacactctcgttggtaattttttttttttaagagacagtgtcttgctttgttgcccagattagagtacagtggcataatcatagtttgggtacagccttgaactcctgggctcaagcaatcctcctacccagcctcctgagtagctgggattacaggtgcacaacactatgcccagctaatttttaaaaaattttttggccaggcacagtggctcacgcctgtaattccagcagtctgggaggccgaggcaggtggattgcttgaggtcaggagttcaaaaccagcctgaccaagatggtgaaaccccatccctactaaaaatacaaaaattagccaggtgtggtggcaggcgcctataatcccagctacttgggaggctgaggcaggaaaactgcttgaacctgagaggcaaaggttgcagtgagccaagatcgtaccactgcactgcaacctgggcaacaaagcaagactcggtctcaaaaaaaacaaaaattttttgtaggccaggcacggtggcttatgcctgtaatcccaggactttgggaggccttaggcagatcacttgaggtcaggagtttgagacttggccaacatggtgaaaccccacctatactatatacagaaattagccaggcatggtggcacatgcctgtgatcccagctacttgagaaggtgaggtaggagaattgcttgaacccaggaggtggaggtttgattgagccaagatagtccactgcactccagcctgggtaacacagtaagactccacctaaaaaaaaaaaaaaaaaaaaaaaaaaaaaaaattgggtcaggcatagtggctcatgcctgtaatcctagcactttgggagtccgaggcaggtggatcacctgaggccaggagtggcgaaaccccatctctactaaaaatacaaaaattagccagatgtgttggtgcgcgcctgtaatcctagctactcgggaggctgaggcacgagaatcgcttgaacccaggaggcagaggttgcagtgagccgagatcatgccattgcactccagcctggccaacaagagagaaactccatctcaaaaaaacaaaaacaaaaacaaaaaaattgtagagacgaggccttgccatgttgcctaggctagtctcgaactcctggtctcaaggaatcctcccacctcagcctctgaaagtgctggaattataggcatgagccacttatttttttttcgagacagggtctcactctgtcacccaagttggagtgcaatggcacaatctcagctcactccatcctccacatcccaggctcaaatgatccttcagcctcagcatcccaagtagctgggactacaggaatgtgccaccatgcctggctaatttttgtaacttttttttggagagacagggtttcgctatgttgctcaggctaagctggatatttttgaatgagtatgtattactttttaaattttctaaaaaatctagtttatttttcaaaaatataccaccacataccaagccatacaagccatagttcagagataatgctcgtatcaactcggaagcctagattcagggttctagaatcttagtgatgggagaaagcagtacttattgagcgcctactatatattggggccaagctcaactctctcgaacacaccttcaccttatttcaccaatttgatgagatgaattaatatccttatttatgttcatttttattacttttttctttttttttttttttttttgagacggagtctcactctgtcgcccaggctggagtgccgtggcgtgatctcagctcactgcaacctccacctcctgggctcaagcaattctcctgcctcagcctcctgagtagctgggactacaggcacgcgctaaattttgtatttttagtagagacggggtttcaccatgtttaccaggctagtcttgaactcctgacctcaggtgatccacccgcctcagcctcccaaagtgctgggataacaggtgggagccaccgcacccagccatagtatctttatttaatgggtgagtaaactgagtctcagagaagtgacataacctgtagtgcagataagtatttaagaaaatgagttttcgccgggcgcagtggctcacacctgtaaatcccagcactttggaaggcagaggagggcggatcacatgaggtcaggaattcgagaccagcctggctaacatggtgagatctcatctctactaaaaatacaaaaattagccaggtgtggtggcacatgcctgtaatcccagctactttagagactgaggcagaagaatcacttgaactggggaggcgcagattgcagtgagccgagatcgtgccactgtactccagcctgggcaacagagcgagactccgtctcaaaaaaaaaaaaagattatgggttttcagccaggcacactggctcacacctgtaatcccagcacgtcaggaggctgaggcaggagaatcacttgagtccaggagtttgagaccagcctggacaatatagtgagaccctgtctctacaaaaaatcaaaacaataatagctgggtatggtggcacatgcctgtagtcccagctactggagaggctgtggtgggaggatcacttgagcccaggaagtcgaggctacagtgagccgtgatcatgcaactgcattccagcctgcatgacagagtgagaccctgtctcttacaaaatttttgtttttgattaaaatatatatatatgagttttggcatctgaaagacttgagctcatattccatctctgccatactgtgaccttgggcaagtaatgtcacctctctgagcttcagtgttctcatctatacaatgaacaatgtacctaattcacagggatgacattgaggattcaattaaataacatagggaagggccgggcacggtggctcacacctgtaatcccagcactttgggaggccgaggcgggtggatcacctgaggtcaggagttcgagaccagcctggccaacatggtgaaaccccatctctactaaaaatacaaaaaattagccaggcatggtggcacgcgcctgtagtcccagctactcgggaggctgaagtaggagaatcgcttgaaccagggaggtggaggttgcagtgagccgagatcgtgccactgtactccagcctgggcaatggagcgagactccatctcaaagaaaaaaacaagcatagggaagggacttagcacagtaggtgctcatggtgttgagcacagtgtggatgctcaataagcagcagatgctaccatcctgattattatcactattatttcctccaccaccagcagcagccagggtcacacagctcgtcagggccagaacctgcctacagaggcccacaagacattttaatcaaggtccggggaacaggccagggctggattaagccaagttttgtttgtggggagtcacatggtccaaagctatgcgtgtgcacagccaagtaaacttttccttgagaacaatggtcagaacaacaggtctttgcggccatgggagaactgaacaggagttccattcatgccctcttcctgggacaggggtccctccagcatctctggggcacagcatgactcagctaagttgaaacagggtggccccaaattagctacatccagaatgacatcccgcttttgacagtggtgatgcatcaagccagatcaaaggcaggacacctggcagtggccatcttcctgggaagagccagtagggagctggccttagagttctgaggactcagaacagaaaagctcaagagtcagtcaagctcagcatgattctcaagtcccatcttaaacatttaggaaagtcaacagcaattgaaaaggtgaaaggtaaagtagaaagggtccaagatataccccactgatcagtctccaaacactcaccaagatctaatgtatgttgggctcagtgccagacctgggggctgagagacaagctacatgtggttcctgccctcaaacagcttccagtttactaaagaaaacaataacaggatcaggcgcagtggctcatgcctgtaaccccagcactttgggaggactgctagagcccaggagttcaagactagcctggacaacacagggagaccctgtttctattaattttttttaattaggcaggtgtggtagcacatgccgtcgtcccagctacttgagaggctgagataggaggatcgcttgagcccaggagttgaggctgcagtgagctgcaatcacacctctgtgctataggctgggcaacagagtgagatcctaaataaataaataaaagcctgatctctatgagggctataccttccttactttatataaagcactaaaattcactttattaattttttttttttgagatagagactcactctgtcacccaagctggaatgcagtggtgcaatcttggctcactgcgacatccacctcctgggttcaagtgattctcctgtctcagcctcctgagtagctgggattacaggtgcctgccaccacgcccagctaatttttatatttttcgtagagatggagtttcaccattttggccaggctggtctcgaactcctgacctcaggtggtccacccacctcagcctcccaaagtgctgggattacaggcgtgagccaccttgcctggccttagtattattttttgttttttgtcgggtttttcttttttcttttttttttgagatggagttttgctcttgttgccccaggctggagtacaatggttcgatcttggctcactgaaacctctgcctcctgggttcaagcaattctcctacctcagcctcccgagtagctgggattacaggcgcgtgtcaccatgctcagctaatttttgtatattattagtagagacggggtttcaccatgttgcccaggctagtctcgaacccctgacctcagttgatctgcctgcctcagcctcccaaagtgctaggattacaggcatgagtcaccgcgcccagccagcattatttttaatgcatgacaggctcactgttgtcacagtcctgccagccacactggaatgggaggagggaagggtgttttccttgaggctgtccctccctcttcccccaggcctggccttcaagggcccaggctggccctggcttgaggtctgcacacacaacgggcctctcgaagcagcggacagacacttgttggctgccaacttgggcccagactgtggtcacaaacacacccctctggctgagaacaggatcaggacatttctgcaaacccctgacctagtagaagaaatgttctaggaggcaggttggggttgctgaggctcagctgagcccccaacttaggccagggaagtaaggctctagctgacacctggagtttgctggtaatgcttgttctcccaggacatcctcaggggattcactatccactgagctggaaaaatatccagttgccttgccaagttcacatccaaaggacaggccatccttccatggccccttggaggcgtcctcagtaatgggatgtgagtggggaaatgttgaacaatgtggtcagtgattcaactccggggaaacctaggcccagagagggtcccaggaaccctggctgctccagactggtgcaactgccaggcccagaccttctccactccccaaagtctcaaggaccagccacagcccagcatcctcctatccttcagacctctctgatcactcttgccattcagagattcctgactccagtgccttccaccactcctcctcccctctttgtgctatcttgagtggaatgacctccttccatgagatcttgggccaggagaataggtcgaaaaagacttcaactaaggaaaagtggggaaaaacatgaaggccacattcttctttctcttacccaggccataggcagggttcaccaaggaatgatctcgtcctgtgaaacatctcagagaatataagagcaggggcccctcagtcctgggatgatacacatgttacttctctactgcatctgtagtagacattgctaatcaattccagctcctttctgctgagcccagacaaagcctcccaatccttccaaatatggaactcacagaaccaccagtggagctgacgcttacactcttttttttttttttcctacagagatgaaatctcactgtgttgcccaagctggtctcgaactcctgggctcaagtgatctgcccacctaagcctcccaaagtgttgggattacaggcgtaagccaccacgcctgcctggagctgccactctaaataaaagctattgatcacctctgatctagcctaacttcaataggaaaactgagtcccctagaaggcaagggtcttacccaaggccaaacagagatttattgcagagcagacaggatttcaggcaccagctttttttttttttttttttttttttttgagatggattcttgctcttgtcgcccaggctggagtgcagcggcacaatcacggctcactgcaacctccgcctcccgtgttcaagattttcctacctcagcctcctgagtagctgggattacaggcacgcgccaccatggctcagctaatttttgtatttttagtagagacggggtttcgccatgttggccaggctggtctcaaactcctggcctcaggtgatccacccgcctcagcctcccaaagtgctgggattacaggcgtgagtcacagcacctagccaccggcttttaaagagtttctgtaggccaggcatggtggctcacgtctgtaatcccagcactttgggaggcccaggcaggcagatcactgaggccgggagttcgagaccagcctggccaacatggcaaaaccctgtctctactaaaaatacaaaaattaaccaggccgtggtggtgcacacctgtaattccagctacagaactgaggcagagaatcgcttgaacctgggagaaggaggttgcagtaagctgagatcgcactactgcactccagcctgggcaacagagtgagaccctgcctcaagaaaaaaacacagtttgtgtagaggagatagtgtttatgttttgtctaccctaccacatggtgagctccttcaggagaggccctgggtgtagtttagcttctgaccttaatatacacagcaggcacacagtagatgtccatgaatgtctcttggcttagtgaggaggaatgcatgacatgagttagagggaaggcttgagtattcactcctaaagtcagaagatgcttcaaggtcacacatttacagatactaccttctcaaaacgacatacatgggaacccagatagatacatttttaatctaaagatgaggaggtgggccgggcgcggtggctcacgcgtgtaatcccagcactttgggaggccggggcgggcagatcacaaggtcaggagatcgagaccatcctggctaacacggtgaaaccacatctctactaataatacaaaaaattagccaggcgtggtggcgggcacctgtagtcccagctacttgggaggctgagcaggagaatggcgtgaacccgggaggcggagcttgcagtgagccgagatcccgccactgcactccaacctgggtgacagagcaagactctgtctcaaaaatataaataaataaaaataaaaaataaagatgaggaggtgaggggacctccgtgtgaatgtggatttgaattgtgtctatagcagaaattttaccatagactaaactttcaaacaacagaagctaaaagagctttcaagtcaactaaaatatgacatttcgatgaatgtcagtggtttcaaaccgcattgctgactataaatatcaaagtaatgaggcatgtggggaaagtctcttatatccatatcatttatgtggcattctattatttaactttgccattaaaatatgattgatacacttaagcttctaaggatcaacactctagagtcagctttttttaagtatcaaaaaaatgcatctagactgggcactgtggcctgcaatcccagcactttgggagacttaggtgggaggatcccttaagcccaggagttggagaccagcccaggcaacatggtgaaaccctgtctctacaaaaaattggctaggtgtggtggctcacgcctgtaatcccagcactttgggaggccgaggcaggcagatcacgaggtcaggagttcgagaccagcctggccaatatggtgaaaccctgtctctactaaaaatacaaaaaaaaaattagccaggcgtggtagtgcgcacctgtagtcccagctactcggaaggctaaggcagaagaatcgcttgaacctggaaggcggaggatgcagtgagccaagatcgcgccactgctccagcctgggcgacagagtaagactccatctcaaaaaaaaaaaaaaaaaaaagctaggcgcaggggctcacacctgtaatcccagcacttttggaggctgaggcaggtggatcacaagctcaggagtttgagaccagcctggccaatatggtgaaacctcatctctactaaaaataaaaaaattagccgggcatggtggtgggtgcctgtaatcccagctactcaggaggcggaggcagaagaattgcttgaacccgggagacggaggttgcagtgagccgagatcatgccactgcactccagcctgggcaacagagtgagactccatctcagaaaaaaaaaaaaattaaccaggtgtggtggcatgcatctgtagtcccagccactcaggaggttgaggtgggaggattgtttgagccccggggggtggagggtgcattgagccaagatcatactactgtactccagcctgggtgatagagcaagaccctgtctcgaaaaaaaaaaaaaacaagaaaaaaaaatgcatccatggcatttaaatagatatacctaaaatataaaataaaactttacattttattttctttatttaaattttattttattttatatctgggtcaaccaaggaccgagaacctatttgcttctgtggcctcttggacactcctttagggaaaccaaggcaacccaccaggatttgggcctgggactcaactcagcagcttctctggccgtgttattctccatcagcccccgccacctccctgtgcctgttctgggccataagccagagacacattcctcaggcccccacggggcttccagagctgacagagtttgaggaaagggctgagcaaagcagaaacctcttgagagacatggcacaagatggtcatgggacaacctcagcaggaggcgtgtaacaactgatggggaaaccgaggcccacagagggcaagggtcccacccaagaccacactgtgagggaacagtggagaaagccattcaaccaaggttcctccacaaaactcctctctgatcctggctggaaggatttgatgtcctactctataaaagccaaggcctctgggcgtggtggctcatgcctgtaatctcagcactttgggagactgaggtgggtggatcacctaaggccaggagttcaagactagcctggccaacatggcaaaaccctgtctctacaaaaatataaaaattagctgggcatggtgacgcacacctgtaatcccagctacttgggaggctgaggcaggaggatcacttgaacccaggaggcagaggttgcgatgaaccaagatcatgccactgtattccagcctggacaacagagcaagattccatctcaaaaaaaaaataaagtaaaataaaagccaaggcttctcccaaaggaggatgggtcttggggttttaaggcccaggcactaaaagaacctgaagtcaagagctctccaggccccacaggaaagaatctgacctgccccttccccagtccgcacccctctctccctgtgtcactcaggtgctggcacactctgccatgtacatttttgccctagtcgcaacaacccagaaaggcaggagctacatccctgttttacaaatgaggaaactaaggatcagggaaatgaagtgacttgtccagggctacacagctagtgactggaagacagaaaatgcaaatcaggtctgcttggctctatgccaactctccctccaccaccccacactgtcttcaggcaggtccccaaattctgtttctgttttcagtcctgcccacctcccagcccccagtgctgggatggggccttctgaggcctgggggaggtagagaagcagtggaacacctccacccagcccctctgaaccctggaacgtcagtgcttaccctccagcaccacctccttgcctgtcttcttgaggacctgcaccgcctcatcatgggtagcagaggacaagtcttccccattcacagacaggatggcatcccccacaaaaagggcctctgtctggtcagctgccaatcccttgaagatcttggaaatgagaataggcatcttgttctcccggccgcctgcacaggtacagaaggaggacaagacttaggcagatactccaacacttgggagtcacatcaagacacaattatttctgaaggcttcccttggtgcctagcccagtgctggaaaaggcaatgggagaataaagggaatctgagaaaaatcttggaagtttgggacactagtaacactaataataaatcatttttgattaggtccggtggctcatgcctgtaatcccagcaccttagaaggctgaggtgggcaggtcacctgaggtcaggagttcaggatcagcctgggcaacatgggaaaaccccgcctctactaaaaatacaaaaattagccaggcacctgtggtctcagctactagggaagctgaagtaggaggatcacttgagcccaggaggtcgaggctgcagtgagctgagattgtgccactgcactccagcttgggtggcagaaggagaccctgtctcaataaattaattaattaaataaatcattttcaaaattcataatgctatagtttgatccctggatcttttgattaagtgctttgggtgttcaccagtgtttgtgcaacttacaaagtgcttcaatcactttttcttaaatgttttcgattttctcatgtaacccataaatatatatgcctactatgtacgcacaaaaattaaaaatgaaaataaccggacaaagtggctcacacctgtaatcccaacactttgggaggccaaggtggtcggatcacttgagaccagtagtttgagaccagcctggccaacatagcgaaatcctgcctctactaaaaacacaaaaaagggccaggtgcggtggcttatgcctgtaatcccagcactttgggaggccaaggctgccaggtggatcacctaaggtcaggagttcgagaccagcctggccaacatagtgaaaccctgtccctaccaaaaatacaaaaaattaactgggcgtggtagcggatgcctgtaatcccagctactcgggaggctgaggcaggagaatcacttggacccaggaggcggaggttgcagtgagctgagatcacgccattgctctctagcctgggcaacaaaagtgaaactctgctcaaaaaagtaaataaatacataataaaaaaataaacaaataaaaaaatatggctgggcgtggtggctcacgcctgtaatcccagcactttgggaggccaagatgggcagatcacctgaggttaggggttcaagaccagcctggccaacatggcaaaaccccatctcttctaaaagtacaaacattagccgggcatgggggcgcatgcctgtaatcccagttactcgggaggctgagtcaggagaattgcttgaaccgggaggctgaggttgcaatgagccaagattgcaccattgcactccagcctgggcaataagagcgaaactccatctcaaaaaataaataaataaataaataaatacaaacacaaaaaattagctgggcctggtggcacatgcctgtagtcccagctactcaggaggctgaggcagcagaattgcttgaacccaggaggtggaggttgcagtgagccaagatcacaccactgcactccagcatgggcgacagaacaagactccatctcaaaataaaacaaaaatacaaaaattagccaggcatggcggtgtgtgcctataattccagctactcaggaggctgaggcacgagaactgcttgaacccaggaggtggagattgcagtgagccgagatcgcaccactgcactccaccctgggcaacagagcaagactgtctcacacacacacacaaaaaggcaacaatgtgggaacccactgatacccctcaaaccggaatcaagagacaagtcggctattcctatggcctcaaaagactgctttagcaatcataatgttttacaatccaaagtccaggctggaaaccaaagccttagagtctagagattctaaaaacctgcctgaatggcatcttggatacaaaagaagctaatacattttactaaacatctttattaccaaactcttaaatgcccttttaaaataagaaatagtaataagagttcaccttagttgcacttaccaaatgccaagcactgtgctaaatgctttcaatgttgattcattgcgtctttacaataccccatcacataggtatgttcagtttcctattagggaaactgaagtgtggagggaagccccttgtccaaggtcactccactagtaagtagcgaagccagtatttgcacctaggcctccaggctccagaaccaacactattagccctaccacagacgacaagtcaggccctcagatatcacactcctggctcatccccagaatactgaagatgaagaattagtggcccagagtgggaggtcattgttccaaggtcacacaagtctggtggcggagctgggactggaacacctctcttgacgcccacacaggcccgaccgtttgcttatctgcacagagcttgaagtctaggagaggaaggggtttctatttatatctgccctcccccacctgaaactaggggcttcagttcagtttgaagctatgatcactcatggctgcctcagactaagctagactttataggaggggttaccatggcaacaggagcccagatttggatccaatggaaatacctgaagtctcctaaaagtaccctcccctccacctagaattatggagctggggagtaactttgtgtgaccttgcaaagtccctgctcctctctgagtctcagtgtgtccatctgcagaatggaattctgtatgaataagttccttcctgctttgacacactgagtgtataatttttggattcatctgttgccctatcccatgctggagattgggggtaagactggtgcccataccctcattttctcatttctcctttttagcccctcttggttggctgcctggggatctgcccttctacaggaaagaatcaacttccctgagcactctctgagggacagtagctgataattaaggttcaaatcccagcactgacactcactatgtaatcgtgggaaaatcattttaactttctgagtctcagtttcttcacctgcaatatgggaattatactccctacctttcaccacttgttgccaggatgaagtggatcatgagactagtgtcctgggcacagcacctggcacacagtggtggcattcaccaccatccccaccgcctcagccaagccaaacggtctggaggcactagtcaacagaaccagtaccagggagaccccagagggtacggtatgtattcaaggtggagacaaaggctgataccctttcccaaagcacctgctgggggctgggaccctgagaaacagatgggcaggaatagtgaacccagcagctgggggtgtgcaaggattttaacaactatgtttagttgctttgggagtatctgctggcctccatttttcctctccgctaacagcagtaattaactaggcacctacagtgtgctggtgtggtgagccctgctctcagaaacatcacaactctgtcatcctcttatacagttgaggaaacagattcagaggcgggacgggacttttgcaacctcacacagctgatcctggattcaaacacagtctggttgcaccctaactgcaccccactagcggtcagtcctgggggctgaaagctctatcctgtgcaaggtggagatagtcagatcaggagacccaaatccagctgtcagggctccctgcagccttcctgggtccttagattcctaggtccttgctggccttctgcctgtgaccccagcctgtgcctgcacccaggcctcctatccacccctgtgcttcccagactccaggcttcccctctgcacccaccttggttgcttctcagggactccctcctccctgtcccactggtgtcccggcctcaaccccctttctccacactctgctttccgggggacccctcttgtccttgatgttcatgctggttacccctcagacccccccgcctccacacagaactcccacccacgtgtccttggtgctcccacaatcttatccacacctgtgtcttccgtgccccctaaggccaccaactactgaaaccccctccaaccttggtgtgcccagtgccctccgttacctgtttcctcagaccccccttacccccagacaggaagcctccagctccatgtcctgggcgcgctgccagccccctgcgccctcggctgcccccagacaccacgaccccgcgccctcggtgtcccgcgcccacctttgatgctgatgcccagcccaccggcgtcggccttgcgcaccgtcacgcggcgccgctggagcagtagcgcctctggcagctgcgggggcccggcgcccggctccgcggcgccgttgagctgcgcgggctcctgctcccgcggagcgccgggctcgggaccagggtcgccgtcggcggggctcacggtcagcacgtcctccgccagactcagcagcacccgctgccatcgctcgccgccggcccccgagcccgccccggcgcgcagctccagcagcccggtgcgcggggcgcgcctgccggacgccatcttcgcctccgagcccccgggccgccgcgctcgccctgtcccgctttgcccagcccgctccgaccaagcgcccagggcagagggcagcgggggcccggctgggccagccgccaccctaccccggccgctgggggaggagctctgggggcggggctaccctggggtgtggccagtgctggggagggggcctcgggcaaatgcaggaggccggggcggggcccgggagccgagggccgccgtgtgggactacctagcggggtgggtcagaagggcggcggggcgggccactaagtaaggcgaaagcccgggaggcgtggtgctgggcggggcgtcagggggcggggcttcgcgtcgggggcggaacccagtgagcccgcgcagggggctcggcgctcggaatgcccatcgagggccgggactgtaactcccggacgtgggagcgcatgaaaaagagacagaaccacgtatcctggtgcgaagcactgggcatcgggctgggctgcatatggcggagggctgggctgcgtatggtagagcgttggactccaaggcttgagtttaagaggtagacaccgtctgggcgtggaggctcacgcctgtaatcccaacactttgggaggcctagatgacagcccagaagctcgaggctgcagtaagccgcgatcgcgccactgcactccagcctgggtgacagagcgaaaccctgtgtcaaaaaaaaaaaaaaaaaaaaaaggtagatgctgagccgcgagagaccttgcgggcacagttgctagttggggagctgaggaagaagttggtttcctatcggggagggcgggggatggggggtgggggtcgaggctttggtctgtgggcgtggcttatcgctggcgtggcttctaaagatgacaggccccgccccctggaggagaccgctaccgacaccgcttagggcttgggggaggtgtgggcaggatccccacttcaaaactggagggaagtttaagagattaacccctggctgtgttcacagtcgagtatagaaaagcctgaagtcccacactttgaggcctggcagaaaaaaaacagaactggtgtgtgggaagagggttgcaaggtggggctctgggtctgggcgactggagacatggtttctaatctttgctgcctctgttagctccaagtcgactttggtcccctcacgtcactgctctaggcctcaatttcctcatctgtaaaatgtggatcataataatacctacttcactgggctggtgtgaggattaaatcaatgtgaaaacacgtggtaaactgtgactccctattctatagaaataatcactttcatttagtgaatgcttactcttacctagggctggcagaatattttccaagtgttatctttacattagcctcctggagtagctaagagcacccccagctgggcacagtggctcacacctgtaatcacagctgaggtggcaggatcgcttgagccttggaggtccaggctgcagtgagctgtgattgcaccatcacactccagccttggtgacagagcaagaaaaaagagcacccctattatacagaagggaaaacttggatttagtctaattggcctaggtcacacatttatgagtgaggaagagctgcgattcaaacccaggcctgtttgacaccagtgcctgggcactgaaccactctgctagacagctgacaaatacagaggtaaagcatgattgtaatctgaaaaatccaccacatcacacagctcaactggccttcatacctgctccttgtctctatcctccattcctagctgggatatgttgagcaataaataagtaggactacaccagtgtttagcctccctgaacttttgggtaaaatcctccacataagataccatcaagaaaaaaaagagggggccaggtatggtggctcatgcctgtaatcccagcactttaggaggccgaggcaggtagatcacgaggtcaggagtttgagactcagcctggccaacatggtgaaaccccatctctactaaaaatataaaaaaattagccgggcgtggtggcagacacctataatcccagctactcaggaggctgaggcaggagaatcacttgaacccgggaggcggagattgcagcaagcagagattgcaccactgcactccagcctgggtgatagggtgagactccgtctcaaaaaaaaaaaaaaaaaaaaccaacaacaaaaaaaaggaattgttttaagttagagtggtaggtgtcaaaacaggagagacacaggttttaaaaaaagaacccagggtcttttatacatatatatatgggatgccgaggaggaatgatcacttgaggctaggagtttgagaccacttgggcaacttcacgagactccatctctacaaaataaagaaattagccaagcgtggtaatgtgcacctgtactcccagctacttaggaagctgcagcaggaggcctgtttgaggctgctgctgtgagccacaatcatgccactgcactccagcctgggtgacagagcaagaccctgtctcaaaaataaataaaagaaagtgagaggaaggaaggagagaagggaggcagggaaggaatatagcattgtatataagcattgatatcttaaaagtatgactgtgcttaaagattgtaggacagcctgaggaatttggggtaagcacttgtgataaataactacagcctacttggcttgtggaagcttcactccaatggtagagaagggaggggaggacagacctggcaggaggcaagagaccagcagggaattgaagctcctttcccaagaccaaagcctggaaccagatccttaaaagtccccccacgtactgccctgcttaaaaaagacttaatgaggcccagacaaacttactgagaaagagccctaagagagggcttctcctctgggggacagtttcctgtggatataacaggaaggaaggaagtagggaaaggagtgatgtgtgcaaaggggctaacacagaaagaagatgtagagccaaggaaacagtgacgtgtgtatgcatatgtatacgtctgtatgtgagtatgggtgtgtgtgtttgtgatcacacttgataggcagtgccaatcacctgtagctacccccaagaaccctgtagctgcaggaatgctctatccctacactgtggtcagccgatgcctctctgctgtggctcagaaattggcctcccagatagatacacataggcccggctccctgccaagccccaggcagagctcccagagaaaaccagttcactcccaaggaataggagagggggaaggggaaaaaaagggagagaggggagctgcccagcctactaaagtctctgcaagctctggccaggcgcggtggctcacacctgtaatcccagcactttaggaggcctaggcggctggatcacctgaggtcaggagttcaacagcagcctggccaacatggtaaaaccccattctctacaaaaatacgaaaattagctgggcacggtggctcaagcctgtaatcccagcactttgggaggccgaggtgggcagatcacgaggtcaagctatcgagaccatcctgaccaacatggtgaaaccccgtctctactaaaatacaaaaacttggctgggcacggtggctcatgcctgtaatcccagcactttgggaggccgaggcgggcggatcgcgaggtcaggagatcaagaccattctggctaacacagtgaaaccccatctctactaaaaatacaaaaagaaattagcagggcgtggtggcgggcgcctgtagtcccagctactcaggaggctgaggcaggagaatggcgtgaacctgggaggcggagcttgcagtgaaccaagatgtgctgctgcacctcagcctgggtgtcaaagcgagactccgtctcaaaaaaaaaaaaatctatgcataaatcctaaacaatctactgtttagttttacattttttaacatcacataaatggacatttctccttctgcttttggaagttatattctctagttgtattaagagcactctattatcttcaattacttactctcccaaattatttgctatgttgttaagtatttagcgctaaatatttttctttttatttatttattattattatttttttaagacggagtttcactcctattgcccaggatggggtgcagtggcgcgatctccactcactgcaacctccgcctcccgggttcaagcgattctcctgcctcagccttccaagcagctgggattacaggcgcccgccatcacacccagctaatttctgtatttttagtaaaaacagggtttctgcagtgaaaccccatctctactaaaaatacaaaaaattggccaggcatgttggtacacgcctgtagtcccaccttcttggaaggctgaggcaggagaatctcttgaacccaggaggcagatgttgcagtgagctgagatcacaccactgcactccagcctgggtgacagagtgagactctgtctcaaaaaaaaaaaaaaaaagggggtttcaccacgttggccaggatggtcttgaactcctgacctcagatgatccgcccacctcggcctcccaaagtgctggaattacaggtgtgagccatcgcacccagcctctttttatttagttttttattttattttattttattttattttgagactgagtctcactctgtcacccaggctggagtgcaatggcactatcttgactcactgcaacctctgcctcccaggttcaagcgattcttccaactcagcctctagagtagctgggattacaggcacatgccaccacgcccagctaatttttgtatttttgtagaaacggaatttcaccatgttggccaggctggtttcaaactcctgacctcaggcaacctgcccgcctcagcctcccaaagtgctgggattacaggcatgagccactgcacccagcctgaaggtggcaggcaaagctttctatcaaagaaggccaaatgcctcttgcccaatctttaattatctcttaaattagaatatcttactcaaatctccatgtctcttaactttctttcatatcttctctttacttttttccatactgcattctgagtaatttcttcagtgatatcttccagtttactaattctttctttaactagaactaatctactgtttatcctattctttgaatttaaaatatcaattgttacttttttatttctagaaattctactttttttttttttttttttttgagacggagtctcactctgtcacccaggctggagtgcagtggcacaatctcagctcactgcaacctccacctcctggattcaagcaattctcctgcctcagcctcctgagtagctggggttaaaggcgcatgccaccacatccagctagttttggggttttttttgtttgtttgtttgtttgtttgagatggaatctcacactgttgcccaagctggagtgcagtgtcacgatctcagctcactgcaacctctgcctcccagcttcaagggattctcctgcctcagcctctcaaatagctgggattacaggcacctgccaccacgcccagctaattttttgtattttcagtagagacagggtttcactatgttggccaggctggtctcaaactcctgatctcgtgatccacccacctcggcctcccaaagtgctgggattacaggtgtgagccaccacgccctgccataatttttgtatttttagtagagacagggtttcaccatgttgatcaggctagtcttgaactcctgacctcatgatccgcctgcctcagcctcccaaagtgctgggattacaggcataagccaccatgcccggccctacttttttttccacatctgtctgattatgtttatagtatctttttttttttttgagacagagtcttgctctgtcccccaggctggagtgcaatggcgtgatcttggctcactgcaacctccacctcccgggttcaagtgattctcttgcctcagcctcccaagttatctgggattacaagtgcccacaaccacccccggctaattttttgtatttttagtagagacgggggttttgccatcttggccaggctggtctcgaactcctgaccgcaggtgatccacccgcctcagcctcccaaagtgctgggattacaggcgtgagccaccataactggcatagtctctctattctttacccatgcttttgatacccttttgaaatgtatttaaacctatgaattgtacttattttatattatctatatagtagttcttttttgtttttattttatttatttatttatttttgaggcagggtctcactctgacgcccaggctggagtgcaatggcatgatctcagctcactgcaacctccacctcccaggttcaagcgattcttctgccccaggctcccaagtagctgggattacagacatgtgccaccactcgcaactaattttttgaatttttagtggagacggggtttcaccatgttggccaggctggtctcgaactcctgacctcaaatgatccacccgcctcggcctcccaaagtgttgggattaaaggtgtgagccaccgcgcccagcctctttttgtttttaaagagacggggcttgctttgtgatgcagactggagtacagtggcatgatcctagcttcctgcagcctctaactcctgggctcaagacaggcgagccccaaattgggccttagcctgggaaagttcttggcttctcccaggaaataattcaaaggtgagccagtggtatcagacagcaacttttattgaagcagcagcgtacagcagcagcagagggactgcccttgcagaggagggttaacacacaggcagtgtgcccagaagagtttcatatgggctgggggcagctgtatttatacccactttttttttttttgagacggaatctggccctgttgcccaggttggagtacagtggcatgatcttggctcactgcagcctctaccccactgattccagagattctcctgcctcagcctcccaagtagctgggattacaggtgtgtgccaccacacctggttcatttttttgtatttttagtagagatggagtttcactatgttggccatgaactcctgacttcaggcgatctgcccgcctcagcctcccaaagtgctaggattacagacgtgagccaccccgcccggcctagacccacttttaattatacacaaattaagaggcaagttattcagaacgttctggaaaatggacagtttctggaaccatataaggtaacttctgggccattgccatggccattgccagagcctttctaaactatcatggcactagtgggagtgtctttatgcaaatgagcagtgagggcaactagcggtcactttagtcaccatctgctgattttggctggcgtcttcactgcaccctggattgaccagtttctgctctgatcagcgggatggtgaccagtcataaccagtgcttggaaaacaaatcttgctgatctacctcaaaattcctgggttcaagctatcctcctgcctcagcctcccaaagcactgggattacaggcatgagcctatatagtaattctgattctgaagtgttggtggctctttttactttttcttttttaaaatttgttttaattggccgggcgcggtggctcatgcctgtaatcccagcactttgggaggccgaggcaggcggatcacaaggtcaggagatcgaaaccatcctggctaacacagtgaaaccccatctctactaaaaatacaaaaaattagccaggcgtggtggcaggcgcctgtggtccccgctactctggaggctgaggcaggagaatggtgtgaacccgggaggcagaggttgcagtgagccgagattgtaccactgcactccagcctgggcgaaagagcgagactccatctaaaaaaaaaaaaaaaaaatttgttttaatttactttaaatagaaacggggtcccactatgttgcccaggctggtctggaactcctggactcaagccatcctcccaccttggcctcccaaagtcccaagattacaggcatgagccactgagcccagcctttttcttaaagcaataaaagaatggctactccatagacagcagctggtggatcttttttcttcattacacatgtgtaatcttgtcaactacacagtttatatgcattctttgaggtctggtatgaagtaggttctattccttcagagaggatttgtgggtacttctgtcagatgcctgatgggacagccaacctaagagtgctttcagggccgggcgtggtcgctcacgcctataatcccagcactttgggaggccaaggcaggtggatcatgaggtcaggagtttgagaccagcctgaccaacatggtgaaacacagtctttactaaaaatacaaaacttagccgggcatgatggtgcgtgtctgtcatcccagctactcaggaggctgagacaggagaatcacttgaacccggaaagcggagcttgcactgacctgagatcgcgacactgcactccagcctgggtgacagagcaagactctgtctcaaaaaaagagtgctttcagtacttagcatgaggccagtcacggtggctcacacctgtaatctcagcactttaggaggccaaggcaggcagatcacctgaggtcaggagtttgagaccagcctggccaacatgatgaaaccccgtctctaccaaaaataaaaaattagccgggcgtggtggtgaatgcctgtaatcccagctacttgggaggttgaggcagaagaatcgctcggacctgggaggcggaggttgcaatgagcagagatcatgccactatactccagccaggtcatcaagagcgaaatgccgtctcaaaaaataaaataaaataaaatattttagcacgggatcttttgattcacacaaagagtagaaatacaggttgcaatcccatgtgaggttacgaattctcagagatgctttccccctctgcccaccatgttcacgatggagaaatttctttgctggtgccctctgcaagatttttgcagtccgctctttctttcttttttttttttttttttgagatgaaatcttgctctgttgcccaggctggagtgcaatggcgtgatctcggctcactgcaacctccgcctcctgggttcaagtgattctcctgcctcagcttcctgagtagctgggattataggcacccaccaccacgcctgagtaattttttacttttggtagaggtggggtgtcaccatgctggccaggctggtctcaaactcccgacctcaggcgatctgcctgccttggccttccaaagtgctaggattacaggtgtaagccaccacacccggcccagtccactctttcaatgaggatgcaggctttccagaccctggctttatgtgggggtcacctaacagctttttcaccctgggtgggccctgggtttctctcttgccccataattccaaatgtgcatcaaaactgaagctttgtggccgggcggagtggctcacacctataatcccagcactttgggaggctgaggtgggtggatcacgagctcaggtgatcaagaccatcctgaactgggtttcaacatggtgaaacccagtctctactaaaaatacaaaaattagctcggtatagtggtgcctgcctgtaatcccagctactcgggaggctgaggcatgagaatcgcttgaacccaacaggcagaggttgcagtgagtcgagataacgctgctgcactccagcctgggtgacagaacgagactctgtctcaaaaaaaaaaaaaaaaaaaaggccgggctcagtggctcacacctgtaatcccagcatttcaggaggccgaggcgggcggatc

SEQ ID NO: 13 - DNA, 1712 bp, Homo sapiens
ggagccacagtgaaagtcaagaatgtcagtgattccacatttaatatctacatttttgcagggcagttactcttttgtagtataacattgagctgatagcacatagtgtagacaagtgaatacaggattctctgggttgtattcccagaagtctggaggtcatttggatatttgtgggcccttggcttcactctgacttgtgtgacacataaaaattgtgatgaaatgtcctatagatgtcctgcaggtcttaaaagaacctttccaaactatgaaacagcccagcagcactgagttagaggtaaattctgaacccttgaacactaaaactattctaactgcacatagaattggcaagtagcattctatgtctatgaacagtatgtcttttctatataacagagaaaatctttttaagcaaactactcagtttaaaacctaattcttctcataatctcagtacttttgaatgaagacatatcaatgcaacagtacactcttattcaggcatttgaaagaaagaattcgagatctagtttgtatcagatattataaattagtatggtttagtctttgtcatgaaattctacttaatttttggactataggtttaagaatgtaagcagaagttctgcaccaatcagaataagctacattatgcttgagtgacaactactgtaatgacaaaatatcagtggcttaatacaatggtttttctctcatacttgttcataaagagtcagcaaggaccctgctcattatggtccctcagggacccaggttgttggaagctccaccattttagatagctcccttcaaagtcagccatctttgcagtcatgtcccccaacagctgcaaaatttgctctgatgctcaagaattgagcatcggcagttaaatgcttcaacatgaaagtgacacctgccactcccactcacatcccattggccagaactagtcacatggccagacctaacttcagaaggttggagaattgtaatcctccatgtacccaaaaagtagagaagccagatactgagaaacatcaataatggctaacagaaatccattctaccattccctttgcctaaagtgaaaagatgagtactttcatcaatttgtaaactgtacttttgaagtaaatcctggtagcttgcatgggggctggatttccagaaagccatatgtaatttgggaatgacattcacttaagctcatagaatatcattatttgatgtaaaatgccctcatttgcaatacaggaccaaaatgcactaaccacaaaattccactccacaagggtctgggttctaatttcttcattctttaaatgaggcattctatgatttggaatggaagcccagttgtagtcgtaagaattttacttaattcaagaattattctcactgaatatgtgccagttctgaaaggaatgcaaagtcaaattttgcatcttctttgctcaagggcctttagatgtaacaacacagacatgatacaaggctgacaatgacattatgatttaaatatgttaaacaacttattaaattgtgaatcaacaaaaaattatgttctttattttatggttttgcatagtcctgactcactgcctacatacccctcttgttcctcagttcttatccctgatttcttacaggatggcctaagacagctgtagatgtttttatttagcaaaaaaaaaaaaaaaaaa

SEQ ID NO: 14 - DNA, 2274 bp, Homo sapiens
ggcacgagggtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacaaaaaaaaaaaaaaaaaaaaaa

SEQ ID NO: 15 - DNA, 2510 bp, Homo sapiens
gcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttccgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaaaaaaaaaaaaaaa

SEQ ID NO: 16 - DNA, 929 bp, Homo sapiens
caaacaaggcccacactggacagggcagctgctgggttgctactctcgcctccgccatgattccgcccgcagactcttttgctcaagtacgacaccccagtgctggtgagccggaacacggagaaacggagccccaaggtcggctactgaaagtcagcccccagcagcctggaccttcaggttcagccccacagccacccaagaccaagctcccctcaactccctgtgtcccagatcctacaaagcaggcagaagaaatcttgaatgccatactacccccaagggagtgggtggaagacacgcagctatggatccagcaggtgtccagcacccctacgcaccaggatggacgtggtgcacctccaggagcagttagacttaaagctgcagcagcggcaggccagggaaacaggcatctgccctgtccgcaggaactctactcacagtgttttgatgagttgatccgggagtcaccatcaactgtgcggagagggggctgctgctgctgcagtcgggacgagatccgcatgaccatcgctgcctaccagaccctgtacgagagcagcgtggcgtttggcatgaggaaggcactgcaggctgagcaggggaagtcagacatggagaggaaaatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggcccaactggaaggcattattgcaccaaagaagtgataatttccacatgattaatttccaacaagacacttgggagttatttactgtgttcctctggcagccaataaaatcatcataagccctttgtaataaaaa

SEQ ID NO: 17 - DNA, 2082 bp, Homo sapiens
gtcaacaacccccgaggaaatttccaccccaatagaaacaacatatagaacggaacattcaggtccaccagagtgggcaacttaaatcctggagctaaaatatgggtacagtgtccatcagatcctgcccctaagactgctgaccttgtagctattggagcagaatatgaaggcacagtacaatttcctaaagatgaaaaacagtatcatgttcccctccatttttgttactacagagaataacctgtctgctagtaatcagcacctggatcaccatgtctgaggctgagaatgagttcatcaactgggtagccactgctgcaatagaagccaactgcagtcagtgctggctctgtgttgagttgccagaggccgctgggaatgggctaccttggagaattgtccctgctaacatttctgaatggatatgccaataccaatgggagtgggataacacttggttttgttttgattttttgagccagagtgtctctctgtcgcccaggctggagtgcagtggcacgatcttggctcagtgcaacctctgcctcctgggttcaagcgattctcctgcctcagcctcccaagtagctgggattataggtgcatgtcgccacgcctggctaattttttgtatttttagtagagacggggtttcaccgtattgcccaggctgatgtcaaactcctgagttcaggtgatctgccctcctcggcctcccaaagtgctgggattgcaggtgtgagccaccgcgcctggcccgggataacacttgaaatccaacctggacttcttttaaccaaacagtctatttttgcccttgcccaaacaaaacacagcacccttgttacttcaattacacattacagcgatacaattataggagaactcttcctgttccctggggggccctctaggtatgcgaatcctacaggtggcaatacctgcttggacggggagacacacttgggggtggccattaattccattcaccatctgggataatatttctctccccagtaatctagatgcttacaaacattgctggttatgaatgcgccggactccctggtgacggtaccctatcacagtattctcccctgccaccggtacaatcctgcttcagcaacaaattcaaacattcagcttacatgtagaaaaagctcttaatgatagtagcatggaacttatgttgtaatcagataaatttgctcagctgtgtactgtcatgttgcaaagtcaaatggcattaggtttgcttactgcagcccaaggaaaggtttgccccttactgcatcctgaatgttatgtgtatatccctgacaattctcacaatatgaatctccttgcgaagccatgaggggtgtggtttttattaattatgcttttagttctcctgtgcttaccctgtatctgtaatctatatcaattgtggcttccctgtgtatccgtaagagtattttcctacagttgagtatcagattgaggccaaatgtggaggaaaagttaaatattaaatttgaactcaattgaacatggacacaaacaatggtcaccaagtcccggaacaggttgtgtgagccccttgaggcattcatccagcgctgtttcagataaatctctatttcaatctattcctatatgttagttattgaaaaacaacagacaatcgcaaaaacaagttgacctttttgtgttccttgagcctggtcatgaagggccctcgtgcctggagctcatgccaaacaactcattacaaaagagctagggtcctagattgtgccgaagcttcatgagacctctcctcgtctgtgcacggacgagtggccgactctggagcccaggccgttgtttcctagtctggtggtgaatccgccatagtctggtgagtgcagtgtccgactctcgagcccaggctgttgctgttgcttcccagtctggtggtgaatcctccatagtctggtgagtataaatacatatatctcttttcctttctccccttcccattgcaacttgcttactatatcatttgcttattatatctgcattgccatttatgtgggataaagcttgtttaccctt

SEQ ID NO: 18 - DNA, 575 bp, Homo sapiens
ctggctcacaactttaattgattgctttccctccactgggcccaccgggtcggcttacatagctcatagctcagtgctgctgaaatagacccagggcaagaaaggtatgaacaaccagtgaatgccactggagcataaatgttcacaaaattgtagagaaggggtgacaagaagcaagcagtggggcagggagtgtcactgatgtccgaaaccccgggtcagaccaacacgcagcacagccactcggccagagagagctgaaccatgccatccttgtcttcgtccagaaggctgaatagtttgaagagggtctccaggcggatcatacaagccacgaagctgtcaaagttgatgccaagcttgctgcacgcattcccgaagggcaatggtctgctgcacctggctgttgagggtgaaacctgccttcctgagggctgtcctcatctcgtgggcatcgatggtgcccgagtggttataatcagtttcccaatagatctcctaaagcaggaaagaaatcccaagtagaaaacaaccattcacggcccctgccagaaccatctccctccaccacactg

SEQ ID NO: 19 - DNA, 485 bp, Homo sapiens
  modified_base (339)..(339): a, c, g, t, unknown, or other
  modified_base (459)..(459): a, c, g, t, unknown, or other
  modified_base (461)..(461): a, c, g, t, unknown, or other
  modified_base (470)..(470): a, c, g, t, unknown, or other
gttttgtcctccaaattttcctgtagcaaaatgaaattgttgtctcctatcagattatagcaatcctggcattattataaaagatttcccttatctaattggaactaagaagtgatatgttttaatctgagatatttctagactgacataaaaagtaaagttttgaatttggctatatcacttaacccataaacaagcttagtacaccttacttcagattccttatgaataaattctgactttgatagaaaaattaacacaagtttattgtatgttttgtgtgtcagaaattgtgctacatgatagaaaacacacagaaacataagattctcataaggntaaggactatgaaatataaggaaatcaataaaattagccaaaatgcctcatgaaaatgcaaatcatgttttaaatgctaaagagactcatattaactgtatagaactttatattcccacncnttatgaaantgaaccaccagtgaa

SEQ ID NO: 20 - DNA, 522 bp, Homo sapiens
tgccatttatttaaaacttttattaacgcttgaagaaaaataatgcaatgtgacaatgtacaggtcctgttgcctaaatccgtagtagaaacagatattatcacttagcaagctcacgtggtgccaattctgagatcagacggggttgttcctccttaggaagtggccactggaagcattgtttttccatgctatttccgtgaagccttttgcttggttcgagtttaaatttctccctttgtgtgagtatgactatagttctggcctggtgttttctatttatttagttttagatgtcagcattttactatacttggtcctctcacttcagaataacagggctatttattgatacaaaggagaggtgttcagatcatcttgttaagatgcagagctcaaaataaacactaaatctttatttggagatccacatccttcctcaaaggaaggctcatgagtaaatttgtatgcagtataaagcccaagtagagggtgtatttttaatgactactttgcttacat

SEQ ID NO: 21 - DNA, 526 bp, Homo sapiens
  modified_base (341)..(341): a, c, g, t, unknown, or other
  modified_base (395)..(395): a, c, g, t, unknown, or other
gctcttaaccacgtttattgagaggggccgggggaaggggatggacggtcctccccgcggcgggtatttcagccctcgcgggtgggcagcgtcttgtcctcaggtgtagatgctccagtctcggctcagccaaacactgtcagggcccccagcagggccttcagggcattcacggccccacggcctggggacccagctcagccacacacttctgggagccctctatgaggtggttcacggggatgcccaggctgctcagcaggagcttcagcgggttgagggtgccgagggggttggccagggtcccggccccgggctccggcgccgactccagcgcagancaggcttgggcacaggctttggcggagccactaagaaaagcagcagcggactgngaacaagggccacgcagagccccaggaaggggccgagctttcatggcgccggggctcggggcgcgccgggaacctgcggctgcccgggcaaaggcaagaggcttctttataccggttcttggccctcgtgc

SEQ ID NO: 22 - DNA, 293 bp, Homo sapiens
ggtcgacatcatcatcatcatggatttgctggtgcagtacaacttttttttttttttttttttggggttttccaaaaatgtttttatggttaaaatctgtacaaacagatatatttatataagttacatattttaagaaaaatcagtcatttttcatatataattgcaaagaattaagatcatttaactttagcactataagcaagcattaaattaaatgcactcagatttttggcacattatatggcattccttataccacatatttataagatctaaaggattataaacat

SEQ ID NO: 23 - DNA, 533 bp, Homo sapiens
tttaagtttccaggatggttttattaaagtcccatgctgtgttagaaacatacaagtgatgagaaaaacattaacttgaaacatgcacttactggcattctctaaaataccattatacaagttttcatttaattagaaaaatacccactaaaacaatcacagttcttcttaaagatttaaaaaaaatgtattggccagaacaaagtccaagagaataaacaaagttctgaattgtatgtcaaaaaaactgtacaaggttgtacataaaactatagcttacaaaagactcaggtatagtaagaattctgaattaagatttccaaagttctatttaccaatatctattaataaaatccttatgaaataattgacttagaaaaagtgaaatgctcatgatttcagagtgtatagaaaatactaaatatcactttccgaaataaagtgtactcaaaacagcacaacatacagtctaaaatcaagatttctgtcattcatttaaactttgcatatattgccatgatggcttaaacata

SEQ ID NO: 24 - DNA, 568 bp, Homo sapiens
aaaggcacagctttcccagtgtttgtgttccttgcttgcgccctgttttaatgttgtagttacaggtgtccagcagggaggaatgcagcccctgtgggcgcttgggggagctgctgggaatccaagttcaaggagcagctgttttctgttttctgttgccccacagcgccacctcctggccccttggtggtgatgattttgaagtcagcaggttctggtgggccgtgtgaactccagcagctctgggctgagctgtggaaacactgcgtcctttgaaataatacagctttcctgagcccaccccagtccctaaagactgcctctggggttgagattctgagatgcttgacagcatggcttttcccggtgttatgtgtcgtttctatccttaagcctgttaggggtggactggaggctggaccaagctccactggctgcaggaggacccttctgtgggctccaggctggccgtgtgcgtgtggggaggtgggatttgctgctaggcttcatgatcactgtgaagaagcagcccccaagaatagggtgataggccctccccatgtcaccg

SEQ ID NO: 25 - DNA, 743 bp, Homo sapiens
  modified_base (479)..(479): a, c, g, t, unknown, or other
gcggccgcgggctcctcgggccggtggcagttggcgccgtccccggctgaggtcctctcggtgcgcctggtgggcttcttgcccgcggacctccgggcaggcgcgggcgcgttctccgcgggcgcacagggcactgcgggtggcggggcggctgcgctcaccgccacggccacggccgcgggcggggacttctgcttcacgcctttactcccaggggccttgttggctgtccttggcctttgctcctccttgcaagtgctcttgatctccttctctctcaggctgggctggcaaacgtcggggactttcccacagtcctggacgtcctctttcaccgggttgtagtactgattgctctctgacccgtggctttcattttggatcagaataggaggcttgtggggattaactttgtttagccatttatccagctgccacttgttagaggatgccggttcagcctcggggctggagaagtngggggccttgctgccctcactctcgctggagctgctctcggtctccgagtcagatccggagctgctctctgagtcgctggaggagctgctgctgccgctgctgctgctggtgctgctgcccttgctggaagggcacgaggtttctgcatttgggctgctggaccaacggcgctgtcaagagagcgccggagagccgtctctgagctggctgctgtcaatttcctctttataactgcttagcttaagggatctttccaacattgt

SEQ ID NO: 26 - DNA, 2609 bp, Homo sapiens
tacattgggtctactgcacaaattacagggctccaagtgtcttatgagagcaggacttgggctgaccatgtctctctgccctcacccatgctctgctctgatttcaggtcctaagtgtgaacgtgaagtccccagccctgctgctgagccagttgctgccctacatggagaacaggtatggcagggcgggggtggggaccagtcggagttggggacctgaggtgggcacagaaatacagtcggtagcacagccagtagtgggtagaggacagaagaggtctgggatctccacatccctcatcttcttgtcctgcctccccatctgtgtggctgccattcccaattccagtggctgcaggatgagagtagtattccaggggcccaggcatagcctccttggccttgacatcagcaggtttgggacaaggctatgctttaactccttgaccttgtgggctggtcattgtcaccttacctgctctctgttcttaccaacttaaaaccaatgacagggttagccccattcctctccataggaaaaagcctgtcccagacctctcctcatgcctgcgcttggtctccagggaccctgcctgtgttccaggtcctgcagatctgactgtacccctcacagacacacccttaggaactggccaggggctgtcttcagtagaaggaaagtccctgactgtcacttctggtctcccttaccccatctgctccttagaggttgctcattgataggcactcaccatcagccttgggtgcctcttcacaaagcccaccctgccctctccttcaagcccctggcaagagaggaagcagaagataagggttctgagcatggacatcgtatttatgagaaataggcatggaatcctagctctgccgtgtattggctggtactaaacctttctgagcctcagttttctgaactctgagatggggacagtaataggacctgtgttgcttctgtgagggttgcatcatttaatgaactcatgatagtgtcaccatcagtggtaagctcttagcttcagcttctcttatgtttgtcttgtctcaggaggggtgctgtcatcctggtctcttccattgcagcttataatccagtagtggtaagtgcttggtccttgtgctcctgagtggtatagggtgaggggcaactttgttcttttcctcagagccttacagacaaagtgcctgggacagacccccaccatcctcctgctgccctgggctgagcttgtctccatgtgggtgggagggctgctgggcctgtgagatccctgtaggtgagaaatccaactgatgctttcccccactctcccatatcctaatcactctgtcaattcccttcccaggcgctgggtgtctacaatgtcagcaagacagcgctgctgggtctcactagaacactggcattggagctggcccccaaggacatccgggtaaactgcgtggttccaggaactatcaaaactgacttcagcaaagtggtgaggattgggtgtgtcttccatctcccagtctggctcagtgggaacccttcccagtgaataagggatcaaggggtgactgaatccttaggtcagcatgcctatgactgaggtcctcattgttctctgaactcagccatggtgcagtccatccatcctgaaaagatgctccttcttttgagaagggcaaagctgccctaggtgttctgcctggtggccttcccggggccctgcccatcttgttttagtagcactgactccttcatttcttccctttgcccagtttcatgggaatgagtctctctggaagaacttcaaggaacatcatcagctgcagaggcaagtggggtttggagatttggtggtccatgtgtggctaggcaggggcagttgagtctattgcaagagcagacccctccctgtcatctggccattgtttttgctgaaatctggagtccacatggccctggagggtgcaagtagccctgctgcatccaccttgttccccatggagcccactcccacctgtcatccgtgagccccagagcagcagaatcagagtacgagatgcttgacactgtgtccttcttccatccaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctgaggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaaaaaaaaaaaaaaaa

SEQ ID NO: 27 - DNA, 683 bp, Homo sapiens
gagcagggctctgccttccagcagatctgagaggagtcccatttggctccttcctagctgccctccattctctaagacctgtaaaacagggatggccagagggctcttgttgcacagtaagtgctatgcttcctaaatgctagttcctgaaatagaatggtttaacctctacttactaaacacctgctacaatcctgttaattcttttgacatgtaagactaaaataaataaataaataaataaatataaaaaaaaaaaaaaaaaaaaaaaaaaaaaaaaaaaaaaaaaaaaaaaaaacaacaacaaaaaagaagacaggcgggaaagaaaaaaaaacagaagaacaaacaacaacaacagcagcgagcggtgggggcgcggcgcacgccgccgccaggagaacaactgttaacccccaacacagtggtgggggcgggcggcgcgccccacagggagtgagtagcaaagaggagggtgaatatcatgcggtcgctccgagagaacagatgtcggggcagacagaacaaagcagcgcgggggctcacacccccgaaaataaaaaaagccggggcgggcaaaaaaaggggggtctgggaaacacccgcggagaggggtcgcgacgagcgcagaggggggtactaacaaagggggggccacagagacgcgtaataaatagccccgc

SEQ ID NO: 28 - DNA, 398 bp, Homo sapiens
gatgctggggctggtcctggccttgctgtcctccagctctgctgaggagtacgtgggcctgtctgcaaaccagtgtgccgtgccggccaaggacagggtggactgcggctacccccatgtcacccccaaggagtgcaacaaccggggctgctgctttgactccaggatccctggagtgccttggtgtttcaagcccctgactaggaagacagaatgcaccttctgaggcacctccagctgcccctgggatgcaggctgagcacccttgcccggctgtgattgctgccaggcactgttcatctcagtttttctgtccctttgctcccggcaagctttctgctgaaagttcatatctggagcctgatgtcttaacgaataaaggtcccatgctccacccg

SEQ ID NO: 29 - DNA, 427 bp, Homo sapiens
  modified_base (2)..(2): a, c, g, t, unknown, or other
  modified_base (267)..(267): a, c, g, t, unknown, or other
  modified_base (280)..(280): a, c, g, t, unknown, or other
  modified_base (386)..(386): a, c, g, t, unknown, or other
antttttttttctgcaactaatacacatttattagaactttttcagcagcattatttccagttgtttatctaatcaaagtaattacagtcagcactcaaaatatcagcaacaaatattttgagaactctggaataaaataatcagtagtatatgtttcattcattcatccatccatccatccatccattcattcattgtttaacaaatgtgcaatattagcacagagagtcaggtatgctatttgctatgggaaagtgtatattccngccatgggttccngttgtgcagactatacccactatttaagagggagagctgggaagccaggggcacagtgggctcacggcccgtaaccccaaccactcaggggggctgagggtggggnggggtcacttgaggcccgggggctttcaaggttcagccttg

SEQ ID NO: 30 - DNA, 2248 bp, Homo sapiens
cccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcaggtaaagctccagatggctctggaacttatgaggaaagagttggaggacgccttgactcaggaggccaacgtggggaaaaagactgtcatttggaaggagaaagtggaaatgcagaggcagcgcttcagattggagtttgagaagcatcgtggctttctggcccaggaggagcaacggcagctgaggcggctggaggcggaggagcgagcgacgctgcagagactgcgggagagcaagagccggctggtccagcagagcaaggccctgaaggagctggcggatgagctgcaggagaggtgccagcgcccagccctgggtctgctggagggtgtgagaggagtcctgagcagaagtaaggctgtcacaaggctggaagcagagaacatccccatggaactgaagacagcatgctgcatccctgggaggagggagctcttaaggaagttccaagtggatgtaaagctggatcccgccacggcgcacccgagtctgctcttgaccgccgacctgcgcagtgtgcaggatggagaaccatggagggatgtccccaacaaccctgagcgatttgacacatggccctgcatcctgggtttgcagagcttctcatcagggaggcattactgggaggttctggtgggagaaggagcagagtggggtttaggggtctgtcaagacacactgccaagaaagggggaaaccatgccatctcctgagaatggggtctgggccctgtggctgctgaaagggaatgagtacatggtccttgcctccccatcagtgcctcttctccaactggaaagtcctcgctgcattgggattttcttggactatgaagccggtgaaatttcattctacaatgtcacagatggatcttatatctacacattcaaccaactcttctctggtcttcttcggccttactttttcatctgtgatgcaactcctcttatcttgccacccacgacaatagcagggtcaggaaattgggcatccagggatcatttagatcctgcttctgatgtaagagatgatcatctctaaaattctgttcccaagatgcagtcctagcgtagcgaacgttcctggagtggggtgaaggatatcaatatactaagttttaacagataccccatttaggtcagcacttgattcgttgttgctgtgaaatatgtccatgggacaaaagagggaatatgaaatatttgcatatgggaagattatagagcataataattttgtaaatggagcaatctcaacctctatttctagatcacattttcttgatgtcttccttcaaattaatgaccttggattacataaggatttctatgcattcattataatttgttattcctttcaatatccttgtatttcaaatcttccatataagaattagacatggcaattcttaaattgattcagaatggtctgatactattccagtatcacctccttaattctgtttctcctcgttttcctgattttccttctcattctctccttccccgctctgtctctctctccctgtcactctctctctctcgttccttattttttgtttcttacctcttactgtttaacctgttgcttccttctggattaatacatttagagccattcctttatatggtcacatttcctatgactttactcaattacttttaaaatcctttctattctgagactaatttttaagaattacaaagctcattcttctgaatctaatatcactaactcctagactttttccgttttctttggatacactttaagtaggaatttatcagaattttcattcaactcgttctttaatgcagatatttactggttataagaccttaaggctgggtgcagtggctcacgcctgtggtcccagcgctttggggggctgaggcgggtggatcacaggctcgggagttcggggccagcctggccagcatggtgaaaccctgtctctactagaaaaaaaaaa

SEQ ID NO: 31 - DNA, 2627 bp, Homo sapiens
gctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttg

SEQ ID NO: 32 - DNA, 540 bp, Homo sapiens
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacggggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaaaaaaaaaaaaaaaaaaaaaaaaaaaaaaaaaaaaaaa

SEQ ID NO: 33 - DNA, 2071 bp, Homo sapiens
aggcatatcacttctctttttaaatctcttagactctcctgcacacaggaaggaatctaaggtttccctatgggcaccagactccatgtaatctagtctttggccacctctgatctcatctgctaaaatcatttcaatctctccttactcagtccatcccaagccatccctggaaggtttcatcccaactggttctcacatccagtctttgcacttcagctgtctgtcccttgaatgcttccacaaaacatagcaggggaactattatttaggcctctgttcaagtatcacctccttcaagtggtctttcctgactgtccactctaaggagcctcccttctgtcaccatttagctgtatttccctttacttacagcaaaattgtaactagataatgcattacatgtttttctgttgcatgtatattctgtttctttctcataaatgtaaaccctcctatggcccaaatcttcatttgccttttcaactcctttatctccagcatgtggagcacacttggtacacattaggagctgaaatgctccatagctgctgaatcagtagcaccaacatgtgtacccaccaccttctcaagtgtggctttataagatgttcatcatggttgagtgaggataagggaaagaatagtctgtttcttttatgatatggtttggctgtgtccccatgcaaatctcatcttgaattcctatgtgttgtgggaaggaccctgtgggaggtcattgaatcacgggggcaggcctttcccatgctgttctggtgatagtgaataagtctcacaagatctgatagttttaaaaggaggagttcccctgtacaagctctctctctttgcctgctgccatccatgtaagacgttacttgctcctccttgccttccaccatgcttgtgagatcttcccagccaagtggaattgtaagtccattacacctctttttcttcccagtcttgagtatgtctttatcagcagcctgaaaatggactaacacattttatgattggtgcaaattggctactgataaaaatcctgatgataggaaaatttcaaatttccttatagtaaaaatactacttaatttaatttttagagacaaggaaaaacattttgcagagtttggctccactattgaaaaagggatgctttaggttgaaccattgtagcctcagattctatcttttcctaaataaacacattaaagcctcatgtgtgaaattattttttaaaaatatttatctggatttaaagaataacagatcaacagatacctctcaatgtgtttgctaattaataaaaatcagtttcttacaactaatgtttgtaagaaaatgttcattttaagtgctaaatagtgaagaaaatttatcacctaaaatacacccatcaatataaggcaagaaaaaatcttaacatgcagccattcgcttttgccatgccctgtcctgtttacttcttaagaggtttatttttgtacttttgcagaataaactttagtaatctagaactggaaggtactatatatgtatgtgtgtgtatatatatatataaaagaaaaacatatatatatttcaattacttgaaatgtaaaaacttaccgaatacaaatggaaaaagtgatgtgtattatatcatattgctttttgtccatctttgtgatttatttactcacttcatgtttttcatttacaaaattgtcaagctagccaaaataattcttgttttcttaattgggagagaagagacctgacagattatctatactcttcatatgttaaaagaccatttcctgtaaaactgacctagtgcacaaactgaatttgaaatagactgtgaagtaaactataacttgtccttttaattttgtttaacatggttactgacttacatgatgtattgaatatcaagataaagaaaaatgtgtctaaaagctaattagaattctctgggtcaccaagtcaaggtgctattgatctgggttaatctgagtaacttattgtctagcctataaataagttccaaaatatcgaattcaaaaaaaaaaaaaaaaaaaaaaaa

SEQ ID NO: 34 - DNA, 617 bp, Homo sapiens
  modified_base (11)..(11): a, c, g, t, unknown, or other
ttaaacatcangtttatatacttttattaatacaggacacacattataagtcacacacaaaaagagataaaataattagataaaataacataagaatttgaatattttcttcttttgcctaagatatattcagcttgccccatgtattttatggccctctttctgctaataacaataacacactaaaaaatacttgctctgagtcatcagatggagtcttccttcaacaaggctcttcaggtcattggtgctatgaaggagaccccatcagactaacagtggatttctcagcagaaatcataaaggccagaaaacagtggaatggcattttcaaaatgctctttccattgcttttccataccactgcttttcccaggactggagacttggtttccagctctttgcacctcctccagcaatgtcttttttgcagatgtgcttggccttaattccatcaacagtgtcctgagactgaggatagataaaatacttcaggtcaaagcagagcctttttttttaaaaaaataatcttttactgggaggtggcaagagacccatttcttcagaattcctgtatggctcatattctgtgtcagggattgtgggaaagacaattc

SEQ ID NO: 35 - DNA, 1286 bp, Homo sapiens
ggagcgcgcggtccgggcacacggagcaggttgggaccgcggcgggtaccggggccggggcgccatgcggaggccgagcgtgcgcgcggccgggctggtcctgtgcaccctgtgttacctgctggtgggcgctgctgtcttcgacgcgctcgagtccgaggcggaaagcggccgccagcgactgctggtccagaagcggggcgctctccggaggaagttcggcttctcggccgaggactaccgcgagctggagcgcctggcgctccaggctgagccccaccgcgccggccgccagtggaagttccccggctccttctacttcgccatcaccgtcatcactaccatcgggtacggccacgccgcgccgggtacggactccggcaaggtcttctgcatgttctacgcgctcctgggcatcccgctgacgctggtcactttccagagcctgggcgaacggctgaacgcggtggtgcggcgcctcctgttggcggccaagtgctgcctgggcctgcggtggacgtgcgtgtccacggagaacctggtggtggccgggctgctggcgtgtgccgccaccctggccctcggggccgtcgccttctcgcacttcgagggctggaccttcttccacgcctactactactgcttcatcaccctcaccaccatcggcttcggcgacttcgtggcactgcagagcggcgaggcgctgcagaggaagctcccctacgtggccttcagcttcctctacatcctcctggggctcacggtcattggcgccttcctcaacctggtggtcctgcgcttcctcgttgccagcgccgactggcccgagcgcgctgcccgcccccccagcccgcgccccccgggggcgcccgagagccgtggcctctggctgccccgccgcccggcccgctccgtgggctccgcctctgtcttctgccacgtgcacaagctggagaggtgcgcccgcgacaacctgggcttttcgcccccctcgagcccgggggtcgtgcgtggcgggcaggctcccaggcctggggcccggtggaagtccatctgacaaccccacccaggccagggtcgaatctggaatgggagggtctggcttcagctatcagggcaccctccccagggattggaaacggatgacgggcctctaggcggtcttctgcacgagcaagtttctcattactgtctgtggctaagtcccctcccttctttccaaaaatatattacagtcaccccataaaaaaaaaaaaaaaaaaaaaaaaaaaaaaaaaaaaaaaaaa

SEQ ID NO: 36 - DNA, 2229 bp, Homo sapiens
ggcacgagggccaggaacgccagccgttcacgcgttcggtcctccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaaaaaaaaaaaaaaaaaaaaaaaaaaaaaaaaaaa

SEQ ID NO: 37 - DNA, 817 bp, Homo sapiens
ggcacgaggggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctcttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaaaaaaaaaaaaaaa

SEQ ID NO: 38 - DNA, 1391 bp, Homo sapiens
tgcactcacctcctagagaccaggctgccatcatgctctggaagcttgtggagaatgtcaagtacgaagatatctatgaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaattttt

SEQ ID NO: 39 - DNA, 1686 bp, Homo sapiens
ccacgcgtccgggcgtaagccaggcgtgttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagtctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgtttttttttttaaaa

SEQ ID NO: 40 - DNA, 565 bp, Homo sapiens
  modified_base (548)..(548): a, c, g, t, unknown, or other
tttctaatgctgaaaagatttattaaaggcattctctttataacatttcttgtcagtgcacataattccaatagcaaatattttttcaccattcattcaaatacagtatcacaatgtgtttagtataaatatgtatacaaaattttataaagacactaaaaagtttctgaccaattaagtcatgagtttacaaagcacaaactgaagattaaatactgaatattaagatgaaaactactatacaggtactttaggaagttcttcaaagaagtgcacctcccgggaaatcctcatatgtacatctacactccagcaaactgcacaggcaaagtgctacttgccagattattgactaataaaaacacatatagagcttcagaaagaatacaaggtcaaatgccaaaaataaaaaaagaaatgaaagcaaatgtgctacattgtaccattttaaagagcttgaaaacaccacacaaggttcactaatactgttctgactgcaatgaccgtatttacttacaatctcttcctaacaaggaaactatcagatntattcatggtacgaatg

SEQ ID NO: 41 - DNA, 478 bp, Homo sapiens
  modified_base (381)..(381): a, c, g, t, unknown, or other
caatttaccaaaatatctgtattatctataaaaattgaactctaatgagtcactgatacgggaggcagcaatacccgactgtgctgacatgcagaaggaagacagctctgtcccaccaaccctatagcagaacatttgcattgagtggcacgtgggctgagtcatttgtaaggtctcaaaaacctggacactttggaacgtagcaatcggatgaacgatcttggaaacatctctcgggactcctgggctgtgtacttgaaatagttctggggatgggccaggacatcaaacagagccttgataagtttcttatccttaagtatttcctgatggttctcagatgcatagagcctgccatctcgaactatgtcttcaatgagnttcctgtagtcctcatcatatgtcacgtatgggacctggaaccctctagcgctgttcccttcattggacttgaactgaatccacagcttctttgacc

SEQ ID NO: 42 - DNA, 1409 bp, Homo sapiens
aattaagagaaaaaaagtgaatatggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgctgaaacccggggaagtggccacagccagcatcttctttgggattctgtggttgttttctatcttcggcaattccctggtttgtttggtcatccataggagtaggaggactcagtctaccaccaactactttgtggtctccatggcatgtgctgaccttctcatcagcgttgccagcacgcctttcgtcctgctccagttcaccactggaaggtggacgctgggtagtgcaacgtgcaaggttgtgcgatattttcaatatctcactccaggtgtccagatctacgttctcctctccatctgcatagaccggttctacaccatcgtctatcctctgagcttcaaggtgtccagagaaaaagccaagaaaatgattgcggcatcgtggatctttgatgcaggctttgtgacccctgtgctctttttctatggctccaactgggacagtcattgtaactatttcctcccctcctcttgggaaggcactgcctacactgtcatccacttcttggtgggctttgtgattccatctgtcctcataattttattttaccaaaaggtcataaaatatatttggagaataggcacagatggccgaacggtgaggaggacaatgaacattgtccctcggacaaaagtgaaaactatcaagatgttcctcattttaaatctgttgtttttgctctcctggctgccttttcatgtagctcagctatggcacccccatgaacaagactataagaaaagttcccttgttttcacagctatcacatggatatcctttagttcttcagcctctaaacctactctgtattcaatttataatgccaattttcggagagggatgaaagagactttttgcatgtcctctatgaaatgttaccgaagcaatgcctatactatcacaacaagttcaaggatggccaaaaaaaactacgttggcatttcagaaatcccttccatggccaaaactattaccaaagactcgatctatgactcatttgacagagaagccaaggaaaaaaagcttgcttggcccattaactcaaatccaccaaatacttttgtctaagttctcattctttcaattgttatgcaccagagattaaaaagctttaactataaaaacagaagctatttacatatttgttttcactcaactttccaagggaaatgttttattttgtaaaatgcattcatttgtttactgt

SEQ ID NO: 43 - DNA, 854 bp, Homo sapiens
cccggatccctgcggctgcctgcactctggaccacgagctctgagagcagcaggttgagggccggtgggcagcagctcggaggctccgcgaggtgcaggagacgcaggcatggccggtgagctgactcctgaggaggaggcccagtacaaaaaggctttctccgcggttgacacggatggaaacggcaccatcaatgcccaggagctgggcgcggcgctgaaggccacgggcaagaacctctcggaggcccagctaaggaaactcatctccgaggttgacagcgacggcgacggcgaaatcagcttccaggagttcctgacggcggcaaggaaggccagggccggcctggaggacctgcaggtcgccttccgcgccttcgaccaggatggcgacggccacatcaccgtggacgagctcaggcgggccatggcggggctggggcagccgctgccgcaggaggagctggacgccatgatccgcgaggccgacgtggaccaggacgggcgggtgaactacgaggagttcgcgaggatgctcgcccaggagtgaggctccccgcctgtgtccccctggctgcgctctgagccttcagggccaccgcccgctgctgcttttgtgctgggactctccggggaaacctggtcggtggatgggaaactgcctccccctgggaggaaggctttgcgctccggggcctggatgcggcgccctcgggccgcctgcgagcccctctctgccttcagaccttgggcagaaggaggcctccttgggcctggtccccctttgccctgcagtggaatgagggccccttaaccccgcattgatctaaataaaggactgccgagttccaaaa

SEQ ID NO: 44 - DNA, 1024 bp, Homo sapiens
gggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggagacgcaggtgcccgcgctgctggaggccggcttccggagggagaacatccgtacggaggtgatggcgctggtcccaccggccgactgccgctactacgccttcccacagatgatcacgcccctggtgaccaaaggctgagcccccaccccggcccggccacacccatgccctcctccgtgccttcctggccgggagtccagggtgtcgcaccagccctgggctgatcccagctgtgtgtcaccagaagctttcccggcttctctgtgaggggtcccaccagcccagggctgatcccagctgtgtgtcaccagcagctttcccagcttctctgtgagggtcactgctgcccactgcagggtccctgaggtgaagtaaacgccggcgctgcgcttggccagtcggcagtga

SEQ ID NO: 45 - DNA, 2525 bp, Homo sapiens
ttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctggacgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggtgagggatgtgatgctggccaagcatgtcatcactctgcacgtgagtgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggacggggcccgtcagcacgagagggacagtgaccgcgtccagcatccccatcactgtgcggcagttggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgctcactggactcatggactcgccacgctcgccctccttgccgctgcctgccattgacaatgttgctgggacctctgcctccccactgcagccctcgaacttcccaggcaccctcctttctgccccagaggaaggagctgtagtgtcctgctgcctctgggcgcccgctctagcgggttctgggaagtgtgcttttggcatccgttaataataaagccacggtgtgttcaggt

SEQ ID NO: 46 - DNA, 2514 bp, Homo sapiens
cacgagggtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcctggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggatcgggaatacaaagatgagataaaacattgtccctgcccccgggggcttcacatgccactggaaacaacagactcttaaactaacaattcaagcaggcgccaagtgctacgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaaaaaaaaaaaaaaaaa

SEQ ID NO: 47 - DNA, 661 bp, Homo sapiens
ttttacagtggtaaagcagcagtttttatttattacaaattctaaaaaagaatccaactttataagtaaaaaggaacactgatgatcacttaaaacatttaaatttaaaattactactaaaaaaaccctgtacattcacacaagtccaatgcctttgttggtttttacagacatagaatttctgtagggttttgggccctatcaacaatttttattaagtactgcaataacaaaatacagcaataaaacaactggacactcctaggggacaccaaagataaagggcccattaatcaggtgtaggccagagaaacccaacctgttggcaatatgacgctctttcccaactgggtcttggtgagacacgtggcacagcaaggctgtcagtgcatgtgcataaattgtagaccaggtcccactatgctacttcaggattcagccagcccttctatgagtcacagaggtcccttggtcgttattcatcttgatatactcatgggatgtttggaattaaggagcccaactaccttacttgcatttgaagtctttcacttcatatcctacccctcagtctaagagcccaccaacaagggtagctacacctagatgctcacatctataggctgcctgaatcctggaccagctcgggccctgatatgat

SEQ ID NO: 48 - DNA, 2607 bp, Homo sapiens
gaattcgggcagattagaccctggtcctacactcttagccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgctatcaccttcgtcttccaccagcattctcatgaggaacagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 49 - DNA, 2510 bp, Homo sapiens
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcactcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacgatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaaaaaaaaaaaa

SEQ ID NO: 50 - DNA, 477 bp, Homo sapiens
ttttgacaactgaattaactttattctcttctaactgcagattcaaggtatacaactgaacattgctatttttcttatgagacttataaataaaaatacaaaaaatgttcactacaaaaaaatctactgttagtaggatgtaaaaaatattctctttgctatagaaggcacaaacttcacttagtgacacatggagagagaaaaaaacctgcagcagtaaattcattttttctttttttttccttttttttttttttaaatcttgtcagaaacactgaaattacaaagaaacgcgtcaatctacacgaaacgaaggcagatgcggaaagctgcaaccaggactgcacaacttcgagtgaaactgcttcggaactagaacagataaggagcggcaagcacaactcggggaagtgggctggggagggggcagcaggaggcaggagagagggagagagaatggagtggacagaaatgaga

SEQ ID NO: 51 - DNA, 1456 bp, Homo sapiens
gggagggcggcagtgagggcgcggcggcgggcggcttggggctggattccggctccctcgctcgctcgctccctcccgagccccctcccacccaggcccaccccacccagcacccctggcgcagggactgctggaacctggctgtgcccgtgtcgctttaagacagactctgccggcgccgtccggagccttagaaacggccccggatcgcgagccggagccggagccggagccggagccggagccggggccggccgggctgctgaggcccgagcggcaggagcgacgcggagcgctgagccaggcgcccagtcgcgagaagctgccgccgcctctggccgccgccgcagccccggggcggtccatggggcgggcaccggcgtcgctgcaggctgtcggcagcctggagggcagccgcttagcgtgcgctcttgtccccgcaggtcgcagccagggcggcgggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgac

SEQ ID NO: 52 - DNA, 891 bp, Homo sapiens
gatatacggaccggattgttttcgctggcccagtgtccccggagcttgtgtgcgatacagagagcacctcggaagctgaggcagctggcacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattacaatattggctatatcaaaagagaaaacaacaaaaagcatgacgacgaacacaaacctctgttggtggccacgggctcgtgggccccatgcgaagaagcattctctattagacccactctgtttgtgggggcgccgggcggccccatggttgatgtgttaggttgtccaaaaccgctggtcatcaaataaggagggttccccaacagaggagaaacccgggtggcttcaacgaacacaggttgctcgtgggattttccccaccccgataataagaaaacgccgccgggggtggaaacaccgaagatcgtttttgagacaacaatacccacgaatagtgggtattacagagggcacacatgaagggggaatctttaatcacaaggagtagtttcaagggcaccctcgggatataccatgtaccg

SEQ ID NO: 53 - DNA, 482 bp, Homo sapiens
ttttttttttttgatcttaaaaaaccatttaataaaaaaaaatctttgaagggacaaatgggaagttttcacttagagtttgatttacaagacaataggaggaatcagatttgggaacacaacaggcttgaacactttctggagactgagagacagttcagagtcagccctcaccgttagccagacccctggccaggacccgcagcaggctggtccagcgggtctgtggggcactcctgtggggcactcttggtggaaacgatgagccaggtgatggtctccccaggagtgggcaatgggtgaggcctgagccctgaactggctggcttttggacagtccttgaaaatgtggctgctccagaagccactcaagctggaccatggtcacagttaacctcaggcccaacattaaacaaaaatgtactgagtgctcagtcactagagatgattttactgttacacagggaaggcaaaaaatagct

SEQ ID NO: 54 - DNA, 444 bp, Homo sapiens
aattctagaagtccaaatcactcattgtttgtgaaagctgagctcacagcaaaacaagccaccatgaagctgtcggtgtgtctcctgctggtcacgctggccctctgctgctaccaggccaatgccgagttctgcccagctcttgtttctgagctgttagacttcttcttcattagtgaacctctgttcaagttaagtcttgccaaatttgatgcccctccggaagctgttgcagccaagttaggagtgaagagatgcacggatcagatgtcccttcagaaacgaagcctcattgcggaagtcctggtgaaaatattgaagaaatgtagtgtgtgacatgtaaaaactttcatcctggtttccactgtctttcaatgacaccctgatcttcactgcagaatgtaaaggtttcaacgtcttgctttaataaatcacttgctctac

SEQ ID NO: 55 - DNA, 1356 bp, Homo sapiens
ttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctcccccc

SEQ ID NO: 56 - DNA, 576 bp, Homo sapiens
cttctctgggacacattgccttctgttttctccagcatgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgctt

SEQ ID NO: 57 - DNA, 2085 bp, Homo sapiens
tggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcacccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcgtgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtgatccccgttccaccccaagagaactcgcgctcagtaaacgggaacatgccccctgcagacacgt

SEQ ID NO: 58 - DNA, 735 bp, Homo sapiens
  modified_base (623)..(623): a, c, g, t, unknown, or other
  modified_base (626)..(626): a, c, g, t, unknown, or other
  modified_base (632)..(633): a, c, g, t, unknown, or other
agcggccgccttctcctcgtactgctgggtgaggttctcgatctccttctggaacctcttcttcccctcttccagagcttccacggtgctggcaaagtcctgcagcttcttcttcgagtcggagagctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgggtgtcctggagctgggaactgagggacgccacgtccttggccagcttaatggccttcccctcggcctcgttaagcatccctgtgacgctctcagcttcattctgcagcttgtggactttgtcattgagctccgcccgggcccgctccccatcgctgcacttggactgcagctcctgcacctgcgcctccagcttcttcttcttatgttccacctcctgcttgggcctgcccaggacccgcagctcccccgccaggtctgcgttctctttctccagcgtctgcttattcttgtctggttcgccttggccctcttttgactgctcagctgctctgtgagctnctncaccgnnctgtcgtgtttctgcctcatctcctggacctgagcctcatgggaacgcgtctcttcattcagggcccctcttcagcaccgtcacctcctgctccctcttggc

SEQ ID NO: 59 - DNA, 1108 bp, Homo sapiens
ccgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctgg

SEQ ID NO: 60 - DNA, 1709 bp, Homo sapiens
ggtacctcctgccagcacctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaat

SEQ ID NO: 61 - DNA, 2361 bp, Homo sapiens
ccccctccgctctgctgcgccgcccggctgggccccgaggccgctccgactgctatgtgaccgcgaggctgcgggaggaaggggacagggaagaagaggctctcccgcgggagcccttgaggaccaagtttgcggccacttctgcaggcgtcccttcttagctctcgcctgcccctttctgcagcctaggcggcccaggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcggcagaaagttgggactgagcagctgggagcaggcgaccgagctccttccccatcatttctccttggccaacgacgaggccagccagaatggcaataaggactccgaatacataataaaagcaaacagaacactccaacttagagcaataaccggtgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgggtacttgtccctttgttgtcgttgttgtagttaaaggaatttcatttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaa

SEQ ID NO: 62 - DNA, 2197 bp, Homo sapiens
tcttgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcaggatctggaaggtagaaaagggaccagatggaaaagccatcgtggaatttttgtccaatcttgctcgtcataccaaagccgtcaatgttgtgcgtttttctccaactggggaaattttagcatcgggaggagatgatgctgtcatcctattgtggaaggtgaatgataacaaggagccggagcagatcgcttttcaggatgaggacgaggcccagctgaacaaggagaactggacggttgtgaagactctgcggggccacttagaagatgtgtatgatatttgctgggcaactgatgggaatttaatggcttctgcctctgtggataacacagccatcatatgggatgtcagcaaaggacaaaagatatcaatttttaatgaacataaaagttatgtccaaggagtaacctgggaccctttgggtcaatatgttgctactctgagctgtgacagggtgctgcgagtatacagtatacagaagaagcgtgtggctttcaatgtttcgaagatgctgtctggaataggggctgaaggagaggcaagaagctaccggatgtttcacgacgacagcatgaagtctttcttccgtagactgagtttcactcccgacggatctttgcttctcacgccagctggatgtgtggaatctggtgaaaatgtaatgaataccacttatgttttctccaggaagaatcttaaaaggcccatcgctcatcttccatgtcctggaaaagccactcttgctgttcgctgctgtccggtctactttgaactgaggccagtggtggaaacaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggagaataaacttaacacccttaaagacggacactccaccaagttctgtaccaaccagtgtgatttccaccccttctacagaagaaattcagtcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacatagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttgg

SEQ ID NO: 63 - DNA, 3173 bp, Homo sapiens
aaaaattacgcgaagatgctaagataccagcttgtgaagaaagcctaagccagaccccgccgagggtgacagggaccagtcctgctcaagaccaggatcatccatccgaggaacagggggggcagggttcctgtagagagccaggtgttaacccctgcctctcccgtctaggacgcctccagcagaagatgctgcttgcctgcagagcccccagcctgaggacacgggtgcagaaggaggggctgagtccaagacgagctcagaaaaccagaagcctgaaactttatctggaaacactgaaggtgccttcattagcagaactgcacagccgcctctgaaaaggtacgtccactcggcatggaggagtcggcgtcccttacccagttaataagatcaatgaatgcgcaggtctttcttcttctagcttccacccacaaataaaatggttccaaaaagaagatgtcgtcatcttaaagataagaataaggaatgtaaaggactacaagtgtcagtatttaagggatagagtcgttttcagtgcttgggtgggagacaaattttacctggctgatctggagctgcggggcaacataaggaaagatgactgccaatgtgtgattagaaacgatgaacctgtaatcactctggccaaagagagaagggaggcatggtgtcacctactcagacagaggaaccccaacgtggcttttgattttgatcactgggaagactgtgaagaggacagccacttccccaaggtagtgaattctaaaaacctgccgtacacagtgacagaggtggttgaagacagtagcagcacttcagaggatgacggcagtgagagtgaaagagaaggtgaatgacgtcctcaagagcggctggaagatgttgaacaaaaatggatattgccatgtgaccgacagttaagaaaacagtcagtcataaccaaatctttttcttttcttttctttttttttttttttttttttttttgagacagagtcttgctctgtcggccaggctggagtgcagtggcatgatcttggctcactgcaacctctgcctcacaggctcaagcaattctcctgcctcagcctcccgagtagctgggattacaggcatgtgccaccatgcctgaccaatttttgtatttttagtagagacagggtttcaccatgttggacaggctggtctcgaactcctgacctcaggtaatcctcccacctcagcctcccaaagtgctgggattacaggtgtgagccaccacacccggccaaccaaatctttctttacctcaaggataaatgattactgtcaccttgtggtgctggacttgataacggtgagaaattcttcattgacttaaaaataggctgatgataagaccatcaaaggagggtggacacagagaaacagcaggtgtggtctgattccgccggcttgtctgtcctgtctggcgcctctcgccactcaccctggcagagcagacatgcatctgggtgatgaaatgcactgtctggagtcagtccattcattttttttcacctagacctttgctacattgctacaaacctgatcttacacatataaattgaggtttctaatgtacacacttagactcagcaactgttgaaccagccctttcaaccatgagatagtgggatttaacataaccatctatgtgaattgatagtgttagcattcttggatagtgatagctcctcagagtaagttgacttctgatgaagagatagtccagggatagaaattggattgctcagtaagacccaggcctttccggggtgaagctgctggttctaaacaatcccttggacctgcagagtcctgagcaaatggcacaaaggttgctttttagtggaaattcacaagggcctgtggggtgcctggaggtgatctttgaatgcctacatgtcgtgagccctgcagacattcgccaccccatctgcattgtggctgcagcactggggggggtcaccaggtttaggggaggagtgtatgtagtcatggccacacccagaggctggcttttgtgctttgggtttctttgttgactgaaaaagcgagaaaggtgagctattgggaaattaaaagtcctgtgcactctgtgtcttgtttatcagctttgcctcggaatggaaaagaatttggatagaacatgagtgttgtgtgacggccccaagatctttattatttttttgtatcagaaagcgccaatgcccaggcttatgtatgtcccagcagaagccaccgcttgaactagaggtgaactttgtcatcaagctgtcctgtgagcaggtctggatcacactctggctcagttttctcatctgtaaaatgagacatcccctcattgtgtggcctggccttgtctcagggagcgcccgccgagtgctgctgggttgggcagtttttctgcccagtggctctgatgggggctcagagccctggcctcccctgggaggacacgctgtgcagccaggacagctgccgggagtgtgcccaggtcactgctatggccttcgcagggtgactggcaggtatcaaatcagcccatgaaggaagatggtgattttccttttttgtagctaaattgggcaggctcttgggaagtagaaagttctggtgtttttgctggtgaaggttttgactgtggagctcttctaacacccatatcagtgtctgtttctctgcatgtggctgctgccctgttggtggagctctgggggcagagaccaggccgccgtccagtggcgccccgtgcgcaccagctgcctgctgtttacacccaggtgcgccgagtctctttcatacagcacagcaaatgataatagctagtgacaatgtgtttcctgtgcactcgtgaaaatgcagggaggacaactgcatgcttagatctgtttcttttttcagacattcaaatgttctaatatctgaagctaacattttgtaggatataggatgctgattatgtgaacaattagtcattggttttctgtactgctatgaatatgtctgatttcaagttttggtcaaatatctaaaatgcaaggtgaaagtgcctttgtctctatgcttctaaaatcgctcatgcttagttgtggtatggatgtcttccgcagtgtatcatcaataaaatttcactgttttcacag

SEQ ID NO: 64 - DNA, 533 bp, Homo sapiens
  modified_base (526)..(526): a, c, g, t, unknown, or other
ctactactaaattcgcggccgcgtcgacttttttttttttgccataccaatagctggttttaatttttttagaggaaatactatagtttaaaaaaagagttccaaaatatttaacagaatttccagcaattattatttctaaaatgtaaagatttgaaacataatttatacaaaactaaaaaccagaaggattcattcttgcttttccttttcttaaagaaatccagacaatttgtcacaagaaagttcagcatgtgatagcagctgcagcctcagtcacccttggaatcgctgtccctcctcatggggacagagctctgcactgaagacagcaatacaccttcaatcggcttcttagggttttcctccaagtccgtcttaactgctctagattcagacagtttccaccccaactcatctctggtcaggttcatgccgccaaacaccagaggaccgatcaactgagccttgatgtctccttccaagtaaacaaataccatgggcagattcctatcaggataattgngtatgcg

SEQ ID NO: 65 - DNA, 703 bp, Homo sapiens
cagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacggtgggtttctcgctgggtgcgacgtgaatttgtgaagctcaggatgcccatggattagactcatgtagtagcttaaagagtcattaggcgataggagggagaaaaccaagaagttagcagagtctggatataattcagtgtccgtaaatcccatgaagagaagctcatcagaataaaggcaatgaatttgtgccagaagagcctgtgactacatttctttcaatctctttggctgtttgtttcagtatacacactccctgttattgcttactattttatgagctctaataaatgtacttctcaagttgctcatgaaaaaaa

SEQ ID NO: 66 - DNA, 3887 bp, Homo sapiens
gcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgcacagaaaaaaaaatatattacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctattgtaatacaaggcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgt

SEQ ID NO: 67 - DNA, 238 bp, Homo sapiens
  modified_base (206)..(206): a, c, g, t, unknown, or other
  modified_base (227)..(227): a, c, g, t, unknown, or other
ccaccaccatttagtaatagcctggggtaacaagggctgcgtcacggactgccacttttgccatcctgctcagagcagggccatgcctaacccgtatctggggattgcttcagatattatgaatcgcttcaatattatgaattactacaattcataataattgcttcagatattatgaattacaatatggttcaaaggtgctttanagatgaagacacaaatgtgtnaacacatattg

SEQ ID NO: 68 - DNA, 563 bp, Homo sapiens
  modified_base (478)..(478): a, c, g, t, unknown, or other
taagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcanggggcgaagaggagtggggacagcagcagagacagctggggaagaaaaaacataggagacgcccgtccaagaagaagcggcattg

SEQ ID NO: 69 - DNA, 1411 bp, Homo sapiens
aaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatg

SEQ ID NO: 70 - DNA, 2919 bp, Homo sapiens
tctgtgattgtggccaggcggggcaccctcggaggggagggttcggaagtggaatgcgaccccccagcctctttcccctaggggctgtaatctgatccctggggactccccccctagcctcccgccctcgccctcactgctgactcctcttccagatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagcca

SEQ ID NO: 71 - DNA, 2376 bp, Homo sapiens
cggatgagggtcagggctgcgcggacccctatcccgcctgcgtcctcccggcaagcccagcgggagcgcccgctcggctgggtccccgcctccagcgcgccggggccgcccagaccctgggctcagcctcgcgccccggtgcccacctgaggaggcggcggtcccggcctcgcgtcccggatgggacggcgcgggagcaatgccagtggccccgagcgccccgggccacgcgcggggccggccagccgctctcgcgccctccccgccccctccgcgccttgcctcgccgcccgcgcgccccacccaccggccgctcctcccctctccccaccctcctcctccgccccctcccctcccccgccgcctcgcagatagctcggccgcgcgtctcagccgccggggccccgagcgcaggcggcgaggccaccacacctgcagagcgctcgggctgcctaggcggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggtgtgtggcgctgcccaggggaggggcgacgcccacgacctggcgccggccccctggctgcacgcgcgagcgctcctgccccttccggacgggacccgcggctgtgctgcagacaggagaaaaaagaaagatcttgatgttccggaaatgccatctattccaaacccttttcctgagctatgctgttctccaattacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattatcatgtgaaaagaatgtatttcacctgcaagttacaaaaaaatagtttgtgcattgcaaataagcaaagacttggattgactttacattcatcatttaaaattcattagttaaaattaaaccttagg

SEQ ID NO: 72 - DNA, 517 bp, Homo sapiens
cctccacagcaacttccttgatccctgccacgcacgactgaacacagacagcagccgcctcgccatgaagctgctgatggtcctcatgctggcggccctcctcctgcactgctatgcagattctggctgcaaactcctggaggacatggttgaaaagaccatcaattccgacatatctatacctgaatacaaagagcttcttcaagagttcatagacagtgatgccgctgcagaggctatggggaaattcaagcagtgtttcctcaaccagtcacatagaactctgaaaaactttggactgatgatgcatacagtgtacgacagcatttggtgtaatatgaagagtaattaactttacccaaggcgtttggctcagagggctacagactatggccagaactcatctgttgattgctagaaaccacttttctttcttgtgttgtctttttatgtggaaactgctagacaactgttgaaacctcaaattcatttccatttcaataactaactgcaaatc

SEQ ID NO: 73 - DNA, 1559 bp, Homo sapiens
gggcctgaaccaaacggtgccatggggaactgtctgcacagggtgagtatggggccaggccccagagtcccttatccctatgcccctcatttcccctgctgtttgcccctcagtctttatatctcttccttttcctcctcatcttttctcccttcccgcttttttcctcttccttcaaagtctttttccttctctccttcctatgctagcctcctagctccctcttgtgtccctccctttgcctttgagtcagttccatcctggtctcttggtgcctttccttctgaccttgcactgctcctccagccccagctgccctggcttccccaggactgttcctgctccggctcttcaggctccctgctttgtccttttccactgtccgcactgcatctgactcctgcagagaccttgttctcccacccgaccttcctctctgtcctcccctcccacctgcccctcaattcccaggagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatgatgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtg

SEQ ID NO: 74 - DNA, 568 bp, Homo sapiens
  modified_base (437)..(437): a, c, g, t, unknown, or other
taaaaaagaaaacaatgtttattaggatattctggggtgagaggatggccaaagggactatgtacattctgtagtgcttgagcaataggctaacagaaaattcgaacatcacaaaaccacttccaaagtccatattgcaaaacttgtacttctacaggagatgttcttccaagggtgttggcaataaaggctgttgcaaaacagctatgtgaggcagccatgtgggagtgaccccaggagaatgctccggtgtcctctggaaagcagatacacaggacgatggacaaatgtgtcatcttctaccagtgggaagctcagtaaacacacaatataacatgggagacccgcccgaagcctaactggaggcttctcaacaaagctcagtcgacccctcacccctgttccgaggagactgggtgtctgaacccctcactcangaatgaattctaaaaataccctaaaaatcagaagccgccttctactctaccgtgctataaacctgcatgaaacagaacgaacataagctgaaacacaccctcgggttaagagtgaaaaatgcaacaccatc

SEQ ID NO: 75 - DNA, 2462 bp, Homo sapiens
gctgagctgcaggcgcggcgaaacttccctctacccgcccggcccgcggcgcgcaccgttggcgctggacgcttcctccttggaagcgccctctccctcagtcatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctgacatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtgtttgtgtgtggaaatgacagcaaagccaagcaaagagtgatggatattgttcgtaatcttggacttactccaatggatcaaggatcactcatggcagccaaagaaattgaaaagtaccccctgcagctatttccaatgtggaggttccccttctatttgtctgctgtgctgtgtgtcttcttgtttttctattgtgttataagagacgtaatctacccttatgtttatgaaaagaaagataatacatttcgtatggctatttccattccaaatcgtatctttccaataacagcaccttacactgcttgctttggtttacctccctggtgttattgctgccattctacaactgtaccgaggcacaaaataccgtcgattcccagactggcttgaccactggatgctttgccgaaagcagcttggcttggtagctctgggatttgccttccttcatgtcctctacacacttgtgattcctattcgatattatgtacgatggagattgggaaacttaaccgttacccaggcaatactcaagaaggagaatccatttagcacctcctcagcctggctcagtgattcatatgtggctttgggaatacttgggttttttctgtttgtactcttggggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaaaaaaaaaaaaaaaaaaaaa

SEQ ID NO: 76 - DNA, 743 bp, Homo sapiens
  modified_base (568)..(568): a, c, g, t, unknown, or other
  modified_base (666)..(666): a, c, g, t, unknown, or other
acttacggctaggtacgaggctgggtggtggtccatggcttcgttgagggccatccatatgccagctgggggccagcccacagtggccatatggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgntgtgtgtttttcctggtgcttcaagagcgtgtgcagggcaagtgccgtcactgggaactgcaccagatgctcagacttggttgtcttatgtttaccantaaataaagtagactttttacaccaaaccaacatccaaaaaaaaacccgggggcaaaatgggggggggacaaagggg

SEQ ID NO: 77 - DNA, 3866 bp, Homo sapiens
ggaattcctttttttttttttttgagatggagtttcactcttgttggccaggctggagtgcaatggcacaatctcagcttactgcaacctccgcctcccgggttcaagcgattctcctgcctcagcctctcaagtagctgggattacaggcatgtgccaccacccctggctaactaatttcttttctatttagtagagatggggtttcaccatgttggtcaggctggtcttgaactcctgacctcaggtgatccacttgccttggcctcccaaagtgctaggattacagccgtgaaactgtgcctggctgattctttttttgttgttggatttttgaaacagggtctcccttggtcgcccaggctggagtgcagtggtgcgatcttggctcactataacctccacctcctggtttcaagtgatcctcccactttagcctcctgagtagctgtgattacaggcgtgcaccaccacacccggctaatttttgtatttttattagagacagggtttcaccatgttggccaggctgttctcaaactcctggactcaagggatccgcctgcctccacttcccaaagtcccgagattacaggtgtgagtcaccatgcctgaccttataattcttaagtcattttttctggtccatttcttccttagggtcctcacaacaaatctgcattaggcggtacaataatccttaacttcatgattcacaaaaggaagatgaagtgattcatgatttagaaaggggaagtagtaagcccactgcacactcctggatgatgatcctaaatccagatacagtaaaaatggggtatgggaaggtagaatacaaaatttggtttaaattaattatctaaatatctaaaaacatttttggatacattgttgatgtgaatgtaagactgtacagacttcctagaaaacagtttgggttccatcttttcatttccccagtgcagttttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaagctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataggaggtataaaatatattggactgttatactcttgaatccctgtggaaatctacatttgaagacaacatcactctgaagtgttatcagcaaaaaaaattcagtgagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatga

SEQ ID NO: 78 - DNA, 2480 bp, Homo sapiens
atggccgggccgcgcgcgtgcgcgccgctcctgctcctgctcctcctcgggcagcttctggcggccgccggggcgcagagagtgggactccccggcccccccggccccccagggcgccctgggaagcccggccaggacggcattgacggagaagctggtcctccaggtctgcctggtcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggacctcctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccaggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgaaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcgggggtgtggcaggcgggtgacgtccaggagagggagcgcccctggctgcccctcggccgccgactggacgcgtgggccttgccagcgagcaccctcattgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttgcatagcatttgtgtaaagactatgatctcatcccaataaaatgatatattaaatcttcagattaatgactggctacagagtaacaaaaaataaacaatttaatgtacagtaaattctctccca

SEQ ID NO: 79 - DNA, 2336 bp, Homo sapiens
ggcacgaggaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtactccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaa

SEQ ID NO: 80 - DNA, 3100 bp, Homo sapiens
actcgtctctggtaaagtctgagcaggacagggtggctgactggcagatccagaggttcccttggcagtccacgccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctgcactgctgtgctgtgcccaagttgtggtgctgacaaagcttggaagagcctgcaggtgccttggccgcgtgcatagcccagacacagaagaggctggttcttacgatggcacccagtgagcactcccaagtctacagagtgatagccttccgtaacccaactctcctggactgccttgaatatcccctcccagtcaccttgtgcaagcccctgcccatctgggaaaataccccatcattcatgctactgccaacctggggagccagggctatgggagcagcttttttttcccccctagaaacgtttggaacaatgtaaaactttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttc

SEQ ID NO: 81 - DNA, 1836 bp, Homo sapiens
ggcacgagggcaagtttgaaaagtgatgacggttgacgtttgctgatttttgactttgcttgtagctgctccccgaactcgccgtcttcctgtcggcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggtattcaggagctacaacaatcactaaatcaggattttcatcaaaaaacgatagtgctgcaagagggaaattcccaaaagaagtcaaatatttcagagaaaaccaagcgtttgaatgaactaaaattgttggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttaaaaaaaaaaaaaaaaaaaaaa

SEQ ID NO: 82 - DNA, 6371 bp, Homo sapiens
gtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagatacctgtgttttgactctgttcctgtggatagctgcttggtctgaagttccagaaaggatcctgttcccagacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcgtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgc

SEQ ID NO: 83 - DNA, 1044 bp, Homo sapiens
tttttttttttttttaaacaaatgctcactttaatcacaattctaaattaattattttcacattaatatagatttttccataaaccaacgaaaaactggaggttattatacatttttaaacagctaacatggatttggaaaattttttattaaaaattggatcagaagctagttggaaattctcaatggtgaaatataaaatattcattacaattggtgttttcaaagtaaattcagatctaagcttcctggaaaagctggtactatctcatatcataatagggatgactaagtacttggacaactactttctaaagaacttaacaaaaagtggactacttgaagattacatttacaacagaaagggctaacattctctggcagagctctcattttatcatgaaatggtgggacaatcaggaacacgtggatgaggggtatcaagaaaaggggcatttcaaaatatttccactttaattaaaggtttggacaatgaagatttcataaaagggtctttaaatactattttctagagaataaccatctaaatcggagactatatgccataaaacgggaaccatttgagggggtaacaataattctaagttggtactataaaaagattgggctaaaatacaaaacatcttggccgatacaccgggcaacgtagcctaaagtaggccacaagaattccagaaagggctcccgaaagaaactacagaaggtcccccctggccagatacaaccgcacacttaagccagggcgcgaaccaaaaccagctcaaaggggaccacgtggcaacgaaaaaccgctgtggcgcgagacccggtgcacgagacacaagcgagaaagcgtccccaagcgaggtgtaaaagcaaaacatataaaaaacaacctagaggtgaaacgagagaagcacaagcgcatctgggaagagcgcataggaggagagaagtacataaaaacacagataaaaacgaaacaggcagggtagcacaaaacagcacacccagcgcgaggcagagaacacgaacgggtcaacg

SEQ ID NO: 84 - DNA, 822 bp, Homo sapiens
  modified_base (566)..(566): a, c, g, t, unknown, or other
aaaaaaaaaagtcctgtggaaatcatatagacaaacatttgcaaagctgctactgccattgtaccagtgttaaactgtgttctaccttgcatcttttactgatttttatgacagattttatattggtaaccattcgagaactctgtaagtgctatggcttccttaaactacgatttatcatatgctcccagtgtttactttgagactgaatggcaaccagagaatgtaaacaaccaaggtgcatctggttatgttttaaaataaagattaataaaagttaaggtaaaaggtctgtgtctgaacctatgcattttttcacctctgaggaggatactaatacctaatgagaaaagctgaaatgtgtgggccgcgggtggcgggtgcgctacatggcgctaatggatactctcagacagcttgaggggagggcgcgcaggcaggtcagaaatcgagcctggaggctcggagaagaattcggagttacccaggggcgtgggaccctaagcgagtggagtggaacacccttgattctcgtgagtggagaggtgtcaccaaaaatattgagnccggggcggactattaggacagaactaccatgatcatatccacgaggtgctaaactggtgcgacaagggtctgaaggcgcagtaaatcagaggcgtggtaacaccccgctaaggagtgggccgtaagtgtcctggcgcctgggatgtccagagaagattcgggggggccaataagggcaagtaacccaggattctggcaggcaacactaacttcagttcgaaccgggttccccggtggcggttacaacacaagccc

SEQ ID NO: 85 - DNA, 2150 bp, Homo sapiens
ctcgagccacgaaggccccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaaaaaaaaaaaaaaaaaaaaaaaaaaaaaaaaaaaaaaaaaaaaaaaaaaaaaaaaaaaaaaa

SEQ ID NO: 86 - DNA, 461 bp, Homo sapiens
aaataaaagggatgcgtatcagagtgtaagaactggaaattacttccacagtttaaagaattaataagagaatgctggttcaatttcttaaagatggaaagcttaccaaaatgccatcagagtctgtgaactacttataataaacagcaggatccccactggctaggctgccgtgcacacagcacccacccgccacccccaggttaccattttaagatattctgtcaatgcttagttaaaaataagacttacttaagagaccaacaaaaaaaaatcaattaaacttttattgaagactatccagtggcaagaataccatgtgtattatactatgttttagacactcaataaagaattcattaagatgattctcacaacgcactcatcaaaacagccttaaatattgttaaaaagcgcattgaagcgcctgtcctgagttctaacaggttttaaatttagat

SEQ ID NO: 87 - DNA, 1166 bp, Homo sapiens
gcaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacattgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagc

SEQ ID NO: 88 - DNA, 839 bp, Homo sapiens
aagccacaggctccctggctggcgtcagctaaagtggctgttgggtgtccgcaggcttctgcctggccgccgccgcctataagctaccaggaggagctttacgacttcccgtcctgcgggaagtggcgggcacgatcgcaaggtagcgcagaagcttctcaatggccagcgccagctgcagccccggcggcgcactcgcctcacctgagcctgggaggaaaattcttccaaggatgatctcccactcagagctgaggaagcttttctactcagcagatgctgtgtgttttgatgttgacagcacggtcatcagtgaagaaggaatcggatgctttcattggatttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgtttgcttacaattgcctattacaacttgctataaaaagttggtacagatgatctgcactgtcaagtaaactacagttaggaatcctcaaagattggtttgtttgtttttaactgtagttccagtattatatgatcactatcgatttcctggagagttttgtaatctgaattctttatgtatattcctagctatatttcatacaaagtgttttaagagtggagagtcaattaaacacctttactcttaggaatatagattcggcagccttcagtgaatattggtttttttccctttggtatgtcaataaaagtttatccatgtgtcagaaaaaaaaaaa

SEQ ID NO: 89 - DNA, 537 bp, Homo sapiens
gaccagaatagcttttatttcacatgaagctaaggaaggaagtcgagaggacagggctggttctgtgggcgctgcctggcaggtgcaccacctccaactgctgggctccagctccagggctcaaaagccatctccgaaaaggtcgggagcggggctgaagggtcccgggggcaggttccaggccagctcctccagcaggcccaacaggcctttcacctctgtccccaggtgatccacggtcttctctaccatctcctccatgacatctagacggcgttgcacagccatgtgtctgtcacacgctgtgctctgagctgagtctcctcgcggagggctgaagggttcggcagcggccaaagagcccgcggcgcggagcagggccagtccggtcagcgcgcagagcatgggccgcatggtgccgctcgtgcctaattcctgtcacccgggggatccactagttctagagcggccgccaccgcggtggagctccaattcgccctatagtgagtcgtattacgcgcgcttactggccggtgt

SEQ ID NO: 90 - DNA, 1817 bp, Homo sapiens
catgtccagaagcaatccacagtttgagaaaccaagtttgggtaagatttctggggtccattgctggtttacagggataatcagacagactatttgaaatctatcaggatgatgatgatttctgtcaggcctgatggggctcagctcatgaatagcatgggggttctgggatcagctccctgggacagggcaggcctggaggggtcacctgtaaaaagttggtaagcaggggcattgtcaccaggcttcctcttccatgtcaatggagtctggaggcagagttggaatccagctctgcacctttttgctgtgcaccctcaggcgggtcagcaacctctctgaacacacacccagtctacaaaatagaagaaaaaccctataaggtggtttttggcaggggagaggacatgggaagagattgaataaattagttgtccatcctagcatagagcccagaacaaggcactgaaaagacttcttaaatttttttgtccaacaacatcttggacagttctcatttatgtcaacatgcctggtcctgattttgttggtcatatttgcatgtcatattttaaaccatgaagcataataaccaactaagtaagaaagccctggcaaaaaagctgagaggtctggtgcagtggatcacgcctgtgatcccagcacgtttggaagccgaggtgggcagattgcttgagcccaggagttcgagaccagcctggacaaaatggcaaaaccccatctctgctaaaagtacaaaaagcagctggatgtggtggcactcacctgtaatcccaggtactcaagagactaagacacgagaatcacttgaacccaggagacacagggtgcagtgagcctcctgcactccagcctgggtgacagagtgagactctgtctccaaaaaaaaaaaaaaaaaaaaaaaaattgctgagaaagccctaattgttgttgttgttgttgttgttgttgttgttgttattgctgaaatggggtctcgctatgttgcccaggctggtcttgaactcctgggctcaagcaatcctcctgcctcagcctcccaaaacgttgggattacaggcatgagccacctcacccagcccccttgtagttttaactgtgttctacagtaaccctagaatttgcctccttattttctattaaaatgagacatacttgaacaatattcagtcaaaatagaaatatatacagtcaaaagcaactgccacataattgccaaaacttggaagcaaccaagaagtccttcagtaggtggatagacaaaaactaatggaatattatttagggctagaaataaatgagccatcacgtcacaaagagacatggagaaaccttccatgcatattactaagtgaaagaggccactctgaaaagactacctattgtttgattccaactatatgacattctagaaaagttaaaactatggagacagtaaaaaggtcagtggttgccaggggctgggaggacagagggatgaaaaggtggaacagggaggatttcagggcggtgaaactactctgtgtgatattacactggcggatgcatgtcactgtgcacttgtccagacccacagaatgtgcactccgaagtgtgaaccctcgtatggactatgaactctaagcaataatgacatgtccgtgtagggtcatcagttacacatgtaccagtctgatgtgggatgatggtagtaagggaccctgtgcctgtgtggtgggaggaggtgtgtgggaactctgtacttctactcacttttgctgtgaacctaaaactgctctaaaaaaaaaaaaaagcct

SEQ ID NO: 91 - DNA, 1055 bp, Homo sapiens
gcgatcttatcaagctttttgggaggtataaaacaaaatccccattttttccttggatttagttcctcaggaacagagaactttgcaattgatgatctcaactctgcatcatctggtgactcctgattctgcaggactaagacatttcccaagagttctgctgcatcagccagtgaggacaagagttcttcagtgcggttcagctcaaggacacctaggcttccccagcagggggcttgcttgcaggtctgacaaaccacagagcgttgagcagatggcctgggactcccagacctggcagagggttttattagggcccgcctggcctgcaccgtttcatccaagtaccctgacccagcactcatcttccctggcattctctgttatccaccagctcctctgcacacctcagcgtctacttccacgaacttctaaacatcaaaaggtacaatggccagggtgcggcaggagagtcgggggcagggcagccttcaaatccacactattgaatccacacgatggaaagaagagaacagatggggaagttctccagagatcatgagatgcatccaggcagtgttctcatgtgagaggatagggaggccaaaaactaaaattgctatcagcccccgccgctgtctggtacgcgaggaaactttccgaggactttacaagcatagttgcaaaatgctagtaggtctgggactcttcaactttctcttctagggccacagtagactccggtgtactgcctttctggccgcacctgggtatgggtgacaagagggcccccttccgaccctgcgcaagtgtcagactccagcgtgggcccttgcaccggactgccacaagcctgaagcaaaaaatccgtacttgttgcccacctgaatgccttgctcagcgcaggcctacacctggcttccacatttacggaccactaaaactttattgcaaccttgttgacccaggtctattacacaccaggaatccttcagaagccccattcgcctcacatggacacactcggtaaccagcgggcggcacaacctctccag

SEQ ID NO: 92 - DNA, 3394 bp, Homo sapiens
ggatccccttatcaaagctgatgggggtcgctggggaccccccagccttttgctagagcctgcacggctgtgggagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcatccgagctgcatccaggggctgcgctggacaccactcaccaacagcgaggagtccctggatttcagcgagagcctggagcaggcctccacagagcgggtgctcagggctgggaggcagctgcatcagcatctactggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgggaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaatacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcactccagataagatcctagagcttctgttggaggccatgggactagattccagtgctcatgacccaaaagaaacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccacaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaaaaagttcattaagctggcggcccacctcaaggagcagaagaatgtcaattccttctttgccgtcatgtttggcctcagcaactcgcccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctgtcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggaccaaagccaggaataacgaatgaccaagggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggcccctgctttctttccacagctttcttccaacagcaggcagtggggctgcgggcctgaaaaaaaaaaaaaaaaaaaaaaaaa

SEQ ID NO: 93 - DNA, 3997 bp, Homo sapiens
gccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcaggtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcgggggggaggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacccgagagaaacgcaggtgttccagaggcttccttgcagacaaagcacccctgcacctcccatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctcc

SEQ ID NO: 94 - DNA, 2907 bp, Homo sapiens
ggaaccatggagctcagcgtcctcctcttccttgcactcctcacaggcctcttgctactcctggttcagcgtcaccctaactcccatggcaccctcccaccagggccccgccctctgccccttttggggaaccttctgcagatggacagaagaggcctactcaaatcctttctgaggttccgagagaaatatggggacgtcttcacggtacacctgggaccgaggcccgtggtcatgctgtgtggagtagaggccatacgggaggccctggtggacaacgctgaggccttctctggccggggaaaaatcgtcatcatggacccagtctaccagggatatggcatgctctttgccaatggaaaccgctggaaggtgcttcggcgattctctgtgaccaccatgagggacttcgggatgggaaagcggagtgtggaggagcggattcaggacgaggctcagtgtctgatagaggaacttcggaaatccaagggagccctcgtggaccccaccttcctcttccattccattaccgccaacatcatctgctccatcatctttggaaaacgcttccactaccaagatcaagagttcctgaagacgctgaacttgttctgccagagtttcttactcatcagctctatatccagccagctgtttgagctcttctctggcttcttgaaatactttcctggggcacacaggcaagtttacaaaaacctacaggaaatcaatgcttacattggccacagtgtggagaagcaccgtgaaaccctggaccccagcgcccccagggacctcatcgacacctacctgctccacatggaaaaagagaaatccaacccacacagtgaattcagccaccagaacctcatcatcaacacgctctcgctcttctttgctggcactgagaccaccagcaccactctccgctacggcttcctgctcatgctcaaataccctcatgtcgcagagagagtctacaaggagattgaacaggtggttggcccacatcgccctccagcgcttgatgaccgagccaaaatgccatacacagaggcagtcatccgtgagattcagagatttgctgaccttctccccatgggtgtgccccacattgtcacccaacacaccagcttctgagggtacaccatccccaaggacacggaagtatttctcatcctgagcactgctctccgtgacccacactactttgaaaaaccagacgccttcaatcctgaccactttctggatgccaatggggcactgaaaaagaatgaagcttttatccccttctccttagggaagcggatttgtcttggtgaaggcattgcccgtgcggaattgttcctcttcttcaccaccatcctccagaacttctccgtggccagccccgtggctcctgaagacatcgatctgacaccccaggagtgtggtgtgggcaaaatacccccaacataccagatctgcttcctgccccgctgaaggggctgagggaagggggtcaaaggattccagggtcattcagtgtccccacctctgtagataatggctctgactccctgcaacttcctgcctctgagagacctgctgcaagccagcttccttcccttccatggcaccagttgtctgaggtcgcagtgcaaatgagtggaggagtgagattattgaaaattataatatacaaaattatatatatatattttgagacagagtctcactcagttgcccaggctggagtgcagtggcgtgatctcggctcactgcaacctccacccccggggttcaagaaattctcctgcctcagcctccctagtagctgggattacaggtgtgtgctaccatgcctggctaatttttgtatttttagtagagatggggtttcaccgtgttggccaggctgatctcaaactcctgaactcaagtgattcacccaccttagcctcccaaagtgctgggattacaggtgtgagtcaccatgcccggccatgtatatatataattttaaaaattaagatgaaattcacataaaataaaattagccattttaaagtgtacaatttagtggtgtgtggttcattcacaaagctgtacaaccaccaccatctagttccaaacattttctttttttctgagacggagtctcactctgtcacccaggttcgagttcagtggtcttgaactcctgatgtcaggtgattctcctagttccaaatgttttcattatctctcccccaacaaaacccatacctatcaagctgtcactccccataccccattctctttttcatctcagcccctgtcaatctggtttttgtccttatggacttaccaattctgaatatttcctataaacagaatcacacaatatttgattttttttttaaaactaagccttgctctgtctcccaggctggagtgctgtggcgtgattttggttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattacaggcgtaatatgtgatcttttgtgtctggttcctttcacgttgaacgctatttttgaggttcgtgcctgttgtagaccacagtcacacactgctgtagtcttcccccatcctcattcccagctgcctcctcctactgtttccctctatcaaaaagcctccttggcgcaggttccctgagctgtgggattctgcactggtgctttggattccctgatatgttccttcaaatccactgagaattaaataaacatcgctaaagcctgacctccccacgtc

SEQ ID NO: 95 - DNA, 2828 bp, Homo sapiens
atatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcgagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaatgtctaaggcctttacagaaacatttttagcaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtgaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaagg

SEQ ID NO: 96 - DNA, 564 bp, Homo sapiens
  modified_base (5)..(6): a, c, g, t, unknown, or other
atctnnataaaaaaaatgtatttattgaatgtcttggaagtatactaatacatttctgttgtaatacattaaatgatacaatatgaaaaagtataaaaacaaagttaattatctctccctgccttccttctacctatgcttcgcattcctcagtggaaaccaattttagtggtctggtatgtaccttcatacctatctccttgttgaaatgaatatatatagcatattatctaaaggggtttggttggttgattgttagtgctgaaatgaactttaaatacatgcattattctgtagtatgcttctttcacatgtcaatatattgtgggcatttctagaagtcagtaaatacagatctaagcttgctttactaacttcctgaggtagacaaaagcaaacaaatattatatatcatcataatggtataatcatttctgtattcagttgtatcataatcatatgattatgttatattttacatacatattatatattgcatcatacataattatacatattacacatatttatatataacagttaaagtaaattcatgaattctct

SEQ ID NO: 97 - DNA, 3619 bp, Homo sapiens
attagggataggaagagattttcacatggcagactttagaattcttcactttagccagtaaagtatctccttttgatcttagtattctgtgtattttaacttttctgagttgtgcatgtttataagaaaaatcagcacaaagggtttaagttaaagcctttttactgaaatttgaaagaaacagaagaaaatatcaaagttctttgtattttgagaggattaaatatgatttacaaaagttacatggagggctctctaaaacattaaattaattattttttgttgaaaagtcttactttaggcatcattttattcctcagcaactagctgtgaagcctttactgtgctgtatgccagtcactctgctagattgtggagattaccagtgttcccgtcttctccgagcttagagttggatggggaataaagacaggtaaacagatagctacaatattgtactgtgaatgcttatgctggaggaagtacagggaactattggagcacctaagaggagcacctaccttgaatttaggggttagcagaggcatcctgaaaaaagtcaaagctaagccacaatctataagcagtttaggaattagcagaacgtgcatggtgaggagatgccaaaggcaagaagagaagagtattccaaacaggagggattccaaagagagaagagtatcccaaacaacatttgcacaaacctgatggggagagagaatgtggggtggggatggatgatgagactgaagaagaaagccaggtctagataatcagtggccttgtacaccatgttaaagagtgtagacttgattctgttgtaaacaggaaagcagcacaattcatatgaatattttagaagactcccactggaatatggagaataaagttggagatgactaatcctggaagcagggagaacatttttgaggaagttgcactattttggtgaaaatgatggtcataaacatgaagaattgtaggtgatcatgacctctctctaattttccagaagggttttggaagatataacataggaacattgacaggactgacgaaaggagatgaaatacaccatataaattgtcaaacacaaggccagatgtctaattattttgcttatgtgttgaaattacaaatttttcatcaggaaaccaaaaactacaaaacttagttttcccaagtcccagaattctatctgtccaaacaatctgtaccactccacctatatccctacctttgcatgtctgtccaacctcaaagtccaggtctatacacacgggtaagactagagcagttcaagtttcagaaaatgagaaagaggaactgagttgtgctgaacccatacaaaataaacacattctttgtatagattcttggaacctcgagaggaattcacctaactcataggtatttgatggtatgaatccatggctgggctcggcttttaaaaagccttatctgggattccttctatggaaccaagttccatcaaagcccatttaaaagcctacattaaaaacaaaattcttgctgcattgtatacaaataatgatgtcatgatcaaataatcagatgccattatcaagtggaattacaaaatggtatacccactccaaaaaaaaaaaaaaagctaaattctcagtagaacattgtgacttcatgagccctccacagccttggagctgaggagggagcactggtgagcagtaggttgaagagaaaacttggcgcttaataatctatccatgttttttcatctaaaagagccttctttttggattaccttattcaatttccatcaaggaaattgttagttccactaaccagacagcagctgggaaggcagaagcttactgtatgtacatggtagctgtgggaaggaggtttctttctccagttcctcactggccatacaccagtcccttgttagttatgcctggtcatagacccccgttgctatcatctcatatttaagtctttggcttgtgaatttatctattctttcagcttcagcactgcagagtgctgggactttgctaacttccatttcttgctggcttagcacattcctcataggcccagctcttttctcatctggccctgctgtggagtcaccttgccccttcaggagagccatggcttaccactgcctgctaagcctccactcagctgccaccacactaaatccaagcttctctaagatgttgcagactttacaggcaagcataaaaggcttgatcttcctggacttccctttacttgtctgaatctcacctccttcaactttcagtctcagaatgtaggcatttgtcctctttgccctacatcttccttcttctgaatcatgaaagtctctcacttcctcttgctatgtgctggaggcttctgtcaggttttagaatgagttctcatctagtcctagtagcttttgatgcttaagtccaccttttaaggatacctttgagatttagaccatgtttttcgcttgagaaagccctaatctccagacttgcctttctgtggatttcaaagaccaactgaggaagtcaaaagctgaatgttgactttctttgaacatttccgctataacaattccaattctcctcagagcaatatgcctgcctccaactgaccaggagaaaggtccagtgccaaagagaaaaacacaaagattaattatttcagttgagcacatactttcaaagtggtttgggtattcatatgaggttttctgtcaagagggtgagactcttcatctatccatgtgtgcctgacagttctcctggcactggctggtaacagatgcaaaactgtaaaaattaagtgatcatgtattttaacgatatcatcacatacttattttctatgtaatgttttaaatttcccctaacatactttgactgttttgcacatggtagatattcacatttttttgtgttgaagttgatgcaatcttcaaagttatctaccccattgcttattagtaaaactagtgttaatacttggcaagagatgcagggaatctttctcatgactcacgccctatttagttattaatgctactaccctattttgagtaagtagtaggtccctaagtacattgtccagagttatactgttaaagatatttagccccatatacttcttgaatctaaagtcatacaccttgctcctcatttctgagtgggaaagacatttgagagtatgttgacaattgttctgaaggtttttgccgagaaggtgaaactgtcctttcatctgtgtatgcctggggctgggtccctggcagtgatggggtgacaatgcaaagctgtaaaaactaggtgctagtgggcacctaatatcatcatcatatacttattttcaagctaatatgcaaaatcccatctctgtttttaaactaagtgtagatttcagagaaaatattttgtggttcacataagaaaacagtctactcagcttgacaagtgttttatgttaaattggctggtggtttgaaatgaatcatcttcacataatgttttctttaaaaatattgtgaatttaactctaattcttgttattctgtgtgataataaagaataaactaatttctataaaaaaaaaaaaaaaaagg

SEQ ID NO: 98 - DNA, 2106 bp, Homo sapiens
gagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaaccctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttc

SEQ ID NO: 99 - DNA, 566 bp, Homo sapiens
tttttttttttttttttttttttttttttttgcaacaaacattttgtgtttattgaataattactaagtgccagaagtagcacaggaaaccgtgtgtgtgtgtgtgcgtgtgtgcgtgtgtataggcggcgagtggggggcaatacagaattattcattcaagttatttaaaattattcattcaaattacttaaagtacctactatgtgctgggtaggcttggtgctgggcattgggtggggggagttgagtataatcactcacttatttgttgaatgtatatttactgaacatctgagtgccccacactatattagcactaatgatatagtaaaccaaatagccttgttcccatcatagtgtcaggactccctgaaaacagcatctccggatagggaaactgaggcagtagagcttcccacaaaggtctcattggtgagggcgccgggctttaacccagcatcctgacccaggctggccctgctgatgggagccacctccctctcgtcctctcacacttcctctggggcactgatgatgagtcattaataacagaattttaatgg

SEQ ID NO: 100 - DNA, 608 bp, Homo sapiens
cagccctgacgcttccgtggggccacttccttctttgtctcctagcaacggcgggtagcgttgttgacatcccgggaggctgtgccgccggcctgagcccagagtttcgcggcctccgcgatggcagaggtggaggaaaccttaaagaggatccagagtcataaaggggttattggaactatggttgtaaatgcagaaggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctcttatgagtataaaattctatttcaatctaaaaaaaaaaaaaaaaaactcggggggggggcccgtacccaattcgcccttatggggggcgtattacaattaactggcccgcgttttacaacgcgtgactggaaaaaaccctgc

SEQ ID NO: 101 - DNA, 4879 bp, Homo sapiens
gcccgggtgggtggctgcgcagggccctacctgggcgggagcggctgcagagccctgtccacgcggtgcctccccagcacggcacctcccactccaggctgttggttacctggccgggagctggcagagaccaggatttctcctcgccgccgttgctgttgttaggggaaacagaccatctgcatctagacctgcctctctctccgctccccacttcagacgagctcttcctgcctggaatctgtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgacgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaact

SEQ ID NO: 102 - DNA, 396 bp, Homo sapiens
agcggccgcccttttttttttttttttttttttttttttggagtatatgttcagttagggtttattttggtatctgtcatagaaaacccccaaaaccagcagcttacacaaggtagaagttgagattggttctccccttctctctcccatttaagtaagtttgtgctgatatctggctctgccatcatcagggaaccaggctcctgtcatccctaaaggacggcactcgtctgtacacgtggcagtatggctgccagggctccagccatcacacccacattccaggaaataggaagggggaagaaagggtgtatttgtcttttaagaatccttctagaagtgtcatgtaacatttccacatacatttcactggccagaccttaactataagggcag

SEQ ID NO: 103 - DNA, 803 bp, Homo sapiens
  modified_base (619)..(619): a, c, g, t, unknown, or other
  modified_base (778)..(778): a, c, g, t, unknown, or other
  modified_base (785)..(785): a, c, g, t, unknown, or other
  modified_base (797)..(797): a, c, g, t, unknown, or other
tggttttttttagttttaaaatattttcactttattattatgcttataatattattccaacagactgtattaaaggcagtgatcactaacacagaacacgacagggcgaagaggcagccgggccgattgcaggacgtggcctgtcgggccagggtcgctgacatgcacgctggtagctcatacactgctaccctcagcacaggctgcaggaattagggacaagacagatgccgccggactcttagaagctatttaataaatatcatccaaaaacaaaatggaaaagaaacaagaaaccctccgagcacaaccaccttaggccaactgaatgtaatctagtttattcaaccaaaaattgagagagaaggaaaatattgaaacaaacaaacgaaagaaagcagttcttaagactagcagtaaataaatttatacaacagttcggtctgtataatatgatgaaataaatctacatcttttcttattttggtgctttgaattatacatacaaacaacaattacagggacttgttcacaaagcatgtaggcctagaaaaggctctctgagaccctcaatggcaactggtgaacggtaacactgattgcccagaactggtatttnctttgcagaggccaacagctttgaacacatgattcgcctacaactatttgctttgtctgtcttttctgtttttgcttttgtctattatcttttaaggcaccaaacaactgtggccagtgaaaagaaacaaaaactgcagtctgtccatttgaatatcangactagntccttcctaatntcacac

SEQ ID NO: 104 - DNA, 3331 bp, Homo sapiens
agggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacacgttaaagggtaccactacatcattgcaaatctggaatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcggcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaggaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttat

SEQ ID NO: 105 - DNA, 1619 bp, Homo sapiens
ccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcctgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttc

SEQ ID NO: 106 - DNA, 1653 bp, Homo sapiens
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctgagacaggatttcaccatgttgcccaggctggtctcaaactcctgagctcaagcaatccacctgcctcaacctcccaaagtgccaagattacagacctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgtaaaaaaaaaaaaaaaaaaaaaaaaaaaa

SEQ ID NO: 107 - DNA, 735 bp, Homo sapiens
gagtctgcccttgcgagctcagagtgtgcccgtgcgccgccgccgtcgtacctgccgccgccgccaccgccaccatgcccaacttcgccggcacctggaagatgcgcagcagcgagaatttcgacgagctgctgaaggcactgggtgtgaacgccatgctgaggaaagtggccgtagcggctgcgtccaagccgcacgtggagatccgccaggacggggatcagttctacatcaagacatccaccaccgtgcgcaccactgagatcaacttcaaggtcggagaaggctttgaggaggagaccgtggacggacgcaagtgcaggagtttagccacttgggagaatgagaacaagatccactgcacccaaactcttcttgaaggggacggccccaaaacctactggacccgtgagctggccaacgatgaacttatcctgacgtttggcgccgatgacgtggtctgcaccagaatttatgtccgggaatgaaggcagctggcttgctcctactttcaggaagggatgcaggtccccgaggaatatgtcatagttctgagctgccagtggaccgcccttttcccctaccaatattaggtgatcccgttttccccatgacaatgttgtagtgtcccccacccccacccccctggccttggtgcctcttgtatccctagtgctgcatagcccggcatttgcacggtttcgaagtcattaaactggttagacgtgtctcaaa

SEQ ID NO: 108 - DNA, 777 bp, Homo sapiens
ggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattc

SEQ ID NO: 109 - DNA, 2400 bp, Homo sapiens
ggcacgaggtcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccacctcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaaaaaaaaaaaaaaaaaaaaaaaaaaaaa

SEQ ID NO: 110 - DNA, 491 bp, Homo sapiens
  modified_base (487)..(487): a, c, g, t, unknown, or other
ttttttttcgcttcacaccgtttttattgaccgatcgcagcccagcaagattgatcgagctggaatgggaagggacttctcctcccccaggcccagctcgccagggcctcgggccgtgctgcagtttctggcctttggtgtcgctccccgccccccagccccgcaaaatcccggcttcttttctgtctgcgcggccgggaccgcccaggcaggcgccggggctccggggctccggggggagggactcggcggctcggctcggctccgcttctttctcctgcctgcaaatatttgctgcctcgctggaaatccgacgatttcgcgcgcgctctgcttgcaaagtctttaagtaaacacgctcaaatgaccgccccgggcggcccgaggcacgctctctccccctccgcgggattagtaactttaggacttcgaccccggggctccgctttgcctgttacccaggtcgggcagcgcgcgggcgcccggngccg

SEQ ID NO: 111 - DNA, 6450 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctccgtcgggtcgccggcttcaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgcctttgggggtgccctgggatccctggggtagtccagctcttattcatttcccagcgtggccctggttggaagaagcagctgtcaagttgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccaaggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaataaagtcatacagtagctcaaaaggcaaccataattctctttggtgcaagtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcatttttttgcatccaattgtgcctgaacttttaaaatatgtaaatgctgccatgttccaaacccatcgtcagtgtgtgtgtttagagctgtgcaccctagaaacaacatacttgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaact

SEQ ID NO: 112 - DNA, 537 bp, Homo sapiens
ttttttttttttgatagcaaataagttttaatcagcagagaccttaaacgtcaatcatggcaagaggaggggacacaaacacccagcgcgggcttgctaaattcaagatttaaatatattgcctttctttcactacaatcacaactcacttaggtagatactttaattcacattttacagatgagaagattcagagtttaagcttcccaaggacagaaaggtaagtcagtgggaaattccatgtacattccattactaaatgccacataactgtttggataacataagaagagtgggtcattatatgataccaattacaagatattagggatggtggaggcagtaatttctgggataagaactataatttacagaataaccagacatcatctgatctggtgaaacctgtgcattcccacaattaggctttttcacactttctctctttaaatgtgcaacaccttccccatcccctttacttgtagcagttgattctgcttcttatatcccgagaaagcaactaccaccaaatctacc

SEQ ID NO: 113 - DNA, 1488 bp, Homo sapiens
ccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtctatggagccaaaatccgggcccctcacgcgctggtcatgacctttctcttccggaatggcagcctccaggagaagctgtgggccatactgcaggccacatatatccactcctggaacctggcacggtttgtgttcacctacaagggtctccgtgccctgcagtcctacatacaaggcaagacctacccagcacacgcattcctggcggccttcctcgggggtatcctggtgtttggagaaaacaataacatcaacagccagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcatctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactggagaagttctagattcccactgtccaatagaaacacgtgagccatatatgtaattaaaatgtttctagtagctgcattacaaaaaagaagcctgggcactgtggctcacgcctgtaatcccagcactttgggaggctgaggcaggcagataacctgagatcaggagttcttgaccagcctggccaacatggtaaaaccccatctctactaaaaatacaaaaattagctggacatggtggcaggcacctgtaattccagctacttgggaggctgaggtgggagaatctcttgaacctggggggctgctgtgagccgagatagttccattacacttcagcctgggtgacagagtaagactctgtctcaaaaaaaaaaaaaaaaaaaaaaa

SEQ ID NO: 114 - DNA, 543 bp, Homo sapiens
  modified_base (471)..(471): a, c, g, t, unknown, or other
gctgttcataatcatcttctttatttattgggttactttatttattcagggtgggttccctccaccccaaaaataccagctccaggaaaaccatggtatctccccagcactttgcagggcctggcatgtggaagatgtaccagtaatatttgctgtatgaatgaatgagtctcttcatgtgcaggtgacttatcctgcctctgccactcgacggatgtttcagatgccccttagcggatctaatgatgtttccttggctcaagcacaaaagactcctgcttagctggggaagcagggccaggccctgggaattgcagcctctgggcatcagagcccggcccttccagctaatcggcctgcccacagacacaagaggagagggctttcagtgagtccttgactgttccccaagttgaagacctcacaggcgcagccttcacgggtttccccttagcctcgggaacctcctgngggcagagcgggctgactgggaaggaagctgaggccacagaccctctgcagagcggcagggtggccctggcc

SEQ ID NO: 115 - DNA, 1575 bp, Homo sapiens
gcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtaccctt

SEQ ID NO: 116 - DNA, 2119 bp, Homo sapiens
ggcacgagtaggggtggcgggtcagtgctgctcgggggcttctccatccaggtccctggagttcctggtccctggagctccgcacttggcgcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatcttaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggccccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatattaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtta

SEQ ID NO: 117 - DNA, 433 bp, Homo sapiens
aagatacactcaaaacctttattcattgatttacaaactgtacaatatttacaaagtttaggcattaatcccatattgacatgaatgctgtggagagtctaaaaataaatatgtggcacatagcttaatatacacatcatggctctttacacttaagccattaccaatagtgagatgtaatggagaatttaatgtggtagaaaagtcagagtggctgaccagtcccggaccttccatgtgaatgactcttccttggctccttgaggctggggatagtgagcaaataactttctttcaagagaattaaacactgccattctgacaggcacatgggacgcatgcagcaacatctatgcagagtctgcaagcactccctgggtggtggttgaatctgcaccactgtggacctgatccctgtacaccagccagggag

SEQ ID NO: 118 - DNA, 339 bp, Homo sapiens
tttttgggatttcctgctattagcagcagaacgcatcttcattgaaatattcattccacacattttggttctaccttgaaattccacaccacaagtctcatataaaatgagaaaatcatttcctcaacttaggaaatgaggcctatttgttgcaactctgtgatcaaacagaacagacataattatcagcttaatatatttctataggatttatactcttacaggatttatatgcacttgtactgctacgtatgtacaagtaacataaaactaaaaataagatatgcataaaaacaacttttaatttgattgaaaataaaataacagtcgtctctgaca

SEQ ID NO: 119 - DNA, 3336 bp, Homo sapiens
  modified_base (3317)..(3317): a, c, g, t, unknown, or other
cggcggcgactgcagtctggagggtccacacttgtgattctcaatggagagtgaaaacgcagattcataatgaaagctagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcggagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggaccnaaaaaaaaaaaaaaaaaaa

SEQ ID NO: 120 - DNA, 2393 bp, Homo sapiens
atgagttcctatttcgtgaactccaccttccccgtcactctggccagcgggcaggagtccttcctgggccacgtaccgctctattcgtcgggctatcgggacccgctgagacattaccccgcgccctacgggccagggccgggccaggacaagggctttgccacttcctcctattaccgcccggcggggggtggctacggccgagcggcgccctgcgcctacggcccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccggtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccaggacagggaagggagcaggagcctgcagtcactggcttggctttactttgagcccccaacccccctctcccagccctggtagggttccccaaccaaagacggctccattaaaaacggagtgcgtcatgcaagggggtagggggtgacgctgaagaggaagagttgagtctgtctgggactgtgtttccctgtggtggggagctggggcaagatgaggcaccaggaaaggggtggtagtcagaggagggaggaggaataaggggaaggaagagagagggagcaggcggagcgagagagggagaaacaggcgcggggtctcaggttggattatttgttggccttaagtcccaactgatgtccattagccggactcgaaagtgaggagccgttaatgtggactatggatcgatctacgtcattacggattaacggcctggatttatcattgggttggggggatgacggggggtgggaacaagatggatggaaagggagggaaagacaagatgcaactaggaagagacacacctgaccagcccctccccccaggctcaggtgggagttccaactgctcctcccctcccccatctagagtctacagacggcacaggcctaggagactaggagggaatctggagggggcgctggaggagtgcgaaacgggggaagggagccggcagaatagagggcattcccggtactggctggagtctgtgttcgagggtcgactaggggagggggtcctgggcccggtgaccgcaggcctcagcatctccactctgcgtaacaggttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtaaggtgctggaaagggagggaggacgccgagggaaaggcctgtggggagccacgggcgtcagagagacccgggaaggaaggctctcgggtgggggagccaggacacctgctctccggcgcagacagcggggcccagcgctctcctggacgcccccgccgcacagctcccggcgggtgctctgaggcctcactactcgagcccacccagcatcccgcgtcgtcccttccttcccgaggaactgccctcagcctgatcaggcttcctggtgagaactgaggagcggactcacttgatgtttcctggaagcagagcaaaagttctcttgtccctgtcgcgtctcattttgtccatgtcccccgtgcacggttcaatggtagattcgctgtcctcagcgggggccttgaagactccctgatcccagacctggtcgtctctcccaccccctccccaaagccactggaaggagcacatactacctagaagtaagaagaggagcctcagaagaaaacaaagttctattttattaattttctatgtgttgtgtttgtagtcttgtcttagctctggacgcgaaatacttcgatgatgatgatgatgatgataataataataataataacaacaacaacaacaataataaagatgtgaaaactcgaa

SEQ ID NO: 121 - DNA, 450 bp, Homo sapiens
gctcgacaccaagagcctctccaagaaatgcctgcttctgagcccacctgtggcggacgtgccatcctgcccgcactgaagcagaccccgaagaacaactttgccgagacagaagaggctgcaggcaatgcagaaacggcgcctgcatcgctcggtgctttgagctacccgcatctggtcagtgccaggcccaccaacctgcagctggagattggctctctatagcatttcctgatacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaaaaaaaaaaaaaagtcgacg

SEQ ID NO: 122 - DNA, 141540 bp, Homo sapiens
gaattcggctgtgaattcatctggtcctggactttttttggttggtaggctattcattattgcctcaatttcagaacctgttattggtctattcagagattcaacttcttcctgctttagtcttgggagggtgtatgtgtccaggaatctatccatttcttccaggttttctagtttatttgtgtagaagtgtttgtagtattctccaatggtagtttctatttctgtcttcgcctacttttcaacattttgtgtaatgttttgcataagcatttgttgaaatgaactgaattagtttaggatcccctcagcctgcccaaaaactggcccctttgctgactcccatacctaaatgttctaccaaactgcaagatacctacacactccagtggagtctacatcttcctgtagtctaacctgcaccactaggggttcatgggtcccgagctgtggtccacagcacacctgttgtcctgggcttataatgttgctgtgaagaaacaccaggataaatgttcggttttcctcaggacatagttttggtgctcacttttattaaccctgtcatgtccagcagagagagaagaaacatggcctgggaagactgaagggacctatgaagtacatcatgcgtagttgttcctggtctctgttgtggagaatggagatgctggccacgtgcaggagtgctttagagagcaagggctcccgagggcacctggaatcccaatttagtcactttataagctctctgtgctcctcaggacagtggggatgatacacacacctatgcctggggcttgtcacaaggactaaaggtgctcatacacataaagcccttcaaacagatcctgacatttagaaaatcctcctaaaaataccaacaattaaggagctggtagggggtgggtgggggtttgggaaggaacacagaatatccatcggaagaatggtaactaagtaagaacaatagctactggtttttgaataccaactatgtgccaggcactgtgctaagcaatttatatataatgcatttctaaaaaacaacgaactttgcttggtggaaattctggagattaaaagtattatcccagaaatacgtgaatgatgcgtaatcttacacccatccgtgttttcattactgaaggcagacccagatttcatagtccccaagttgactcctcaagttgttctccttctacccaacctttataaaaagacatgtctttgtgttcttttaaggtcttttacagcttttgaaattctccttgggcattcccactgcttcttgttcagtatctttttttatgagactcctatgttcctggtgattgaagcttacttttttctcattttccctctgaaaaactatcaagctcaaaaatgaggatagctcttgttgacactagtctaaaacctgccttaccttctttagaaaacaaacacactactatttacatattcacttttcagcattcaagttccaaaatgcacatttgtcagaaagtcatcattctaagctaaagatgcaaggtgatgcagtattgtttggcgactctaacttagtgaaatttcccttttctctgatttttatatgcaaatcaagatttttaagaagagaagaaagaacttttttcacatgcaaagaaaattgtgtttcattccttttgcgaaaaatgtggtttctggacgactaactcctggtttgcctctttcctacatacaaagctctctcaccgacagcccaggaacacacagctagtgaaacagaacaatggacaggaagcctcctacttagccagttcagcacatagtccttgatgaccaggcaggcccagtgtcactcaagaaagtggaagattgaacgcccacaggggaaatttgggtctaatcagccatcttggctccctcctgtaagatcatggtactcggaacaataatctctgcctaagttatctgaactggctgcttgtgctatcccataaatctatggagtgattaaattgcacaaccttcctcctctcttttaggccagataaacatcttaggagaaatcgttcacttagttaatttggagagtagtcagctgaaataaacaaagcttctagctgagatgtgcagtatggtgaaagttgtctgagatttgggatctggattttctctgtctttattttgcaagtggtggcagtgacatgaattagtaatgtgctcagcaagctcagaggaatacctttcatgagagctgcttctttcccaccatatttgggctgctttgcggcttcacctttctgataccagcactatctcatcttcctggttccttagtgatgcccctgctatgaatctctatcccatattccgtgcaacctgtttataccaagaacgtcactatcttcttcattcatctcagatgccatggaagcccagtagctactgctctgtccctgacaccttttcctcaccctgaaatgaccttgacataccacgacaggggccagagtctggttcttgtcacatggcctgtgtttcagccactgtaagttgtcatcgctgtcagagtctccaccctctttgccagttacataagaggctacatagacatctgcttcctagcacaagcttttattaaccagaggcagcgtgagaggccaagtaagcaagaggtccattccggagccctgtcctcagggagggtgaggggctgtcgtcaggtcaggtcgtggctcctggggcaattcagctcagctctgagcctgtttgcagccttcagtacaggggatgacatgtgatgttgtcagcctgaaggggcaaaaaaaagcagcagcctttcaaaatcagaatgcccctgctgtttgtttccttttggaacacaataagaacagactggggacatgactctaggctgtcaacgcttcctaccagcttccacagcacctttcatatgccagaagaaaaaaaacaagttgcttaagttaaacaaggactcaatgaatagtcaaaataattgtttagcttggatataaggccttaggtaaatagatgattgcctgagaccctgggccaggaaaagcagctaggcaggacaccgcttgttctgtccctcagaaaacagcccagtagcctctgctcctctgaggactgttgttactgaattaattctctcttcccaccagcgtattaaagcaatttaatatcagaacaggctccttaaagcagggagaaggaaagaaaactttctatattagaaatataccattaacacataaatcttactacatgagcgcttccattaaatagaatgcttcagattgggaatgtctggtgtgtttgtattgaactgttttcatgttgtgaaatttctcagatgcattgttagcatacttacaattgtcctgcctcctgccttactggtattcttaacatgatttcatccttttgaaaatgattatttactacaccaaaggggcattgttaggtttatgaggaatcagcttctcaaagtgcagtgtagttatggacagtgtcagcactgaaatggaatcttccaggtatggtttccttatttgttgttattgccgatttgtttgggtttgtttgcttgtttaggtatctttgctctcacctagctccattgttacttgtctcttcttcccaaagtagggtgcagtgtgaaaatttgttgccagctaatttcagttctgctgaagaatatttttaataattgctttcttacttaaaagtaatagattccttgttgatccaggacaggatttggttgtcttgcttgtacagcccatttccactgaaatgctctttgattgaaccgtgaactcatcaagggagtgggattctcctggtattctttttccacaaatcatcatgactgtacatttggtttatcagcaaacagcaatcaaagcatacattacgtaagaaaaagttaatgctgacctgtttaaccaatttttcatcttgataatataggaaagtggttaagaacatgaggtttcaagtcggttctgagtttaagcataagctctgcacttactagctctatgagtctgaacaaattatcaaatttccattagctttgcttcctcatctgtaaagctgtcaaataataataataacagctactttgggttgttgggttgatgatgtgagataatacatgtaaaatcctcagcacagtataagtattcaatgaatgttatctaccatattattttcacataccttataatttccttacaacaactctgtgatgtagataaaattgctatgatttatgcaatttaaatattagacaactggacttcagagtgattactgattcatccagggttacccaagatggcaaaatgttcgtcctgtcagtacaggagcccccaagttcccagtgtattgccctcccttcatccatttggccacagggtactcttcctcagtttccctaaatctaaaactttacgtaataatgggcctccgctgccctagattgtcaggtgaagaccaggaagaaatcctgtcacaggcattaaaaacttcatcaatattacacagtgatttccaaaaggtgagcgtgaaagtgctggaaggagcccatgagattacagcaacaggtcaacaaatccacaagcccagccagctttgtagataaaatctatacagttcctctttggtaatactgagaagaaaatactaatggagaagtgatttccaaaaggtgagcgtgaaagtgctggaaggagcccatgagattacagcaacaggtcaacaaatccacaagcccagccagctttgtagataaaatctatacagtctcctccatgcatcatttttactgtatatgtctcccttcttaccattataaaacataaatttatttaaagtcagtgagtctatcattttaacatgctgtattttctcaattgatattaaaactacaactacttttatgtgaggatctaagattttcatttcttttttcattttaaaaaccaggtctacacactccctaaggtgtgtgtttctaatcataaggttagaaaacaacggtattgtagaaagagctcttcctatgaagtctaacagcctagatttaagtgctaccccactgactataagctgaaagcaccataaacttaggcagctcaattaaagtccataaatatttactatatcaggactttaaggggcttgtgcccttaactgggactacagagcgaatagtagtccttcacaaccattcttctctgagcctctattttcttacttataaagtaaagagaataaaggtgtctctcctcacagggttattatgaaggtccaatgagaaaaaacaagaagataaatatactgtcatgttgtgaaagtgctttgtaaacatagggtgttcaagacaactgccgaggagagaaaaacacttcaacttttcttggtagctttcctttattgaccagccaccccatattaaagtacataagtacattttttttaaagctaacagctttaccctcattgatgtaagtttatattcagacctataaaagtacttttccatctattcctcttcctctcactttggtttataacatttatccataaattacaatattctttcatatcaatatggcaatgtaatatcacattatacaaagcattgaagaaggcaccaatgtaaaattcaaagcagagaacagcccaagagctcatggcttgcactttacaaccccaagtacactcaaggcccatctatgagggacattttaagcatatcagttgcatgagttgcagctgatggggatctcacccaggccctgagttcctccaggaattaggaaaggaaggagagaggactgttcttcctttcagctcccaggctggggccccagtgccaccttacttcgggaaaaaggtgatttatgggagtgtacccattactactggaattgaaaccttccctgattcagttcttccagagatacattatgtctcacatatttctacctctcctctgattccatattatatataataactggtgaatttggtctttatttctactcttgtcaacagagaacattcacttagaatccactaagtaccagacagcattcaaagtgctattatggagaaatgtaaataacatgatatgcatgatccctgctttgcaggagtttagaaggaagcaaaccagcatttattgccaggcagtgagtattattttagcttctctgacaaggacacttcgaagtgggtcttaactttattttataaatgaggcgtctgaggctcagagaaataaatctgccaagatcacacaagtagcaagcgtctgggccagatttctccaaggcctaccgtgttctaaagtccatgctctttccactctactccattacctcccctgatgagaaaggcaggacacatactaaaaaggaaaacgaacacagatattaaatattaaaggaaaccagccaggcgtggtggctcatgcctgtaatcccagaactttgggaggccgaggtgggtggatcacaaggtcaaaagatcaagaccatcctggccaacatggtgataccctgtctctactaaaaatacaaaaattagctaggcatagtggcgtgtgcctgtagtcccagctactcgggaggctaaggcaggagaatcgcttgaactcgggagtcagaggttgcagtgagccaagatcgtgccactgcactccaacctggcaacaaagcgagactccatgtcaaaaaaaaaaaaaaaaaagaaagaaatatatatatacatataaagggaacctacaaataaataagtactagaaactcgacagactgtcctgtgtgcaagagtggccaagtgcctggagcaaggctagcctgtgagccgattctaaagcacattaatgatacaatctggaaaaaagaaaggtggatgccagtcagaaaacaattgtgttggaacaaagaaaaattatagtctgggtgattaacacttttaagaacgaaagctacaatgcaacacccatttgtctttctggattcagagtctttgtctctgtggccctgggaagcataaaaagacttttgtctttttatggaaatttgtaagttgctgtgattttcacagacccatcttctaagcacatacaagagacctgtgttccttgttagtgtattgccaacctcattacactcagtattaaatattcctttccacatagcactcttcagtatggtgaatgggaaccatttttctcctgacatctggggttggtttcattgaggatttacaggggaaaagtgaatgcacgtggcaatgttttcaagcctttgtttggattttctgttttctaggagatatacgactaaggggtcagacgggggttcgtgctgaacgccgtggctcctacccattcattgacttccgcctacttaacagtgagtaatcaagtgtacctggaaaggaacaaacgttttcttcaaaaagaaaaaaaaaaatcctcatttccctctgaacttcgaaaccttctggggtctgccttccttcctgaatctctcttctgccaactagaacttaaccctttgtctttgagtttcctcacaagtgaagtaattctggccctgcactgcctctcagagctccactgagggtcaaatgagatcaggtcagctttaaaagtataaatctctggccaggcatggtggctcacgcctgtaatcccagcacttcgggaggccaaggtgggaggattgcttcagcccaggagttgggcaacagagtgagaccttatctctacaaaaaatcaaaaaattagctgggtatggtggcacagcctgtagtcccagctacttaattgggggctgaggtgagagaatagcttgatcccaggaggtcaaggctgcagtgagccaggattgcaccactgccttccagcatgtctcaaaaagaataaaattttttgtataaaaagtgtaagtctcaaaaactgtgatgccctatacagggaagctactattttcattttccagcacattctctctaccttcagccagagctagactaggtgagattccattttgtttttaaaaccccacagggaaacctcttctacagttgcccttagtaacctacctgttatggaattctcacttctttgtctaatataaatccttgaggtctattcttgccttcctggtaaaactcttcaccagggcaaaatccaaagcacttgctgctttctcccttgaatcttacaagttcattgacttctaccttcccctccctaaactgctcctcatcagtagttttgctcaacctttggtccacaattttcttaatcttaggtttctttgcaaacccaaaccagtgaccagtcatccctccagatttcatgccttataacgatcataatcatccttcactgtagacttgtgggggaggtggaagagcaagtggataaatttcacaatttgctccaaggttttcagtgtttggttctcatatcacttcccatctataaatttcaaagtgctagattatacccaaagaatattactttcctttgacataaataagctcagctaaagaggcaatttgatttacttcaacccctggaaattactaggagaaattagaacctgttatttctgatccttcgatccttgagaggccaatagtaggtggcatgtttgtatttctcctggcttgttaatctcccatatcaatgtgcaatgtctgttttttttagcactttcagggacacagagacttggagtaattctttccacactagagataaccttccctacccagaccctcaaaaatgctttttggaagaccgaattgagccattagaccaatgcaatatgggatacagcctgcgggagctctattggtctctctgacctttccttataccctgaatgggctgttccagctacccacggaagttacacctttgacagtctctagactgagtggatttccaggtcctaggcatgtggtttctccaagcaggacaaggatgagcaaggggttccatttcactgtttcatatagaccagaacgctccaacggcatcccattttgaaagtcggagggagaaaacaaccgaaaggcctcttttcaatagtagatgagtgttagttcatggtttctaatatgaaccacaaaggaattaggaaaataaggggatatttctgtttataattccaaagtttcattattttaaaaccttaatcccagtgttaataagcaactttactgctaatggtggttatgtttgcaggtgggacagtggaatatttaattatctacatcataggattctgcaacatttttttttttttttttttttacaatttgcctcttttacttttgtaatctgaaaaacaactgcaaaaataaataacatttaaagagaaactcattgcagataataattcagtgtcatattgttcaccacgtaagagatcatctgccagcagctgctatcctgtcttccctttgctggagatcctccaggacttctgagcacctgggctcaaccccagcctcatttccctggccctggatgctgcctgcccctctacccccatttcaccccacctggtactcacaatcctccactcatcgagtgacagtgctggccatccacccggaaattccctttagggtctcctcagcattccattccggataactctttcacccatgtctcttactctgtaacatattgcagatgcaatattaattttcctttagcatattttcctttataggtggtctccagtttttttaatgtatcaaagacaccccaaaaagactataagatcctaaagacagtcttctctttatccctaaatagactatcagatcctaaagacaatcaattgctattgatcatttactaactatagttaactgaccaattattaaagggtctcctcgaaaacattatattaaataactatgaatgtaaatcatcccctgtgtttaactgaacaacacgggtaggaatgaaggcctctaagattttcctttgtgatacgatttacctcttggtataatgcaccaaagaccccattggtgagttgaaactagaacagataacattactgtggtcgccctccacggttcctaacttagtttgcaattacaacagcttgtcaccatggagcagagatgtatgaacatctgtgttatgcacagtcacataaggtatatatggcatatctcctactacttcatatactgtctatttaattctctttaatatcattcacgtccttgttgtggtttgcctgagttgttagtgtgtgctttatgcctaaagggaaacatcttgggacatttggggattttctcgtagaacttttctttttaccagctcattcttattctacactgtaagagctgaactagtttaaagtgattctttagatcacttaccttaattttgagtcaagtttttcccagtgtgggcacagaccccaaacttcattttccttgggtgcttgcagttttgttctctctcccacagtaaaatctaatctaggatttttttaaaccatttataggaaaaaccaaatcaccatagctgtcactccccagctctgcatccctgcagccttccttccaaaatgttagtgaaacccacacaactgccatcccctttccaaagtgtcgctgggtgggtgtccctcccccacccacctcagtatatgcattgaatcactggagcacgcaagagcagaaatgtatactaaatagtgaggcccatgcatttccccattggtcccattagtcacagccccagtttgtcacaggagggcagaggacatcagaattaaaatctaaaattacttgtcttcaaccagaacaaagtttctaggcgttaaaatggataactagaacagaagtggacaaatgactgtccacacaccaaatctgtcccctcctcctgcctgttttggtaaataaaattttactgggatattgctatgcccatttgtttatatgacatctatgactgctgtcactgaaacagtggcaaagtagttgcacagaaaccgtgtggtctacaaaccgccccccacaaaccccaaaatactcaccctatggccctttacagaacaaggttgccaatccttaacttagatttttttaaacagatttaagagagctttttgacaaagccacaagcacattcagtccagtgtgtttatctttgttaatgtctttttttttttctgttcagtttccactgccatcactttactttcaagaatggactcacattgactaaatttttatgaacagaagaataaacagagagggaacctctgttattgatgcagattttaaattccaatttaaaattataatttctacttgcacattcttctggaagagattatttttgcggggaggggaagcacatgtttggggcagagggaaacacagtactaccaatttcatgtacctgttttctgcatataaggtgactcttggtttgcctggcatagtcctagtttgcacctgttgttcaggagtatttattaatagtgccatttttcattcccagagtgtcctgatttggacactaaattacaaggccaactgcttatataggttttcccaaaaaagagtatttaaatttaatgtttctcaaagatcacatgcaggaataagcttaaaagatctattgtataatattgtgactatagttaataacaaacgtatatttgaaaattgctaacagagtaggttttaaatgatctcatcacaaaaaataagtacgtgaggtaatgcataagttatttagctttacttagccattccacaatgtgtgtgtgtatatatacatatagatcttgaaatatgttgtataccataaatatgtacaattttgttaaaaataataataccatatcatatgcattccaggaataaagattagaaaatcattttcataagagattcatctagatcaatagaaatacataacactcattaaaagctaatttcgttccctgtttctattttacacaatttagaagagagtcatctctatgaacttcttgaagcttctctggataaatagcaggaaactgtggcctcagcactgtttgtgtgggacataggaaagatagatctttaaagactgttatctttacacctaagcatagagagccagaacagagagaaaagggggaaaattgtttttattccagatgatgtcctaacacagagaactggagggacggaaaagtaacggctgtattctcccaatgtcgatttcctatagatttatttcatttactaattctgtttgtaggggggaaacaaaggaggaaaaaatgtagagaagagtgttctgagacttgtggacccagaggggagagttgcagaagcaattacaaccttctgcagagcaggcggctccagcagccccgtctacagctctgtctcctgatttaatataatcagcagcctgagtagataatgactaggttgagatgttcccgtggcaaccatctcagagcaacacaaagtgatttccacaccggctcagcagaggaagtgacatacaaagaaaacgtgctcagggactgtggagcttgaggaaaagaaacagcttcagcctgaggttttagggcaccaagtatccactgctacagagaacccagagctccagaccagcccctgggctttgcagtagtaggttaattggctatttggcttttcctgactgttaatttgctaatcttgatctttaaagctctattccttcagacttgactctcctgtcagggtcatcttaactgcacaagcatgaggtcattttagtagagctacaaaaatatttccctttacttattatttcccaaatggaaccaatatatacaaacatatatattttttaacctttctatgaagaagtgacccagagactcaaatatttttttaaagctgccatctaaaacatattataccctgcagccattctttctttgacatataaaacacactctctttgacatataaaacacactctcgatgaaggactgttgaacaaaagccactcagtatgctggaaatcatctggccctaagtgatagccccatcttaaagatggagggacagtttccttccagactccatttcctatgagagaattcttggcagacagttacagccttttagtaaccttacagataccttttcctgtcacctataagaactacacaaaatgcaaagaatctgaactaaaatgtcattggatgatttgaattcagtcatgctgagaagatgctatcccacccccagccctgtgttccccaagcggagaagggaggtgtccgctgggacttgttcagacttctcctcacacttgtgagtgccaaggtaacaccctacaatttcaaagttcaatatttaccttcctctagaagaaaggcaaggcactggctgtggtagtggtgctttctggctcagctggatcttgctccatgatggtgcactcagggcttctggctgcaagctcccagcacttcagctgcggaagtgccagggcagcaggatggttaaccactgaaatgcccactagcttgcagaagacagagttggcgatgtcccgactctccctattactacccctcgacggagcacctcctatggtaggcattgtaccagtgctggagatacaaagatgaatgagacatggccactgcccttgagggatttacagtagcataagctactgtatctacaatttatttacaaatacattttgatgtggtgtgatacaccaaataatacatgcctgtataataacagcatacataatatgagaaatatatgcatctacgggattcagaggagttcgagaagggaataattaactctgtcttggaaattaaggaagtcttcctgggagaagttaaaacacaagcagattatggaagcaacagtgaaataaaagagggctgtatgctaaggtcaactattagggccattataaaatacgctttaagacttaagaaaccaggaaaacattgtcaacaagtttgctcaactagataaaagtgttattgaaagacaaagtattctagtgggatccaagcagagaagtcaggaaaaattatacaacatatgtctgagaaaaaacatattcaaaaagaaaccattttcaccttctacatctaaaagtgaaaacagccattgccttctgttaacctgtctgacatcatttaatggattactttttatctgaaggatgaaaaatagaaaattgagttagggagtccagtacttcctctgggttttcattcatttattcagtcaacaaacagcacctactctatgccaagaaggccatgaaacccaggtgctctgagccacaccaaccgccacaggactgagatagccttttgtatgatggctaccttctgtctcagacagcagtgggactggggtctaccagagacaccaaacaaaaatatctgaacaattccttttaagtcaacaaggaccggggagatgggggagaaacctgctatatgctatatctgggcagaaaattctgagggctagaaaggaaactatgagatattctgctaccctcaaagagcaaacaatctcattacatagacaaggaaaataaacattacaccaagtaccatacaacaaagtaaatgatctaattctaaaataagtaacaataatcagagacaagagaaggcagagattactgaagtaacctgagcagaagaaggctttatggtcttgtgctaaacactgaaagataagacagtgttgactgattaaggagttgcctataagggagactgacctacatatgaggacataacgtcattaagtaggaagaaggtccaaaaagtagcaaataaagttcattaactagagagaaaggcttggaatgccaagataaagaattcaaacttgtctcattaagaagaggatctctagagaattttgcaaaaaaggtgaaccgtataaaacactgtttgagaaaattaactaacatccatatgtaggagacacagtttcaatgaatccaaagaaatgtaatcaggctgcagactgtgatggctgtagagatgatagtgtaaatccacagatttcatataaaagaagacataaaactggaggatactgaatattgggagagccagagttggtctggccatctgaaaaattggagctgagatcaacagtcagaaaagttagaggatgagttaggggaaagatggtaagctccactgggacaggttgagtttgcaggagaatcgagtggaaatgtccggaagaaagctagaaataatggactaaagtgcagaggagaggtctattttgggaattccacttgggaatcataatcattcatgagccatctggccagaacaggcgtcatgaagtcaaccaactacttttgttcaggggcccctgtatttttagtttataataagcttgattttgaaaagcattacaagactgtccatgagaaatcccacaaagaaattagtttcctttagtgagaaactctaaatttttctctgtgagaaactatttagacataagagttcaggcaccacctcactccctcatgatggattctattgagtacaaaagtgacttgtgtcagatcccagcggatttgctaactcacctgaacacagcacagagaaatggccattttctactacagcacttccttgagcgaaactctaacccactcaaagtattttcagcatagtggcttctttggatttctggagacattaaaatatagagggaagcagaagtaaattaagttttttttactgaagttacctatgagtcactgagctaaaatgacttgtttgttcaataaaattaaattcaacctcctacccagaaacaggcagagcctatctctgtgacctcattaataaaccaaatgcagggctatttttttcattgccatcccaccttcaacgtttcagaatatctaagggattcactgtggtccccattctactgtatgtatgaaaaaccagaacatggccccatccttaatatcttttgtatgttttcaaactgagatctcagggttcacacacaagatcaaaaagacctttttttctttctaactagcagaccaaattgccttggggcatctgggtcctttattacttttaagtaagctggggaagaagggcagaagttatggaggaaagtcccaagaagaaggtggccaatgccactatatctaacaacagccaccataacagctctagtctgagaggtgcttaaccccaggcacaggatgtacaaggccaggtgtgcacccctcttaggcaaggtccccaggctataggtctcttggaagcctggaagcacaggaggattgctgtgaatactaaaaataaaaatgagtcccttcacaaccaaaccacggctgcctctctgcctcttctaccatggttgccccacccagagctccaagctcactaagtcatcatcaatagaggagcccacagaaagaccatgagctttgaagttagacctgggtttgaatcctacttatactgtgagcttgaaaaagatgcccaaactacttaatgttcacatacatgcaagattttaatttgattgggttgtggtgaggagtaaatgagataaatgtgtccagaagcctgccttgcttataataggtccataataaatacagttgagttttggatgtcccttctctctctgctgagtacatccctctccagccacctcttctcctaggaagcatctgttcacccttcaagccctggccccatcattatgtcctttgtgaagccttcttcaatcctcccaaaggagtgaactcatcattctctctgcactcccactacatctcccagaaagcattatcacattgtaactgcgaagtcattgaacctgaatttctggaggtagagcccaggatattttcaaaacagcctcaggcaacctgaagcaacaagcctggctctgggccttccaggaatatttgggaaccactatatatgtcaattatggcatacaaattatatctatgctttgcacagttagactcatttaatccccataaacaccctataaagtagccactactattacagatgaggaaactgagactgaaagaggagaaataactcaaccaaggtcacccagcttgtaagccagaatttaaaccccaaatatataatcgcagagcacaagcttttaaccatagtaaagtataatcctttttatatatgaattttaatattcaaaggcaatatatgatgcagtatactccttttacaatgaacatatatatgccaattattccttttaaatattttttataaattatgaaaattttctttttatagtacatttagattatttccttttggtattaaatgacttcagtatcattgaacaaatattcctataactgaatgagaaaatatgagattaaacatctaaaaaatcagattttgcaatatttctactgtattttctaatattcctgccactctggtggaagacgccaaatgacagactgcacatttcatcgcctgaccttgtgttctttgataagaaagaaaagggcgtggtggtgacaactgaggatacttgtaagctgcccccaaagaagaaggaaatggaatcgctattgtgacaaattaaagtcagatttgtagctgccaccagttgctttaatttttctcaagggggagttggttatttcctgtcgtgcaaaccatgaatcgctgaaagaaacaatttctcaaaatgtttataacatattagataaaaagcagaatagaaaagtctatatccaaaaagaagatctcagttatgtttattaaaatatgccaaaatccgaacaagggttctttctagatgattattgttcttctggttttctatttttttcctactggaagcatgtattccttttataatcagaaaaaaatgagattttatttttaaaaatttcaatgtccgccagaaaaagaacctttatttttcttccaaaggaatatcaagatgcagaaaatgaaattgcagccataggccagaaaacattatttaacaggcctaaattggaaaattggttggaaattgtgaagttgggtgtttctcaaaagctatgtaagctactttgcttgtcattttaaagtgaaatttattccaaagagcacaaaatcaaagttcttattcacatttgaacagcactttagactttgcaaagcttttaaatgaagacactcaaaaaatcattgagcccagtttttcattttataagcaaacaaaaacaaaaaacaggccaagtgattcaagcaaagctatgaaagagttaaccagggttgggctcttcttacattctgtctttccactcaaccatataaggcttccttatataagccttaccttcaagatataaaataacttttaccacttgcaaaaagagaaaataaaacaccaggattccccttgaaggtggttggtgttggctccagagccggctgcctgggtttagattccagtagcagttgctacaggactttgatctactgacccctggtcctctgattcctccgggctagaaaagacgattcacaagtgcacatctcatgggttattgtgggaagtagtgagtaagcgtgcttagagtgctagtgtaatacctgccatggtatcaattattttattattacagatattagtattcccatttaagaagggcataggacacataacaatataaagtacttgacttatagtgaagtagagaatggcctattaacccttttcagttttccattctatagttttatcttttttctgacaggtatttactgagctccccctacaatgcctgcagcattgctttccaacatgtggttgttaataaattggtagagagactgatggctggaaaagtgaggctagggaaggttgttttgttttgtttttcacaagacattgaagcaagctgaaatcatggtgagaaggatctagttgagaaagaaccatggaatagaccagaaaaatcataactgagaataaagtgtcctgagaagatgggaggggatgactggcctgagaaaaggaggcaactctcctaacagcaggtgggaagaaggaaagaagggatgcaacgcagggggtttggtaggtttcatagcagaaaagtaaggaatttcccatctaacaacttctcgtttctccatgaagtagcaagccaggtagagaacagtagagatggggcagcccgaggggccaccagagcttggtggtcttgcttttgtggcactatatgtcagtatagcccagagagatagttctgtgctccacctggccaccagcagtcaatgtcatcaaaagcatcacagggaaattccatcagcagtgtggtcgcctggctcagccttggtcatctaagtctttaccattgttttcagctttcccctcctcagtttgggctagtatagacaagcctaccactattcccaccctcccctacatgtccacatctcccttagcaatgcacactgaaaaacaagaaaaattataaccttgtgtctgactcccctctccttcctgaactcatttgtgctctgtgggtaatatcatctataaggaaggtctagcagtggaaacaagttttccctgtccctcggtgtctgggccctggcacacccaccccatccacatgatcatccactactggtcactcatcacctgaagccagctgtgactgcagctagttcacttctaggcaggggttgggagatgtcccctccttgctttcctgtgattctggatcctataatgctaatcttttctcccaagagatgccaagaaattaggcaagtagaagcccagtatccccttccctctcctacctaccatttttcgacaattctttatgtgtaaggaaaagaattccccatctcccatcttcttttcccattctttcatttcatgttctaccacattagctttattttctgttttggagagaattcttggaaaagaccagaaagctaaaaatgtatttttagaaagtcctccttggaagacctaagatcatccctttttaaaaaaaggagaaagggtaaactagattacactattcacatttattgagcaactactgtgtaccaggccataagtgctaaaagaaataaaggatgaacaaaacattttgggaaagggctgatacagaactcactagaacaccagctaaattggcaagtgtcacgaggttctaatggagaaagcactggacattctagtgaaggaccttgtggaaaggttggcattggcatttggacaatgactggatttttgtaagtagaagtttttttaaagtgcattcaaaaaaagaccaggtatgggaaaatgctgaatacgtttaaagggtgagcacctcagattctgcggtgaatgtgtagtgctgaaagggtattgcatagttggagggacggtaatcagaattgatgtaaaattaggctgaaacccttactaaatgttaagggttggttagaaccagaccagtgatggtcttgaatgccaatttataatcttttttttttttgagacggagtcttgctgtgtcacccaggctggagcgcagtggtgtgatcttggctcactgcaagctccgcctcccgggttcacgccactctcctgcctcagcctcctgagtagctgggactccaggcgcccaccaccacgcccggctaattttttgtatttttagtagagatggggtttcaccgtgttagccaggatggtctggatctcctgaccccatgatccgcctgtctcggcctcccaaagtgctgggattacaggcgtgagccaccacgcccagctataatttaatcttttttaaatggagatttcacttagggcttgtgagtatagacaaacgcattttctttccctcatatcttatatagcaagtggttgctcctgcttaatattaaaactaagttacaaagaaagagtcagtttttcctgggtatacagtgaaaacacattccctcttcaatcccctaacccaaccttctatgcctaagatcaagagtgcttttacaatatgctttataaaaacctcaaaaactcatctcagtattcaattatatttcaaaattgttgcctggaaagcccaggatctcaatccattattggtgtacaatctataattgtatattggaattctaaaattagctggtatctattgaaagtgttctatgtgctaagcactttatatgtataacattatttattcctctcaaaaatgtgtagattctgtaaattattatcctcaagtgacacaaggggcaacagaagcactaaggaagtagagaggttcagtagctgtatgggagcatagtcaggttgcaaagcttcatggaagactctagagatcatcctctgtatctctctgcaggcagctcccatcaccctccctgctgagatggatgctcttcaggcaagcctccagacacactaagactgctgggatattcttattcattcatttattcactccattcgtatttactgagcacctatgtgtcaggcgctcttctaattgcttagctcttacagtggaaagtgaacaaagttctttcatttgaaaggcctcttctccatctaggtgcggtggctaatcccgcactttgggaggctgaagcaagaggatcacttgaggccaggagttcaaaaccagtctgggcaacatagcaagactctatctctacaaaaaataaaaataaaacaattagctgggtgtgtgatgacgcgtgcctgtagtcctagctactcggggggctgatgtgggagcatttgagcccaggagttcaaggctgtgatgagctggaagataccaactctataaagtaaaagacctcttattttctctatcacaattatgcctcttgattataacaataattattcttttagaggaaatattaggtctccaaaatgtcaacagtgttcttcatatcactgccaaactatctcaacgttcacatagaaaatcatttttacaggcaaatagattataacatctcagaaggaaatgtcttcaaagataagtgctgcctaatatattaaaggacaagcaagttctagttggtcaaatggtctcttcgctgggaattgccaaacaaggataacctgttttgaaagaattatagcataatcaaaaactcctaacacaaaagctatttgaggcataacttaactcttccccagtgactcatgacttctcagaatcttagaatgtttcagagtcaattaatttaaacagcaattattaactggaacttcaaaacaatctttgtgaagagtttagctttcttattgttgcaatttccatttgctgaaccaattaaggccagtggtaccacctgagattttgaaaataaatcagtgggtttttatttcagctgtttggaaatgactaatagagtaatacaatagattaattttatctaacattaatagctggatgtataagaaacacccactctctagaaattaagacatgtcaccatagtcttatgacaagagtgagtctcttatttttgaactttctattgaacagttctcaccatcttaaatcaccctttgttatgagtttttaagtgtcttaagtagagaaggttaagaaaatgaatacttatactcctttaaatactaattaagaggccctggtaaccatttatcagtaatattaatggcatgaaaattgaaaaagtatgactcaaaggtgaattcagggcaatttaaattatatataaaaaataaaaacttaggtggaagaatttaaaaattttaaaattctgcccaaattgtggagtgcaattttatacactgggaagaaaaatgacagcaataaaaattttaaaaagatgaaaaatattttttaaaaaattgtgcaacccaattttaaatgggactgagaaatataagcaaagcatcgacaaaatagtatattgttagaaaagctatgcaaatgaaagaacattaaaatcactttgctatataaaacaatgtcaaatgacagtatcaagtgtccacatcccctgaggccaagtttcagtcatctagtccatatggagagtaatgctgtgccctcagctatttccttcttaggactaatggaaatcaaattagctcccttttcatattatgtgaataaaatataagttccacaaggaaaaggactttattttgttcattgctatatcctagtccccagaacaatgctttttttcacatagcaggatcttgacagatatttgttgaattaataaatattgaaggcatttattcaaaatgacttgttgctatggatggcgtattttatttttactaaagttaaattatatataacatgctgacaacagcagctggagagtttgccctattgtgtgaagtttttccaagaagagtttagcaaacagcatatttgtgaagattatcaatatgtggaatgggtgtgatattacatacatatcaaattatttgtatttgtgataaaacaaatatttaaagtacaatattgaggattttagtaaaaggagaatttgtcttttctaaacaaagaaaattatagggtgtgactagatcatcctttatccttaagtcatattttccaaatctttaatcctttatagcaccatttcccaaagcgtggtatgggaacacaggcgatatttttgttacagaaacaaccttttatcttttactataatcgttacatgtatattttaacatgtactagagaaaatgtaattagcacgtcaaatctgttttttattgatactaattttatataagttatatgtaagtaagggcccgggcatggtcactcacactcgtgaattagcactgtgggaggccaaggcaggaggatcgcttgagggcaggagtttgagatcagcctgggaaaagacatctcttaaaaaaattaaaaaattagtcaggcatggtggtgcacacatgtagttccagctactcaggaggctgaggtgggaagatcacttaaatccaggaggtcaaggctacagtgagctatgatacaattgctccagtgcactccaacctggagacagggcaaagatcctgtccctaaaaaaaataaataaataaagaatacatatatatatataggtaaaaatgaatttatttgattttttaaaaaagatattatgtaagtagtggtataggcagatatggtaaaaaccctactaaaggcaagagcatgactgaaattgaggaaactctgaccttagtttctacttggagcagtgagactcagagcaaatactccattcttcttgtaaaggtgttcccaggcttcagacaggaacccattacacaacagccttcccggggcgtttttacccagcagaaagacttctaaccctctcagacccaatgcctcctttttatagcacattttataatctttactaccttgatagatcctttaccctcttgaaaggaaatctacagcctacttattctcataagttaaaaaaaaatcataataaggccctagcttttaatacacaagaaatacaagaaaagcaacttatgacaaataatgttttcaataagtaaatacttgggcataatcacccttgaaggcctacggatatggtctatattgcacccacatgcagaatccctgtgaatgtgacagtccagtgcagatcgatacaggtgtattatgttggaaatgcagtcaactatcataagcagtcttgccactggtaatttcctaagaaggcgaacaacttctgggaaagtcatgtccaccactccctcctctcacccacaaccccccaaaaacaacattctttccttagtttgcatagtagttacatttctgaaaagggaatacttgtattaaaactgtacaagagaacaaccactatggaaaacagtgtggagattccttaaagaactaaaagtagaatgaccatttgatccagcaatcccactcctgggtatctacccagaggaaaagaagttattatatgaaaaagatacttgcacgtgtatgtttatagtagcaccatttgcaactgcaaaaatgtggaaccaacccaaatgcccatcaattgatgaatggataaagaaactgtggtatatataaatgatggaataccactcagccataaaaaggaatgaattaatggcatttgcagcaaactggatgggattggaggcaattattctaagtgaagttactcaggaatggaaaaccaaacatcgtatgttctcactcataagtgagagctaagctatgaggatgcaaaggcgtaagaatgccacagtggactctggggactcggggaaaggatgggaagaggttgagggataaaagattacaaattgagttcaatgtatactgctcaggagatgggtgccaaaatctcccaaatcgccactaaagaaattactcatgtaaccaaataccacctgttccccaataacctatggaaataaaaatttttttaaaaattatacaaaagaatactttgtgatctccatgaatatatacatacctactatgtacccacaaaaattaatgattttaaagaaaacaaaactttgagcttacctatcagagaaatggggttaggttctaggttcagatcattataaacaggcttttcacccatatgaatacctgaccagccattgaaaaattgaaggtgatacaggacaatcctctgttgtgtagaagagccccatatactttgcgacatcccacatccctggctcccttccattaaattctgttctggccatttctatcatttgacagccaagaatgcccccccaacatttccccaatgcctcctaggaggtaatgcctcccacattgaactcataaatcccaatagcactcaaggatttatttttattttaagctatccattactatctgacatgtagtcattaagtccctttgggctttttatttatcagtgatagcttttggttccaaagtgtcttaaacgtaagagatgatggcttctaaggctattatcagtaatattctactattattacagaagtgttattgtttatggcttgttattaaccacaaagtttctcttttggcttaaagttggtaaaaataaatattgttaaaataaatttcagaaagtttggttgctcttaagaaaaacactcaagagttaggggctcctgaaaagtctgaaattcgatataattagaaatctggttactgaaaaccagatactttaaaaattaagcctctcagggctgcaaattttaacagcacagttttaaaagcagattcttggcataatgttgagggggttttgaccaagtcatgctgagaaatttgcaactgcagcattcactggggtgaacgcaaaagagaaaaaaacacattaatgaaaactttccaggatgaaagaccttaaacttagcttaacttctgaactttttgctctgctgtgatctttctgacactttgaagaatgattctggatgggctccaaatagcacactcctcactcctcattcttaaacagtgtgaaatctgtcaacccaatcaggtcatcaagagggcagactgccacttgtcattactgagaggggtgttctctaggacactgaaaatgtcgggcaggtcttgctttttaccaagagctagggcctggcattttgagaaagacacttatttccactcattgggaaagctagcttagcacccgtgtgcaaatcaagtatgccctattcaatttaccagagtgatgctttgacatcattccccttaacagaaagctgacaatcaacaatagcccacagggctttatttgcaaagatggaaagctcaaaacagttgcctcagctcaagatggaatctaattttttaaattaattctaatgcatgagacaaagaaacaatatcagttaatgagaagcatgggaactgtttgaatgcctgttcttctacttgttacacgtgttttactgagtgtcttaatcttttggtactctctttctctgcttataaacctggaataatgataggtattattagctctggttattttgttgtgagaactgggacccccccacccctgggcaaaattaccaagtggattaagttttcctttgacttttaccccttccttactcacaccattgagctaagcactagggattataggtaaataaggcataggccctgccctcaaggaactaacagtttagtgggtgagaaagacaagtaaatatgataacgcatatatggctgaagaactgctttgctgaatataattagggtggggttgctttggagcccagcacaaaacactagccaccatggggaaaagactaggaagactttccacccaatcaccttctttctcctctctctgtccctttgtcccacctttctgctccccccaaagccaccaccccatgacttcccttctgagatagaaccccaagctttagactgttccttctgcccccttccatcagaacttatccatccagcattgcctacctaattgcaaactaattcaagctaaggcattcattgattcattaactctttctgagtgatatttgcattctgactggagctgtccttacacactctaccaatctgtattgggcatataccatgtagattcatttcaatcttttacctaaaagactgataagtggaagaaccaatccttgaacctcattctaggccaagtatccttttctcagaaatagtttcttattccatttcatcacagtctgcaggctctgcctagcttgtcagcacctgtagcagagactccgtgtacagcaataggatggtgctaagtctcatctatgtggagatgagacatataccagagagaatggagaatactgtcatggcaccatagctgctcctggaggtcccaaccccatgagggcactgcttagttatccagccacactacttgcccactagaagggcagctggaagtcccaggagagggcagagatttcctccaaccacacccctccccactccccacccgaaggccactgtttttggctcttgctgctatggaaggacaggagtgagctcccgctcttgacaggaaactctccaggagcagaagctgtaacttcctcatctttgcatcatcagcacccagcccagtgtctgagccaaagtaaaccctcagttaatgtttggagaaggggaaggaaaggaagggaagggtgagctgttgagacaatcgaggatagttcttctctttggccattctaaaagtactcagctaaatttattctaaaatgctaggtctccaccttctgcttctctctgtcccctccttcagacacagcaattaaactcttcattctgagcaatccagtgttaacctaggatgagagaaggcaagagaaacctcagtgccaacagtgcacatccttttttgtgcatttctatgccccctcactttcatcccctgccagttgcatctccacaggtcccacctgagtgggtttctctgtggctttagcacggtatgtgtatattcatattttttccaatataggtgtatgtaagcttgttctcagagctctatagtttccatagtcgtaagaataaaaacatttttctgaccgaccactccatccctgccatgatgctttacctcatctggaagggtgtgcaggacccagtccattaccagaaaggatacagtctcatagagcgcaactctcaagcccatatgggattcagagggtggcgccaaaaacttcttacatttcctctcagactacctttcactggtacagaaacctcctccgatgggtgcttgaatgtctcttctctcttgatctcccttcctcattccttttctactgctctgtctcctcacctctctacctgaccacaccccctacatatataccaggtgccatcttgcctctatgccatgtggaaagaaaggcttctgactccatcaagtgtgagcggcaaagtagagcatcactttcttgagagcagagcacccgctagacaaatgatctttctttttcttgctcatattttttgctttatacagtattttaatttctaggcacttttatactaaaaccttccttacctgccacagctgaagtggaaacataagtagtgaaggggataaagagccaatcccatcaccttcctctgggtagttgaggacagaaacactcacttaaatcttcttgtatgagtccgttttcatgctactgataaagacatacccgagactgggtaatttataaagaaaaagaggtttaatggactcagttctacatggctggggagacctcacaatcatggtgggagatgaaaggcatgtcttacatggcagtggcaaaagagaagtgagagccaagtgaaaggggttcccccttatcagaccatcagatctcatgagacttatttattaccatgagaacagtatggggaaaaccaccccatgattcaattatctcccaccgggtccctcccacaacatgtgggaattatgggagctacaattcaagatgagatttgggtgaggacacagccaaaccatatccattctgtatattcaggtaccacaatgccttgcacagagcaggtgttcaatggatatttattggtggaggcttcccagtgttcatcagactacaaaaaacaaatagccaattcattcctcacctgcttccagttcatttgacaactaccaaaaaatattatatattatagccattcctaattaaaacattatgcaaaattatcaatgtaggtagagatatttagaaaacacataaaagacatatgtgttttctagagggaaggtaagaagaaaacaatgcccatgggccatgttaagcagcaaggaaaggttttggattatgccctgacaccatgactctatcaacagatgtcccttcaggtaaaatttcaggagactataaggcttggctccaaagggttaaacacaaggcctgtatgcatccctgtgcatcctggcaggtttttttttttttttttttttttttgagccgcctgtttgcccaagtaactcccactctttcccttccccacaagctgctgctccactctatgtacacaacaaaaatatttgtcttttccaaagctgggggcactaaccaatgtctgtgaatttctttgtataataacataataatcaaatcacattaagtcagtgtcaagtgagacatgtgttttcaattttaaaacccacaagtgattatttattccttaatacttcatttgtacatttagtgagagaaataggaaagtcacacatacatagaatcgcttccaacctttgctatgaagttatttctctaggtgttttctagttattttacaagttgtctttcactattagcattacagtatttctcactctcttgttcactgataccaagtttaattttcagcctttacaactttattgatttttaaacactcgtatttatgaattacacggttagaaagaatgaataagaaatgtcctcttattggttttgttttactatactttttatgtggtaaataactcataatatgagatctaccatcttagcaaatttttaagtatatagtacagtcttgttaactgtaagtacaatgttgtacagccgacctctacaattttttcatcttgcatgactgaaactccataccccttgaacagtgatttcccatttccacttcccccagcccctagcaaccaccattctactttctgcatctatgagtttggctactttactataccttttttttaaagtaccaaaactttaaatcctttgggtgctgatacatcattttggatccctataccccagagaaaatagggtcctctgctagactgccttatgtctccactctttgccctttcctgtaaagagcaggatataatgagcagagcatcatcttcaaggtcagaaagacccaggttccatccctgctctgttacttatccattgcatgactttgggtaaattattaaacctttccaaactcatttcttcatctgtaagatgtacctattttaatatcaacttcacaatacctacttttatgaaaatcaattggatcacaaatgtaaattacctagtaggtgctcaatattttgattccatcaccccagctgcaaaccctagcctcgtatggattgaatacatggaataggagacccagtgtgtttgttctagatgaaatacatgagatatgtctttgggatccattcagacatgcaggtggacactgcagtagtcatctaaaacaattctttcttctctctgaactagttcaatgtgaaaatatatagctttccatgccctgttaatgtcttaatgaaacctgcttccttaagagtgtcctgcaccaagaatacagacatgattagtcctaaggtgccactacaatccatagagcgccgtgggcactaagagagaaatctcaatgcacaggtaaatttctcaagttctctgaggaactaaggatatttacacttaaagagttatattccaaccacatataaaaaacacataattaaatcacagaatccactccagtgaaatataattcaagcagcctttgtaacctataaagaaaaaggaattagcttccagtgctttccctttctaaagcataaagcataaagcagcatggcacatgtatacatatgtaactaacctgcacattgtgcacatgtaccctaaaacttaaagtataataataataatattaataataataaaacaagaaggggctgccaaaaaaaaaaagcataaaggttttctttctggaagtttttagagatcaaagtttctatctaggcctctaccaatgagtaaagttagtactaatctaccatcattctaaagatgcacttataatcatttaggaaaatccaacaaattcagaaaagaaatagaggttcaagttcttctacacaggggatcatccctgttatctgatgtgttagatgagtgaatcttgcttgttctggacaattacttcaattcaacaattacatggtagcacctatcatgagccagataatgtactacaatagacagaagaacagcttacacttcaataaatagtcatctcattccttcattccttctttcagtaaacaccttttcggtaagctaggcaccataataataataggtaagacatggtcctagcctaacagggtttacagcagcgtgcagcatctgccacatagcaagtgagctaagttactgcaatactaggaggagagctgaatgcctctgaccaggagcccaggaggaaatacttgaggtgggctgccgaaggacagatggcatttcaacaggtggggagaatattcaattgagaaggaatgtgggaatccagatagaaacagaaaactctgggggatgtggcataaaaacagcaaaagcagagatctgtttatctgcagggtacttttgggagataaaaatggaaaagtaagttggcctcatattgtggagggccacgaatgtcagaataaataatataaattaaggagacattgtgggggccattgaaggacttggagcagggggctgacatggtaggagttgtgcctgaggaacgaatccgttggtggtaggtgagatagattgaaagggatgactaaaggccctcagaggggttaatccaatatcctgggacagggagtaaactagcagagacactgaaaggagagaagcagttgtagtacgttatggcacacatctggaacttttgcagtcaaatttgacagtccaaacatatctcccagataaaagaccacacttgctttaaatgtatgctgagaactacagagttaatgcagcagtttttaacctctggagacttagaatcaactcaaagtttggtcacttcaatttgctcaccacaaaccgttgccctcaaaactctggatttgctgtaacatttcaaactctgagaagcggagggttcaataaaaccacattgcgcctggcatgtatttcttctttaggactgaggaaacttgatctgcttcttactaattcatttaaatttcattcaaactgggattttgaaaaacgtttcgattgcccagagaagcttaagagcttacttttaaagccttttttcccctccttacaaaaaggaaacaatagttttccaaccaaccctgaaccccggatgtcagagattcaacccattcgttgggatggagtttatggtaggcaaaaaaaaaaaaaaaaaaaaaaattgactaaaaccagcagattttgccaaaaatccgtgtgttgcatggttaaggagacaagcatttgctcctcttgaacacctacaagcgatgcagcaggggtgcagacagtcagctaggaaggagctcattctattccatgactcaaatcagccatgttggttttcccttcactgtcaagaacataaaggaaaaatggcaattgaaaaaaaaaataagcatgttaaaaaggagagtgagagaaacaatttcactctgccttaaagaagactttcctattcctccccctgctcctcccacttggtggcaatgttgaaacaaagctcttcttctagtgacagccatcaagaagtcgtgagtattttttgtacacagaagagctaatgacataaggctttaatacattctattcaagacctgagtttggagaacttaaaataacttttgagttcctttaagctcaaacagattttccaacttcaaattaaattttaagatgatggtttgctttattttggtttaggttttttctccctttcttacttttttcctctttttggtggttttattattgttgtagatgttttgttgtatgtgtttttgttttctaatagttacaactcatcttcttttctattaaaaactaagcctagcaaatgccctaaatgttaagaaatttgtttttatcttaaattgctcagaatttcaaagtcatttataatgactttgtcttaaaaatatgtccacccatgtgaggaaatctccacacttgatgatgttaagggccaaataatatatttggttgtcatcagtttctacccatcattttctgaccactgagaatagacacagtaagaaataaacaaatatggcctcttatgaccactggtgatttctgaaagactgggggagtcatagtattttattttaaaaggttttctggcagctattttatgaataaatgaaactttaatgtctagagatgctaaactgtgaaagggatgatttgaatactgaagtcattacaaccaagtctaagttattaaatttgctaaaagcacgtgaaagtgaatcgaagtgtttaatacattgaagggagcactggtctcatccagagaatgacatccttagcacctcgtcaaagtccgtactgtaagttctggaaatgactcaatattgttttctacacacaacctctttaaatttttttaatttcttaaagtagtctatataaaaattatttttacagggcaactgcatcttaggctaggttacttcaatcttaaaatcctcatgtatgctttcaagaaaactgtcatcctagacaacactaaccttttaattttacagggatcctgaaccctgaactagtagaatgtgtgaaagagtgaaagagctgtgctgtaaatctgctacttctgcttcaggacactgtcaaactaattaacagtttctcctgttttttaaagctgcatattgaaaactagaatttcaccctgctttctccagagttccgcattcttgaacttagatgagagcacacacatcaggaaagtaatttaattccatcaacatgtatttcacacctacaacctgcaggactttgtggaaattcaaagaaaatttaacagaaatctggtctccaaaaccttacagcataataagaaagtcagatatgtgaataagagtgaactttgcaaccacacgaggcacaactgagtgttacagcaaaagtcaaaacaagcaaaggacaaagagggtgactagggtcaataataattgtacattgaaaaaataactaaaagagtataactggattctttgtaacagaaaggatgaatggttgaaggtatggataccccattttccatgatgtcatattacacattgcatgcccgttatcaaaacacctcatgtaccccataaatatgtatatacctactatgtacccacaaaaattaaaaataaaacaattataagaagtgaaaataaaataaataatgaaaaaaaaaaaaagcaaaggacagtggcagtggcaagagggcctggaccctggaactccattttgaggttgactcagaaaatgattacaatgtgtatgtataagttttagcatctccacttaacaaattggcttattgttcaaaaagagcatttaacagtgatatttctgtaaatgaagagaatttattccaatttaatcaacaaattttttactgtttccattacatgtaagattattatacactagataccaggggtcagaaaggctgattaaatggtttctgactttggggtgtaatagttgttcaccaataactgtagtacaagacatatgaaaaatcctgtaacagttgggtgtagtggtacatatgtataatcccagctaccctggaggctgaggcaggaggactgtttttagggcaggagtttgaggttgtagtacactatgattgcacacctgtgaacagccaccacactccagcctgggcagcatagcaagactgtcacttaaaaaaaaaattcctataaaaggaagataaacaaagcctatgaatagccactaaccaagcaagaaattttattagaattactagctcaataattatcaaagtagggcttaataacacattattaagaggttcagttggactgatgctcgaaagtgctaatattaggtttatgtagttggatctccacgggtgcttaacagtcagctctgctcacttaaacacaaaggctttctttgttctcagtatcaccctagctacttctgcaccagttagtcactactcgacttctggaaacagttgacatagacctatttcagggaaccagatatacagttgacagaaacagccttataatatggatatatttacagctttcttaaatctcagatatttattctagatttaaggtttctcctggtaccaaaattaatcagcccctatacagagactattccataaagaaggtactcaaaaatgaaaataatttttattaacatatttttgcatttaagccaaccccaacttgtaaaatttaacaattactgtaccagcagtgccaatacaaactttgtattcctaaaattagcaccaaagtagtgcaaaaatgtgttaatatgtagatatctgtgatatttacaaaagaaaagtgaaaagaaaatgaatttcacagttcgggtcaatgctcacatggattaggcaatgaaacattctggaacacctttttataactattccaaatgagaatttggaaaccataaaacaataaaatccaaacaaaggtgcattaggataactgtaaatgcctttaagtaatgatttgtaaaattgtataagggtcttaaataaacctagcattttattaccaggcacactgttaacattccccagatttttacaagaggaatttagcgagctatctgtaagatttagcttagctaatcatttacgtttctacccagaaatacatatcaatacattatcaaagtaaatatggtagctatgcactgggagtccttttggaaacaaatatatcagatctttatcaataattgattaacacatttaaatacttcaaaaaccaggaccttgtactattatacagagggtgctttattcagattgttatatgaatttttttcctcccatcttcagcttcttatatcttcgtttttctttatctcacaaaacacaaattgctccctaaataacactcgataagttattaatgttagtttaaataaacttattttttcttggattgttgcacgttcttcccctttagaaagctaccttgaggattttttttctggttagctttatgtatgtcctcaaataagaaagttaagtgctattgttttcgcaaatggctatgtagcattggttctgaatcatttgcttgttaattaaaggataacccagatagaagttaaacggagtagtcatggcctgccttgctattttagaaaatattggccaccagttaacactgcaacttgtcagatatctacttgcccatctgagagggcaggtttgaaagtacacaaataaagaatacacatcatgatgaccaattcattcaaaaactttgaacatttttagggggaaagacattatatgctacatgttttaacctacaaggcatcatagaaaattaactatgaaaagatttgttggctagctttatttaattactggatttttttgttgttttttattatactttaagttttagggtacatgtgcacgatgtgcaggtttgttacatatgtatacatgtgccatgttggtgtgctgcacccattaactcatcatttaacattaggcatatctcctaatgctatccctcccccttcccccgacgccacaacaggccccagtgtgtgatgttcgccctcctgtgtccatgtgttctcattgttcaattcccacctatgagtgagaacatgcagtgtttggtcttttgtccttgcaatagtttgctgagaatgatggtttccagcttcatccatgtccctacaaaggacatgaactcatcactttttatggctgcatagtattccgtggtgtatatgtgccacattttcttaatccagtctatcattgttggacatttgggttggttccaagtctttgctattgtgaatagtgcctcagtaaacatacgtgtgcatgtgtctttagagcagcatgatttataatcctttgggtatatacccggtaatgggatggctgggtcaaatggtatttctagttctagatccttgaggaatcgccacactgacttccacaatggttgaactagtttacagtcccaccaacagtgtaaaagtgttcctatttctccacatcctctccagtacctgttgtttcctgactttttaactatcgccattctaactggtgtgagatggtatctcattgtggttttgatttgcatttctctgatggccagtgatgacgagcattttttcacgtgtcttttggctgcataaatgtcttcttttgagaagtgtctgttcatatccttcgcccacttgttgatggggttgtttgtttttttcttgtaaatttgttggagttcattgtagattctggatattagccctttgtcagatgagtagattgcaaaaattttctcccattctgtaggttgcctgttcactctgatggtagtttcttttgttgtgcagaagctctttagtttaattagatcccattggtcaattttggcttttgttgccattgcttttggtgttttagacatgaagttcttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagtagcatttattaaatagggaatcgtttccccatttcttgtttttgtcaggtttgtcaaagaccagagagttgtagatacgcagcattatttctgagggctctgttctgttccattggtctgtatctctgttttggtaccagtaccatgctgttttggttactgtagccttgcagtatagtttgaagtcaggtagcatgatgcctccagctttgttcttttggcttaggattgacttggtaatgcaggctcttttttggttccatatgaactttaaagtagttttttccaattctatgaagaaagtcattggtagcttgatggcaatggcattgaatctataaattaccttggcagtatggccattttcacgatattgattcctcctacccttgagcatggaatgttcttccattgtttgtatcctcttttatttcattgagcagtggtttgtagttctccttgaagaggtccttcacatcccttgtaagttggattcctaggtattttgttctctttgaagcaattgtgaatgggagttcactcatgatttggctgtttgtctgttattggtgtataagaatgcttgtgatttttgctcattgattttgtatcctgagactttgctgaagttgcctatcagcttaaggagactttgggctgagacaatggggttttctagatatacaatcatgtcgtctgcaaacagggacaatttgacttcctcttttcctgattgaataccctttatttccttctcctgcctgattgtcctggccagaacttccaacactatgttgaataggagtggtgagagagggcatccctgtattgtgccagttttcaaagggaatgcttccagtttttgcccattcagtatgatattagctgtgggtttgtcatagatagctcttattattttgagatacgtcccatcagtacctaatttattgagagtttttagcatgaagggttgttgaattttgtcaaaggccttttctgcgtctattgagataatcatgtagtttttgtctttggttctgtttatatgctggattacctttattgatttgcgtatgttgaaccagccttgcatcccagggatgaagcccacttgatcatggtggataagctttttgatgtgctgctggattgggtttgccagtattttattgaggatacttgcattgatgttcatcaggaatattggtctaaaattctccttttttgttgtgtctctgccaggctttggtatcaggatgatgctggcctcataaaatgagttagggaggattccctctttttctattgattggaatagtttcagaaggaatggtaccagctcctccttgtacctgtggtagaatttggctgtgaatccatctggtcctggactttttttggtttgtaagctattaattattgcctcaatttcagatcctgttattggtctattcagagattcaacttcttcctggtttagtcttgagagggtgtatgtgtcgaggaatttatccatttcttctagattttctagtttatttgcgtacaggtgtttagtattctctgatggtagtttgtatttctgtgggatcggtgctgatatcccctttatcattttttgattgcgtctatttgattcttctctcttattcgtcttgcgagcagtctatcaattttgttgatcttttcaaaaaaccagcttctggattcattgattttttgaagggttttttgtatctgtttccttcagttctgctctgatcttagttatttcttgccttctgctagcttttgcgtgtgtttgctcttgcttctctagttcttttaattgtgatgttagggtatcagttttagatctttcctgctttctcttgtgggcatttagtgctataaatttccctctacacactgctttgactgtgtcccagagattctggtatgttgtgtctttgttctcactggtttcaaagaacatctttatttctgccttcatttcgttatgtacccagtagtcattcaggagcaggttgttcagtttccatgtagttgagcagtttggagtgagtttcttaatcctgagttctagtttgattgcactgtggtctgagagacagtttgttataatttctgttcttttacatttgctgaggagtgctttacttccaagtatgtggtgaattttggaataggtgtggtgtggtgctgagaagaatgtatattctgttgatttggggtggagagttctgtagatgtctattaggtcctcttggtgcagagctgagttcagttcctggatatccttgttaactttctgtctcgctgatctaatgttgacagtggggtgttaaagtctcccattattattgtgtgggagcctaagtctctttgtaggtcactaaggacttgctttatgaatctgggtgctcctgtattgggtgcatatatatttaggatagttagctcttcttgttgaattgatccctttaccattatgtaatggctttctttgtctcttttgatctttgctggtttaaagtcttttttatcagagactaggattgcaacccctgcctttttttgttttccattttcttggtagatcttcctccatccctttattttgagcctatgtgtgtctctgcacatgaatgggtttcctgaatacagcacactgataggtcttgactctttatccaatttgccagtctgtgtcttttaattggagcatttagcctatttacatttaaggttaatattgttatgtgtgaatttgatcctgtcattatgatgttagctggttattttgcccgttagttgatgcagtttcttcctaccctcaatgatctttacaatttggcatgtttttgcagtggctggtactggttgttcctttccatgtttagtgcttccttcaggagctcttttagggcaggcctggtggtgacaaaatctctcagcatttgcttgtctgtaaagtatttaattactggggttttttaaacaccatctgagtttatgtttcaaagactggcccaatatggtagctcacacttataatcccagtatttatggtaggcctaggcaggaggatcacttaagcccaggatcatcagccctggcaacacagtgatacccccatgtctattatattttttttatttaaaaaaaaaatgcaagacaggctagagtcaggggaatgaggcactagccttacttaaaatttaggggaataccaaataacttggtgatcacagtgtatcatatcttaatgtaatatttttaaaaatcaaaattaaaaccaaaaaaagtcatgagaaacaatatatcaaaaatttaaataaagatccaaagaggtctgcattctgtcatgttgctgaactaatgttactattattcatttgactctaggtgaagaaaaataggtaaggaatcatgctgttttcttctttgttgtaaagataaaaacagatctaaacttaatatctccagctcatggcatcattagtttagtaatattttagtcaaagttagtgaatagtaaccattatttcctatcatctacacttaggatatgtcacttaatttcaatgtcattatcttaactatgaatcttcctaaagtactacactacttggaaaactaaagggaagtttaagaagtaatccatcatttcaatttgctacatttgtggcatatttccatcattcagggctattttacttgcttctgagtttattatataaatataggtatactctcagctacataagacattttcttttagtattttgagatgggggaattttaaagaatatgaaaaaaaggaaaagatcatctatattttcttttagattttccttatacgtaacataggaataatttatttattgaataattgatttcattctatatagagctatcactacatttctttactttcctatgtagcaaaactccttaaaagagtggtctacacttgatattgtttcaaacttcttcttcacattttttctcttcttaaattttttatcataaaataacttcaatttatcaaaaatctgcaagaatactcatatactctttctctatatgcaccatttgttatattttgcaatctttgccttactgcacacatttttgcttaacactttattgtacatatgctactttatcactaaatatttcagcatgtattttctaagaatgaaggcattcttttgtaaccacacttcaattatcagacattcaaataatgtgtttggggtatttctggacaatcactgtgatgtcaacattcaagttttgaaaggcacatgtgaaatgagtattaaaatatttataaatactgtctcatgcataaatccatatccaaaattgtgctaataatgtcatttatgacattttttctgatacagaatccagttaagggtcatgcattgcatttagtgcactgtctctggtattcattattatgaaacaatacctaaggctgtctttgtctttcatgatattgacattttttaagagagcacaggctgattgttttgtgaagtgtccttcaacaattttttctaatgtttcctctttattagaatcagatgtgcatttggggcaggaacacaatatgtgtgaggttgtatcctcagtgcattacattaggaagagcatgatgtcagtttctggtggcattaactagggttacttagggaagatgatgccccctccacatttttccactaaaaactacccatttttttcttctccaattaataagtcttctgtgggtaaatgctttgatattgggtaattaccccattgctttttaaactttcatttaataattttagtatccattaatgattctggcctgaatcagtcattaccatatcggctgcaaaatggtaattttccagctctattatttcttctacatttatcagttggcacattctacaaggaagagatttcacttttccttatttatttacttatttaccttatcacctgtatgaactcattggttcttacttcagccaatggtttacaatccattctttcgttattcattttgagactcaaatttcccgtattttctcagagagatcccttgatgttgtcacttctgtcatttttaaatgattccatcattttttgagctcccccttattctctagtataacaaggtgctacagttcatctgatacattttccatccctgccctagaattggccatttcaccaagataaatctggttcctattagcaaaaagtcatatttaaaaaccagaatctgggtgctagaagtgctcgttgctacttctaggcacttctagagtgttgctgcttctaggcacacaatacaatgtgctcaagtactgtgaatagttcatggccaactctcagtcttcatggtacctgacccattagcagcatttaattttaatgatcgcatcttcctcccagcaatacaatcttcatgaagcttctaggaaatgatgctctcttggctttcctctgtccttatggaatacttcccagtcctctttaattttccctacttttctctaaacccatctaaagtcaaggtagagtctagaactcaggactttttgatccttttctcatctgtatctatacttactccctaggtaatgtcatctgacaactttcaagtttttatctcaagcccagtcttctccctcaagctctggattttatatccatttatttctacttagcaccttcacctgaatctctgatagatgtctaaatacaacatgtgtaaaactgaaccactccagacctggtccacctatagcctgcccttgaattatgcctttgcaagcataatgcagcctaaataacaaactgattttggtcactcactgccatcagggagcacccattgtttcctctgcctctgccatctgttgtgatttttgagttccacagaggaaagggggagatgggagaaggtaggacagaagcccaaattactttacatatgagccgtacatttcctactagactgttaaactgactctacattcaaaattggcagcagacgtcactaatgtggccttagagtgattcatataatttcagctgagataagaaatatcttgacagacattcaaataatgtgtttggggtatttctggacaatcactgtgatgtcaacactcaagttttgaaaggcacatgtgaaatgagtattaaaatatctctactggcaagattagatttttatggcaaccagtaagagagaatacaccattagaaagtaaacactctctgcttcttctcaggggcatccaggtcactttttgtgcaagattattgattcctttgccaattatgttcctggaatattagaaaccatttcctcatgtgtaaactggtgtatttacaaccctcctaattcaggtggaaaaattcatcatacaagtaacagtgtgggatgagaacttggcctaaatgtttgagtctcaattctgctgtagtagaaaaagaataactgctcatttcaaatgcaggcagaagtgtgtgaatttcacttagcataccagcatcattaacaagaaaatgaaattcttaattcatatatttcatggccttccaaaattacattctgaaacaccttgacattttagtaaatgtaatatataagaaatactagttaggccgggtgcagtggctctctcctataatcccagcactttgggaggctcaagacgagcctgggcaacatggcaaaaacttgtctccacaaaaaatataaatattagctaggcatggtggcacatgcctgtagtagcatctactcaggagggtgaggcgggaggatcgcttgagcccaggaggcagaggttgaagtgagccaagattgcaccactgcactccagactggatgacagtgtgagacccagtctcaaaaaataaataagtaaaaattaaaaaaaaaacaaatatcaggtatgttcatgaaacatttcaaatgtagagttcaatagaccatatttttaaaagtatagaaagcatcttttaaatttctcttcttttaatgcatttatttttacagagtggagaaaattggctctcttttaaatatataaatttcttgacttgatgactttccacaggtacaacatactcaggggagattggcaccaagaaaaaggtgaaaagactattaagctttcaaagatacttccatgcatcaaggctgcttcgtggaattataccacaagcccctctgcacctgctggatgaagactaccttggacaagcaagggtaagctgactgccccatctcctcacagcaggccagtggccaagagcatgtgcctcagctgatagcactggtgttggagtcctactctgcctctgaggagctctgtgaccctgagctcattattccatacatctggacttgttcctctaatagaaaatgaaattaacagaaacatcccccttatgaggtgcacgaagtaaaccatgtttatgtgctgaatatacccatgcctaacacatactagccattttcatttttataaaggtacaaaacatatttgcacgatactaagtaaagcaaaattttggactggcagattactaatgagggaataactaatttttttaatttattaaattagctcatcgtaacagctacactaaaaataacccaatcactatcaactcttaattctactttaggctattgatgcactgcattttccttttcataatttttaattcatttgaataaattttaataactctacaattactttagtaatacattgatctgactgagggtggaaattaatgtgtgaccatctgaaaaaagtgttcaggttatgtctaccccaaactgccaaaggaatttaaatttcagcaataaatgccccagtttaaacagaagtcgaagatagattttacagcttgcatgctaagtgatattatactatttatatactattatgaaatatataccactggcaaagcacagtgcctcatgcctgtaaatcccagtactttgagaggctgaggcagcaggattgcttaagctcaggaggttgaggctgcagtgaggtatgatgatgctactgtactccagcctggggtacagagtgagaccaggtctcaaaaagaaagaaggaaagaaaagaaaagaaagaaggaaaggaaagaaagaaggaaaggaaaaagaaggaaaggaaagggagagaggagggtgggagggagggagggaaggaaggaaggcaggcaggcaggcaggcaggcaggcaactaatatatgccgttagaaaatgaacagcaagtaatgtcaaaagagctaattcccaatattaggcctccaaaaggataaaaaaatcattcctaacagcttaaggtctgagattgggaaatttttgaatgtttgcttgtttgttgagaggagaacaagccttaacttccccagccctggaatgtcactgacagagcactcttggcggtgtctctcctctaagcagccacctctcaagaaaggtggtgtgagatgtggaaaggacagagggctggaagtccagctatcacaggccaagtcctagggctgtctttaatattgtgtgagttaggtaaaagtctcacgcaatctaaacctcaaaaataacctaatatcccttcatttttctgacgtgttgtgacggtctttttgtgtcacgctgaggcatttggattttattgtaggacatagggaaaccattcatttgcactagatggtagtatgctaggattttcaactttttaattgtttaatccactatatcccaaagtaaatgtttgagtctccagtgtgattcatttgcgtgctgttttttgtttgccttttcagcatatgctctccaaagtgggaatgtgggattttgacattttcttgtttgatcgcttgacaaatggtaagttacccaaaagaattctcactaaaatatacaccataaagtgggattaatttcatgaaaaacaaaatttatttttaaacactgctattcctttttccttctttccccattttcataaacctacagctactgaagaaggaccggggtaagggaaaatcaactcagatgaaaaataaggactgaatttgaccttagaatcttaggacagtttccttgtgaccttgatcatcccagaggaatttagaaaccacagattagattcttttcttgcagaatattttggccacatccagaagtaaggagttcattgttagttgatgaaaactagaaacaaaagcacatctgatcagccctgacttttacagggcagggtgcttatgcagttttattaagtgagctaaatctgccctgttgcgggtattgctcaaatgtgtttgacatcatcagaagaaaacaattgccgaggaaagaatataaaagcttaggctgcagccaaagggaaaagcaaacatcttcactggtgtcacttcttaagtttttgtgcctataaagaccttccttaagaaaataataaaaaacctattatatttttatctggccattaaacaaatgctgatgagctttgagagccaatgaaagacatcacatttaatgctgatgttgataggtctcttttaagtcattatatatggttttctcatcattctattacttggcaaacaatatgcagttgagagaaatatagcctaagaccacgaaatggacctttacagtgtggaaagaaaactagatcatggagagaagaatcccataattttgcatgtcattttgttcaaatcaactgagaaacgggtactggtaaactaagttacctgtgaacaaaagaacttgttcaatggtatttgtttaaaagagaatataatcatgaccctcatagacatatgaaatgaccacatgacagagattttctttaactcaattaattagagatccagtaagatgctacaactagttcaaaggagaagtcaaagagcctcacaagtatatgaagtatataccacacatatctaagaaatgctgaaattgatttataagtagccgcaaaatcgacagggggaaataaattgtatttccacctaactgatttcatttcctgtatgttttcttccagtagtttcatagtttcaggtctcatgtgtaagtcttaaattcatttagtgttgatttttgtatatggtgagagatgagggtctaatttaattcttctgcatgtggatatcccactttcccagcaccatttattgaagagactatcctttccccaatgtgtttttggtgcctttgtcaaacattagttggctgcagaagcatgaatttatttctgggttctctattctgttccattggcctcattgtctgtgcttttaaaattcaaaatcattattcctaaataaacagtatttcttgaatgcttacaagtcattacagcttcaattttgcatctctgctgacttgaattctaaaatagctcatagtcagatctcctcttgagtgattttccataggaagaagaataggctgtgactatcaagcaatatggtggtttagatacacctgtaaatggaatagtcaattggaagtgacttaaggaacatttcaagtggccataagctctgtctttaaaaaaatacacatatacacatgtgtgtgtgtgtgtatgtgtatgtatccctgacacctcagtaggcagattctttctaactcttaatgtcttcattgtctttggtgaagggagaaggtctgagctaattttacttgtacaataagaaaaaacctaggatcagatcatagtaataatatgctctatccttgaataatttcacttctaaaggggaaaaaatattctatcacagaaactttattacagagactttaggtcttattgtcaatcttgatattttagtggtgatcaaaattagttaaaggaagtgactgttttcctgcaggaaacagcctggtaacactgttgtgccacctcttcaatacccatggactcattcaccatttcaagttagatatggtgaccttacaccgatttttaggtaagtcctttttttcacatttctagccccattctcttgaataatggcaatgcataatactctttaatataaagtggtaagatccataggatgatagatgcatacctccaattaatcttaaatggtctcatcttacttttaaaatatggcttgttcatcctaaatcatttaaaaattgtttacttgattacagttgatcccaaacaacttgggggttaggggtgctaaccccctgtgtagtcaaaaaatctgtgtatagcttttgactctcaaaaacctaactactaatagcttactactgttgactggaagccttaccaataataaacagttaattaacacatactttttatgttctttgtattatgtattgtattcttataataaagtaagatagagaaaagaaaatgttcttttaaaaattacagggaatcctagcactttgggaggcgggcgtatcacaaggtcaggagttcgagaccagcctggccagcacagtgaaaccctgtctctactaaaaatacaaaaaaaaaattagccaggcttgttggcaggtgcctgtaatcccagctacttgggaggctgaggcagggagaatcacttgaacccgggaggtggaggttgcagtgagccgagattgcgccactgcactccagcctgggcgacagtgcaagactctgtcttaaaaataaataaataaataaataaatgacagggaagagaaaatgtatttcctattcatcaagtggatgtggatcatcataaagctcttcatccttgtcatcttcacactgagtaggctgaggaagaagaggaagaggaggggttggtcttcctgtctcagggtggccaaggcagaaagaatctgagtacaagtggactcacgtggtttaaacccatgttctcaagggtcaagtgtagttatgtttataataaattatatataaagaaaaccatcaggaacataccgttttcaaagaagatactggtctgctgacatattaacaaacctccagcagcatgcgcctcaaataattttaatcaggacatgagttgttgaaaattttcaataggctttttaaaaaataataataactaccatttatgtagtgcccactatgagcagagtacttttggcaagttatttctaaccatttaaacaaatctgcaagtaggatattattatcaccatttgtcccatagtttaggagaggtacaaagaggtttcattacttgcccaaggccaacagctagtaagtggcagaatatgagcccaagcctagctctgtcgacttgggagtccaccatctttccactgaactccatcattactctgtatcaaaaggcagcctcagttcttatttaaatgtgtgcatattcttatttatctgccagtgaatttttcaggggacatttctaatcaccaaatgactttcctctgccatttacatgtttctggcttctttttgacttgccacatggctgtactttgattttggaggctgacttaatgccatcagaagaaaataacaggcgtgacaataataatgggagccacaaccaggtttctatggtgcttacatctgctggaagctcttccaaggacctgcatatattaataaacacatttaatccttactccactttgagctcagagctattgctatccccattttacagaggaggaaactgagggaacttgcagttaagtaacttgcccaatacagacattaaagtgatagagggtttaaatataattgtcaaatatacctgctgaataaaaagtatgtgcaacacaacagaaatatttgaaaccagccacaacatggctaatttccagaaatccaaataacctcaagctgattgtatttcaattgattgagcaaagaaatggccatgcatagggccaaataattttgatttgtctgaaaagggagatacagatatagatactttggacacgtgtatctacccagaaaatatataaagaatacaaagacttgacaacagaattaacactgtaatccagagccagattcatagcaatgggctgagagaatctggccacacttgcaaatcaggacagtctatacacactgaatatattgcatcctaagcatcgccttggttatgagctgaagcaggttagcgtcttccataaaaagcaaaccaaaatcgccttgcctgtgtctctacttggttccaagagtactctaagccttacattagactgcaggagcatgaaagatgatactctaacttgaataaggtagaaataaatccaagaagtccacagttggatcaaggcaataccctgaatctctgccctaagaggcccggatttgctttcattggtatttgttattcaagtgttaaaccagtctttggatatcagtattctgatgctacttgggctctttgaaggaaacctcatttgtggcatattatttataaacagcagaaactcaattaaactatagtgtgagataaagttgtgcttttcctacatatttatttttcctatgaatgacagcctttatgaatgtcagaaaggggggatttatgaaggaggtgagaaatcccaacgcttcacaaatccttttggcctttctcccctctgctgtccatctctgctctctgctaaaaacagcctagcagaactgccaagcttgcaaaccacgtttatttttaaagcatctctatgctgcacattttggaggcactgatatttttaagcaaaaagcacccacagtaagtctaagctagtataccactcctatttgggttttagttgattgagttatctgtttacctcccagtcatggttcaagaagattaccacagccaaaacccgtatcacaatgctgttcacgcagccgacgtcacccaggccatgcactgctacctgaaagagccaaaggtaagacaagacccagctgcctcctcagccacctggaaatgccaaggaaactacctgctaggcccaagttacccaacatatctgagtaactatgttatgtgtcattaacaatgtgaacacaaattattgatattaaggttccagtatcagctctgaaaatcttacaatgttcacgaaaaaggatgagactcatctgaggttttctttcatattttgtatatttttgaggctgtatttggacaaaaaaaaaaaaaaaaacttcctctctatggcaatctacatcttagataccttcaacagtccatagaactagctccgtgccttagatctttgccacaaacagcaccagcattgaactttgttgggaaaagtctcctactgcatgagttttgatcaacaaatggaatcaaagctcctcaagtctgatgttctatttcctactgaaccaactggatatcccgattcagggcccaagaaaacttgtgaatgtcaaagacctcttagcaagcatgttctgatgcaataaaccaacccaaagttaaaaattaaaaacattgtaataatgctcaatactcaacattcaggcagtccttagactgaaagtctgttggtacaaggtacaggatgagttttcttaaggtttctggaaaattatattctaagactgttgagttcaatctgtttttaacatccccctacatatgcggatgctttgacagcaacaactaaatattcagatgtcaaacaggcactctcagggcaaagctgggtgggtgcctcatccctgcaacatatcccaaggacattaatggctctgttttttaatttccaagtagtctaaacattgtactatgtcatacagttgtatttttaaagttagtattggattcccgtgtctctgcttattttcctagctaaccagaaaatcacagattctcatacattctcccactatttattacacattgaaaaaaatgcagatcttgcaagtcggcccacttctttcaaagtggcaaagatatattagacagttgaaatacacaaatgatttttaagtaggtccatcatgtgaccaacttttttcttcatttacacatttctctaggagcaaggctgatttcaggccctgtcttctacctatccacccaacagcactgttgccaaccagcaatgccatcacaacaacaaaacaaaacagagtggaataggaagaaggggataccagaataatctacacaatttgagtttacccaatattttccacacagtcctttcctttttgcctgtgatttcatgtgactatcacctcatttaatgcttcaaagggtaaaggtctggctgataggcttaaacaatgccatgatgattcattgtgtttgatttagccaaaatgattatgagcctatttgtgaaaatacaccaatcaatctcccaatttgtttttttaacagcttgccagcttcctcacgcctctggacatcatgcttggactgctggctgcagcagcacacgatgtggaccacccaggggtgaaccagccatttttgataaaaactaaccaccatcttgcaaacctatatcaggtaagggagcccaacctggagccagccacagtatggtcaatcgccttaggcccggtgctcaagcctgaatcttgcccatggagaaagccttgttttagggtcctagaagttcaaagacgaatgaaacacaatctctgccctcaaaaatttgttcaaactcagatgctcaaaatgagcaaaatccaagcaaacttaatcccagtttgaaagaggtttgaggaattagctcatgtcgatacaattgttttttaaaatctctaaagagtaaatacttgtgctgttctttgtatccaaagaccttactagaataaagtgagccgctgtttttcttttcccatcagtaaatttattctctaattctctggccttgtccctgtaaggaaagagaagagagaatgatccaagtgtgtgtgtgtgtgtgtgtgtgtgtgtgtgtgtgtgtgttttcagaaacagggtcttgctttctcacccaggctggagtgcaatagtgcaatcatagctcactgcagcctggaattcctgagctcaaacaatccctccacctcagcctccctagtagctcagactacaggcacgtgccgccacacctgactaattctgtttttcatagggacaaggtctcactatgttgcccaggctagtctcgaactcctggcctcaagtgatcatcccacctcagcctaccaaaacactaggattactggcatgagccacctgggactacaggcatgagctaccatgcccgaccgagaaggatctctttgattatgactagggagaaattggggtataggtctagggaccacattcaggatactacctatatcagtcacctgttcaactggtcttaggatctcttggaggctatagatccatgtcttttaagatttagggacaaagttgaaggcaaagcaatatcacatagtaccatacagatatcttcagtgtcctatagctggctagaaaaaaagctgaaacttttcttagccaaattggtgcttgtcaatactgaaaataaaaattgtttaaaaggacttgaaaataataggaaacttcaattttgtcaaaaaattgtgatccctttatttttggctatataccatcactattaactatactaaggaacatcaaaaagatgaaaaaaatttcttttaaaaagttcagttcaacaaactgtttaactaacctttattcaacacttactatgacccaaacactgtgccaaatgcctttgatgtagtatattattaatcttcacaatagcccagtgaggtgagtactattatcatacctattttccacagaaagaagaattgatacttgggaaatttaagtgtttttcctgaaaataaacagataattaatagaactggaattagaactcaactttttggtttccagagccaaagtgcctaagaactatgcatcctgcctctgaaattcatattgatcacctaccgtgtaccagaaactaacagctctcctacaatgctcctattgtagtaaggcagacaagagggttctagaaagtgatcgaggcctggtgcagtggttcacacctgtaatctcagcactttgggaggctgaggcaggcggatcacttgaggtcagtagttggacagcctggccaacacggtgaaaccccgtctctactaaaaatacaaaaattagctgggcatcgtggcacatgcttgtaatcccagctacttgggaggctgagacaggagaatcacttgaaccctggaggcagaggttgaagtgagccaagatggcgccactgcactccagcctgggcaacagagggagactccgtctcaaagaaaaagcaaaggaaagaaaagataagtgatctaaagtgtgagaggcttgatagatactttaaagtatttagctacaaacaaatgtgatgggaagatgggggaaggagaaactgattctgcagatagttgcagcgggaaaaaaaagaacatagaaaaagaatgctataaactgggccttaaagtgtgagtaacattaatagctgagatgaaaagagggcattagagtcaggatgagctgatgtacttttgggattaaattccacaactccagaataactgaaaatggaatgtccggtggcctttagctgagtatggtcctgccatctacagctccgtctctgatcagtgtgttgtgcatatcatgattcagtgcatacgctctcttttgtagtaacttcagattagttgtacaggacatgacctggatcaagaaatctttactctgcattaagttatagatgaggaactggcagaaatcttcaagttttcagtatcaaaggaaaaaatcacgttacataatatataagctgagcaaacccattaacgacacatggtatttaaaaatctttggaaatgtagccttttagcctctcaagggcccgtttgctgagacacaaatgggctttcagggagctatttgcaaattttcataggatgtttgcatgcacattttcctagggagagggtctataagttactcttatcaaattttaaaataagttgcagattctgaaaatgttaagaaccatggtaatgaatgaaaaaaatatatgtacatatacgcacaaaaattatgcatgcgcacatgcacatttggtcaacaagaataccgtagagaggatgtgccaggaattatgtggcttggggaacaccctgtgcgtgactttgccacaatccagacttactataaatgagataaaatggaagagggcttcctctccctccttctgttggctgtgctcttttagttctaataaataagaggatcattgcataacatccagcctgttattctaccctgagataaagagagagcagggcagctggagtgaaggccaggtcagagggctccctcccatggtctgttctctgggccggactcactcgctgaactgccaaccaagttcaatatgaaggcactgaaggcacttctacttggcacctctctcatcagactggaagcagtccaggtgtccagggtggactgggaggaaaaacagcatgtgagaaatagaaccaagaatttactttctgttccttcaccctccaaccccacacatacaaatttaatggtgggcttagcaactgtgcaaagtaagcattaagttacatacaacgttggtgattataaattgtaaaggaataactttcagttcaattttaaattcaactcctttcaatagagtccaacaacatggactctatcatttactcatgacacagcatccttaaaataatgactttaaaaaattgtcccataaacatttattacactctataatgtcttgcagaagtttataatcagctttcttagtcatttatcacaagcacttagaggggggtcagcattttgaaccacttgttattcttaatgagtctgaatcacaaacatgaagttgacccagccaggaggaatattccttccacgtggtcctatgaccccaccccgtcctcaaacaaacatctgcaaagactaacataagctcacaatttctacagtatgaaaggtgtttttggaaagtagtgctaaaattataaaaggagcctcaaatttgactttctgttccataaagtttctgccatccccaatctgaaccccagccttccctgcagacagcaattggcatccccgctcccttctctcagctatcttaggcagatgcagaacaaacaagagaaagacatcttcaaacaggcattaaacaaggcagtgctatcgtttcttcaagggccaaggtcttgtttagggctcaaggagcttctattccactgagacctcctaggctggggctctcatagtgttaccaaggagaccattggcttgttagggaagaactcagcagcctccattatctcctaaagtcttgcaccttgtttcatgagcaattaaaaatgaaaacacagacaatgttcctgttgtttttctttctgtatcctccggatttaaaatgttcaattaactctggttcctggtaccccagattcagtttatcatcatcatttgaagtattttaatcaaagaaagtgtccaacaaatagaggaaaaaaacagtttaaatctgccttgtatgatagcaactctgctctgccagattctgtttgccaaataccctcttgacttaatttgaaaacctgtgttggtggtgtattaaagaccaggtgtgctattagcaaacaaagggattgttttgtttttagggtgaaaaatacttgataattcaggcacaaagggaaacgaaggttttgccttagaagttggaagggttttgtttttttcaaattaaagttctaataggttttgttgtcacaaaggtagatgcttactccttcaactttaagatgaagattactcttaaaactgcaagtaggaagggtttgagccactagaacacattgtcatcaggataatgtgaaattactgaaccgatacttcttaaagatagacagacatagtacctgatgtggtattctagaaccggttagggtttcaaaggatattaaatggtatcctctcaccacatgtttagatctccatgaccatttctgatgcttttcttctttttctcagtctacctttggttgatacgagtcactgagcctctgtgaaagatgagtctgtaggagtagagctgctttttgctagggaggatacagcattcttatctctggcaagtcactaagaaaccccagtgtatgcaagcctgctcgccaccctttgcctctcccctaggttcagggcacaccagcatcatcctctcatccacctactctcagccttgcctggtttcagccctttttccactatgaagacagaaagagtttcctgaaactcaaatctgaccacatcgattcctgcttaaaaccctaccatgcctcaggattgagtccaaatgacttaacacaatttaccatccccgttctgatctgacccctgccagtccttccagcctcacttcccaccattcccctcccaggcttctatgcattgaggctgaacttccagtttcccaaacatatcactcaattctttatccattcagcagatacatacggagtgctgaatacatgctaggtgcaggagtatagaagatgaacaaaacaaataaaaaagtctgcttttttctaagggaaacagaaaataagtaaaatatgtcctctattagaaagtgataattcatagataaaaacaaaacaagataaagatataaagtatccctcttgcttacagatcttcacacccatgctcttccttctgcctatttgaataaaatgtagtattccatggtatattttactcaaatataatatacaatagagtatgttgtctgtactctctaattcctctcttacttgctcatccttttgatctaaatttggacatatttccctcctgaaagtcttctttttctctaaaaatccatcttacaagcccctcctatgagattttccagtactctcttacttcccttatcacagtatgtgtcactcgaatcgctattgcctgattagatgtccacttcccagacagatagtacatttttggtcacctaactcattcactgtgatatcctcaataccgagaacagttctgatgtccagggaatatttaatagcttctcctgcttattattgcagtcttactaagaatacacagagagtacaccatgcagaaggagtagcaatgattaaaaattcttggaatgatcttctcattgcatcttggaattgacaaatgcaagctgatacatgttatttcttgagtcctttacctaatcttggttgtctgcaaatgagtagtgggagggaacccattgcagtaataattttaaaatttctttggattttacctaagtctaaggatttcactacacaagatcctaaatctggcttctatcagatattgaccaaaaattcaaataggactctttttcttttaacagttcttttaacttttgtagctactgaactttggggtttggggtatcaattactcagtacccattcaacaaatatttacctatttaagtggcactgtgccccataccatggcacaaagatgaatacaatacgctccctgccctcaatagcagtcacgtagggccacagttttcacacagggtatgtgtgcccatggggatatgtgaagactttccaaggggtacacaggcataaatagtgttaacagaatccatttttaggtccttaaactgacttgcctggaatgtgcttgcggggcagtgaagccagttccacttttccacttaactttcacagtcaccctgtttccactttacaaaagacagacacatgtctgactcattctaagttatatttcatactgacctaggtataaaaatagcaagcaactatattagtccatactcaacgctgctataaggacacatctgagactgggtaatttaaaaaggagagaggtttaattgactcacagttctgcagggctggggaggcctcaggaagcttacaatcatagcagaaggggaagcaaacacgtccttcttcacatggtgacaggaaggagaagtgctgagcaaaagggaaaaaaaacccttataaaaccatcagatgtaatgagaactcatgcactatcatgagaacagcatgggggaccacccccatgattcagttacctcccatcaggcccctcccatcacatgtagggcttatgggaactacaattcaagttgagaattggataggaacacagccacatatcattctgcccccagcccctcccaaatctcatgtcctcacatttcaaaacacagtcatgcctttccaacattccccaaagttttaactcattccagcattaacccaaaagtccaagtccatagtctcatctgagataaagcaagtcccttttacctaggagcctgtaaaataaaagcaagttagttacttcctagatacaatggggtcacaggcattgggtaaatacacccattccaaatgggagaaattggccaaaacaaaagggttacaggccccatgcaagtccaaaatccaatagggcagtcattaaaccttcaagttccaaaatgatctcctttgactctgtgtctcacatctaggtcacacctgatgctgggctcccatgccttgggcagctccattcctgtggccttgcagggtacaacccccttcccagctgctttcatgggatggcattgagtgtctgtggcttttccaggtacacaggtgcaagctataggtggatctaccattctggggtctggaagacagtggccctcttctcacagctccactagacagtgtaccagtggggactctgtgtgggagctccaatcctacatttctcttctgcactgccctagcagaggttttccatgagggttctgcccctacagaaactcatgcctggacatacaggcatttctgtacatcctttgaaatctaggtggaggttctcaaacctcaattcttgacttctgtgcacccacaaactcaacaccatgtggaagtcactaaggcttggggttgcaccttctgaagcaatggcctgagctacactttggccccttttagccacggctggagctgaaacagctgggatgcagggcgccatgtcccaaggctgcacagagctgggggccctaggccctggcccaggaaaccatttttacctccctaggcctccaggcctgtgatggttcgggctgccatggaggtcttagacatgccttggagacatttaccccattgtcttggtgattaacatttggcttgttacttatgcaaatttctgcagctggcttgaatttctccccagaaaatgggtttttcttttctattacatcatcagcctacacattttccaaacttttttgctctgcttccctttgaatgctttgccatttaggaatttcttctatcagataccctaaatcatctctctcaagttcaaagttccactgatctctagaacaggggcaaaatgccaccagtctctttgctaaagcatagcaagagtcacttttattccagttcccaacaagttcttcatctccatatgagagcacctaagcctagactttattgtccatatcactatcagcattttgggcaaagccatacaacaagtctctaggaagttccaaactttcccacatttcctgtcttcttctgagccctccaaactgttctaacatctgcctgttccccagttccaaagtcacttccacattttcaggtatctgtatggcagcacccaaatctcagtactgtattagtccattctcatgttgctataaggacataccccagactgggtaatttataaaggaaagaggtttaattgactcacagttctacagtgctggggaggcctcaggaaacttaccatcatagcagaaggagaggcaaacacatccttcttcacatggtggcaggaaggagaagtgccaagccaaggggataaagccccttataaagccatcagatctcatgagaactcactcactatcatgagaacaggttgggggaccaccaccatgattcaattacctctcaccgggtccctcctgtcacatgtatggattataggaactacaattcaagatgagatttggatggggacacagccaaaccatatcaagagcaattaaaaatattaaaggaagtctcctgtaactgagatatgataactcccccatccatctcataaacagacacacggccaataaattattattcttgagcataattattctttccaaatttgcaataaacatgtgttttgaccaatgagtttctggtaaggattatactataaactcaagctggaaaagtatttagtacttagagcctgatgttaggaaatttttttaaaatcaaatttcaatttagactttcattgcagagaaatatgataggatgacaataaaagattttcacatataaaattatattacattaaaataaaaatctacagagaaatagaatgaaaatacaaactctagagggaaaagaatttaatatttctgacttaaataataagttaaattattcatgtggatttttttcaatgggtgctgaatgggcattaaatgccattgttattaggttcccttagacacatttaatacccagaagagtgatatagtaagtttatattaaactaccaacattcactaatacactggacattacatcttttgtaaccacttatatttatgatttttgaaagtttagatatcaactctgaaaagtgtgaggaaagtatagtttttcaaaattcactgaatgagcagaccactgacatgtgggagcaaggccagtgaacaaagttgttataaggtgttgtagacactaggatagaagtttcctgtgggtgtagaaggtctggaagaggaagctgtcagttctgttgagagaaccaagaaaggctttccaagcagatcaatgatttgtctcagaaataagtagataaggtcgtgtgtgtgtgtatgtgtgtttccaactttattaaggagattctcctcactcttttttggagttatgtaatcctttattatcatttcctatgcccaaaccaagccttattataaatcaagacattgaaaaggccctctctcattagctctttcaggatgacatgggagacaaattaactttaaatcaacttggtgtatttgtgatttaaacaagatagaagtttattcctaaccttcataaaagttgggcagttggaagtccaaggaaggcacaatagctccacaaaacattagagacccaggattcttttagttctacaatctgtcatctcttggtagggcacttgtcctcctcacccaaggtatctgctggaggtcaaaccattcctgctgcattccagtgagaagatagaatggggaaaagcaaaagaaacctctctcagatgactccacctttggtttaaacaaccttcctggaaatcccacgcaacacttctgctaacatttagtagatcagaacttcatcaaatgatcccacctagttataaaggaggctgagaaatgctgtctttcttctgaatagccataagcccatttaaaaactgaggttctgtgagtaaggaagaaaggaaatcagaaaaatgggatgaacaaacaggagtctctgtcatacgtgatgcttaatcttaaacctaaggccatcaaaatgatgacttggtgtgatccttccctttatgtaacattcttcctctaacccaccaattactacagcacttacatgaccattgtgttttccttttattgttgttactgcttaggttatttgatatccccactgtgctgccatgtgtctaatggcacctcaaactccacatgtcccacactgaactctacacctgctccactgcagctttcccgtcacgattaatgggcactccatccttctgtgctcataccagaaacaatggaatcatcctgcagacccagaaatcaaccacctctgatgctacctcccccatccacatctccatcacctcttacctggatgagtgctattgtcccaaacagccttccacttgtatattagttccttctcacattgctataaagaaatacctgcaactggataatttataaagaggtttaattggcttattgttccacaagatgtacaggaagcatgatgctggcatctgcttggcttctggggagaccttaggaaatttacagtcatggcagatggcaaagagagtaggcacctcacacggctagagcaggagcaagagagagagtgagggcaaggtgctacacacttttaaacaagcagatctcataagaactcactaccacaagaacagcatcaaggggatggtgccaaatcattcatgagaaaccacactcataatccaatcccctcccaccaggcctcacctccactattggggattacaattgaacatgagatttggctggggacacagatacaaaccatttcaacctgtttctccccttacccctaccaaagtctgttgtcaacatacaccaaaagtggccttatttcaatgtaagtcataattttactcctcccaaacccttgcagtggctccttatttctctcaaagtaaaaaccaaaatgtttgtaattgccagaaggctgtgcctggtctggtgtctcatgacctcactgacttcatgtcttcatacttcccctctctcgctgtgcattgacctcacagctgttagctcctcccttgaggcctttgctccagctgttctctttagaatgctcttccccaggcaggaatgactaactccctcctgccttcaagcttttgctcaaatctcacatttccccatgactaccttaccagccctgactatatctgaaagtggggactctcagatgcccactattctgctcttctctccatgcatttactatcttctaacatgctatccaactctttccagcatgaaagtatttattatgtttattgtttattgcctgtctctccccatctgatatggtttggctgtgtccccacccaaatctcatcttaaattctgtgtcatgggggggaacagtgggaggtaactgaatcatgggggcaggtctttcccatgcccttcttgtgataataagtctcacaagatctgatggtttcataaaggggaggtttcctgcacaagctctctctcttcacctgctaccatccatgtaagatgtgacttgctcctccttgccttccaccatgattgtaaggcttccccagccatgtggaactgtaagtccattgaacctctttctttggtaaattgcccagtcttgggtatgtctttatcagtagcatgaaaacggactaatataccatctctaccaccactagtttcttgtctgttttgttcactgatgtattccaagcacatatcacagtgcctagaacatagtaagtgctcaatatatttgttgaatgaaatcaagtaatttgttctcttacttagcaaatttatagaaactctgtgtgaggcatagatttgagtggatacaaaaggaacaaggtcggctgcctactcatacctagcttataatgtagtaaaagataaagaactctaatagacatcaatgggactgagtttaataggacacaggacttccggaatgccagagaaaaattcaaaatgagtataagactcagaagaaagcacatttgcctttgcctggaatgattgcagatggccttgtggagtatttgaagtgaactttgaaagacaggggctggtttgataagtgaacatagagaaagaggtgtttgcagataataaaccaccttggaaggtattagggttagcaaaaggaaaggacaccatcatatattaataatttaatatttatgtaagttatagtcttgctaacatgatatttatttggactataagagctttgttggaaaggagaggtaaaggtattgagttatctcaaacatttaggaacaaagtgatatttgggacaatttcataaagcattgaacgtcaagctaaggaatttgacttaatttgtcttacagggatccgttgtggggtttggaacagggaactggggcaggtggatagcatgatcataccagaggccagcaagctccttgagagcagagattttgtcttatttatccttggatccccagtgcacaccacagaacctggcatattagtgggtgattgataaatatttttgtttcaaccagtgattagggagaatgtaaaaaattttgtcaaataaacaggtcacattctggcagctgtaaggaggatgacttgaagaaaaacaatgaaaaaggatggtaaaactctgaaatagggtggcttctatgaaaggaatgattgggcacaagtgacactatgtaggaaaaaccaaaaggattcagacactgattgcagatgagggttgagagtgaacaatgagttctcccccaagacgacctaaatctactcaatcattattcaaaccacaagatttttagcaatagaaccagattcagaggtaaatgcaagaattccaatgtgggtttagaaactaacatctaattagaacaatcaaccttagttttttttgagcaacaactataggtaattttggcaaattcagtataattccaggtatttatcagcttgtaaatttcaggcttctgatgcttggatgtggtagcacagagaaaattcttgggaggcagcaagggctgtatgcagagcttaggtttgagtctgcaggcataagtgaggccttcctcagctactcactagctctgtggcctccctaagaaacctgagttttttatgacctatgaattcatgatcaaaatagtggaggggtatgtgagatttagatgagggcatggaaagtgcctggcacagagttggtgtttgataaatgttagtctctcctctctatgctgttcttcttttcttagtctctggaatccaccatggtgcccctatttccaccgcggttctggccaaaacatgctttcatgcataatgactcttccacaaaggctgtgtttgcaatcatctactctattgtcttttaatctgtaccagcttccaagctaacccaattttctagcatttccctggtgctcatctccaaatacagtttcaccagcaaatttcctaagtatccttttattctgtcttcaggaagattattaatgaagatgttaagtcaggctggcatacatcaccatgcttaaggccatcttccagacatttttgttccactacatggggatatggtgtcatttatcattagatcttgttacagctttctggcccttgaaaaactcatgggagggcactcatgtccacatctacttgaattagtcttgcaagtgaacacgtgagcgactgaattaaatgtcatcacaggattgaacatctgttacatcacactaatctatcactcttctctcctaaatcttttcaatcaaaacaaattagtctagcatgtgattttcaatcagccttctcttttgttgtgtgtagctcatgcccaaaaggaaataatagaccagttgataaaagtaacaaaatttcattactgcttcaaacatggtcaagtggtaaataaagaataatgactccttggcaattagtgaaatgaatagcaataggacagactctacagaagatggatatgagactcagtcagcctcatgaaacttacctcataacaaagccttggagataaatgagtgtgtggttttagaatcaagaatagttttagaatcaagaatagttgcagctttcctgacttgtgttttcctaatggagcattgattgtgtcactaacaagagattctccttcctcatttgctgaaaaagttgaacatcgtatgggtggctcagatacagtaggggcataatataatgggatggtttttagccgcacttctgactccatttcgtcaccaaattattttccttgcttcttttcccttactttttgtttaattgtggtaaaatacatgtaatataaaatttaccatcctaaccattttgaagtgtacaattcagtggtattaagcacattcataatgtgcaatcatcaccactacccaactctagaactcttttcatcttgtaaaactaaaccctgtgcccattaaacaataattccctgttcctccctccccttagtccctggcaaccacccattctactttctgtctctaagactgtggctactctaggtacctcatacacatgaaattatacagtgtctctcactttttattgaatgttattgtcttagtccattttctgttgcttataacagaatacctgaaactgagtaatttacaaggaagcaaaatttatttcttacagttatggaagctatgaaagtcaagatagagggggctgtaccttggtgagagtcttcttactagcggaaactctgtacggagtcctgaggcatctcatggcatcagagagggggctgagcatgcacaagtgttagctcttctctcttcctctcttataaagctaccagtttatcttccatgataacccattaatccattaatccattaatagattactccacaatccaatcacctcttaaaggccccacctctcaatactgtcacattgtggattaagtttcaacgtgtgttttggaggggacattcaaaccatagcaactatccttttatatgttttgtaagattataactactcttgaaaccaaatggagactgaataaacaaaatattgcctgaggtcaagaggagttctattctgtatctatgaagtcaatggtacagacataatgtttcctaattagaacaaaacacaattgagtataagaaatattcatcatttaaatggttaattgttcagataaaaagcatattcaaaataacaggtcaagggagagattgaatataacacaggttccctcaaggacaggaatgttaagataattgagcaaggaagcaattgtagattccaactcacagatttaatcagctaaatgccaaggtgctggtcacaaagattaccggcagagctgcctgcaaggtaatggttctcaaaccttagtgtacatatgaatttattaccacaagcctatcaaatcagaaccataatgactgcgactcaggagtctgaatgtgtcaccagctaccctggtggtttgggcttaggaggttcttatcagcgttgagaaatgatggtcagtgcagtagattagaccagagattgtgaggcttgcctccattcagtttgctagtataatcttggattatgttatgactatagtgacatggtatccattactacctatttcactgcttcactttttttttattattattatactttaagttttagggtacatgtgcacaatgtgcaggttagttacatatgtatacatgtgccatgctggtgtgctgcacccattaactcgtcacttagcattaggtatatctcctaaagctatccctcccccctcccccgaccccacaacaggccctggtgtgtgatgttccccttcctgtgtccatgtgttctcattgttcaattcccacctatgagtgagaatatgcagtgtttggttttttgttcttgcgatagtttactgagaatgatgatttccaatttcacccatgtccctacaaaggacatgaactcatcattttttatggctgcatagtattccatggtgtatatgtgccacattttcttaatccagtctatcattgttggacatttgggttggttccaagtctttgctattgtgaatagtgctgctataaacatacgtgtgcatgtgtctttatagcagcatgatttgtagtcctttgggtacatacccagtaatgggatggctgtgtcaaatggtatttctagttctagatccttgaggaatcgccacactgacttccacaagggttgaactagtttacagtcccaccaacagtgtaaaagtgttcctatttctccacaccctctccagcacctgttgtttcctgactttttaatgattgccattctaactggtgtgagatggtatctcactgtggttttgatttgcatttctctgatggccagtgatggtgagcatttattcatgtgttttttggctgcataaatgtcttcctttgagacatgtctgttcatgtccttcgcccactttttaatggggttatttttttcttgtaaatttgtttgagttcattgtagattctggatattagccctttgtcagatgagtaggttttgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggaaaaatcacaagcattcttatacaccaataacagacaaacagagagccaaatcttgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaaactaccaatgactttcttcacagaattggaaaaaactactttaaagttcatatcgaaccaaaaagagcccgcattgccaagtcaatcctaagccaaaagaacaaagctggaggcatcatgctacctgacttcaaaatatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccgtatgtagaaagctgtcactgcttcactttctttcttacatttagcgtggcctgactgagctattggaagaggggcagaggcaggagtgaatgatgctggaaatagatcctcattcaaccctgcagcagagggtgagccgcaggccctgctgttctcccatcatcatcacagccttgagactagacctcatggttgttttatcttttgggtttttttttcctggtctgcctctgggtcatcaagtacaaactggagggaaaatgctagcgtccgtggagctgtgttcagcatgaaagatcagtatctggcttccctctcatttataactcttattttctttctttctagaatatgtctgtgctggagaatcatcactggcgatctacaattggcatgcttcgagaatcaaggcttcttgctcatttgccaaaggaaatgacgtaagtgctgccgagatgaaacatactgatgtgcatgcagtaaagataagccactttctctagggcaggcttgggaccttttgcgtgaatggcagagagccccccggctgtacttcctgcctgcactgagctgtctatcagaggagatttggtgtcagttacagcaacccagaaaccaaaatctctctgtgtgctttgaaagggccttgcagagtcaatgacctacagtcaggaaaagggataataaacagctctcagttttcacacgcttcagtatcagtgctcgactttgccaaattcccgacctttagtttagcaaaattgtccttccatgtagctccaaatagtaaatatttatcaagaaggaacccaggcattctaaagctagagttcaaaaaagtatattttgtaattgctagtctcagcaaaaatagaagtcagaaattcttttctaaaatgtcttttgctaagtaattgaaatggccctagcatttttttcaccaattaatttaccttacgtctcttgcactttaaacagaaggggagacactcattttctggttcactatttgatagccatggtatgtaggctgagtcccactaaatctgaggccattgtttcattttcctggtggccccaagttagctgctaatactgtcttccaaggccaccattaattctgatctgtttaatgaacacgtgcagaacccaagaaacctaggtgaaaagagtacatagattgctgtacccttcttcaagacaagcacataacttgaggtcaaggaccaagtgctgtctcccaactgaacaagcagtatactctgggttgtggattgattcctggccctctgatttgatctcatgctgtttcctagcacccagaggaatgtgaaatttgcaggaggaatttcagttctgataaatttttactccctggaactaaataaaaccagttctcgtgcatggaataaaaacttatgcctcttactagaataataaattgcaaagattgaaagaattaaatgcaaaaagaactaaaaactagagcaaaagatcaagtgagaagaagaaaagaggaggtaaggagagagacaaggaagaaagaaggagaaggaaaggaagaatagtgaggacaggaaagaagaaaatgcaagggaaatgggaaaggactctggggtgaccagacttctcctggtcagtacctgcattcatcctgtttgttactcaatatttctttcctaaaatattcatttcacatctatggattccaatgaaaaatatatttttatgtgtctttgtggaacacagtgttataaattgtttttgccagaagaataattgttatacaataatatatgtgaaaactttattacaaaagccattatcataatcattattattccttctatcacaggtaaatgctttaatgtcatttttctgattttaaaagtagggcaggttaattgtagaaagtaaggaaaattcaggaaagtgttagtttgaactatgtgaagttgctctttttaagggccaaaaacaggagacttttagcactttcatatgtttcagcttgatatgaaagagaaaactgaaactgctagtaatcctgccatccaggtatagttcatgttaacctggctagtttattttcttttagtcttttttcaatacaaacttattttaacaaaatatgattatatttggggaacttattttacagtttacgtcctgaaattttttatttacaataaagacttttttccaaatcattaaacctgttaaattaaaatgattttgtcagccgtatggcattattgtataccactactgcctttcatttggaattcaaatggtttccaatatcccaaactttgatactctgttttctcaggaagtatttgtagataaaaattattggtcagaaaggtctgaacttttaagtttcttgtatattatccagttgttcttctaaaaggctgtatctacctgtattccaactgatggattgtaagaaaatgtaccaatgtaccatcaccaaaattgagtttatttttatctttttaaaatatttgcaaatttgacatatatgtatgtatatacacaaatatatatgtaaagtggttttcattaaattagtatgcatcctttacttacaaccaagattgaaatttttcgtatatttgctgatcattgctatttctttagagaacacatttttatatttggtctcttcctattttcctatcagtgttattcatttgttagaactctttgtatattaactacagtaaccatttgttatatgtggtaaatattacttgaagtttttagtttgccttttgattcatgaaacatttcacctaattaaaataattttattttccaattataaattcagtaagtattcatatcttcaaagaattcatataattttgagaagtataaataaaatatcaaccataatcccattatagatcttttcagtttattttctgtgaccatagagatcatgctttacatgctttgcattttgtttgtagcattaaaaagatgacatttttcaatgtcaattactatagctgtacattgtacttcataattgcacaatatgaatgtaccatggtttatttaactaatctcataaatttttgtgatttttttcccccacggaatgcttcattattgtaaataacaatagaatacgcatccttgtaacatatctttactaattatatctttactaacatgttaatgttaatttgtagatggactgttggtcagattatttatgttcatcaaatgctttttccactaattcctaaattaccctccagaaacattgtactaatttatactccctaacaaagaatgaggggaaccatttttctcgtactattgatagcattgggtattacaatctttcaataattcagcaaattacttagcagttacttttaatcctcaccaataaaaatgggagaaataatatcacattgtggttttaatttgctttctgctatactaagaatatttaatatcactttattttttgagatattttgtatttctcttgtgaattttctgttttatataattttttatgttcagaactggattaaagatgtagtatggcttaaaaacaaaaatgtttgtggtgaaactataaagcttttagaatatgatgtagggaaattttcatcagagttgggaaaagtttcttaaagaggaaaaaaaaaactagccataaataaaaagatttatagattaagctacattaaaaattaagacttcctggtggcactgtggttcatgcctgtaatcctagcactttgggaggtggagatgggaggatcacttgaggccaggagttcgagaccagcctggtcaacatagtgaaacccccatctctatttataaatttaaaaataaaattaaaatgataaaaattgagacttcatcaatagacatcataaagacagctaaaagacaaaccacagacacaatatttgcaacacgtagctgacaaaggaccagtatttaaaatatgcaaagaacctcagaaacaataagaaaaagacaacttaatagagtagacaaaaactagagtagaaacttcacaaaagaagtacaaatggccaataaagacatgaaaatatgtctagcctcattagtaaacaaaattcatattaaaactacagtgagttgcatgacatgcccatcaaactagcaaaaaatgtaaagggtaagaatgtagaacaatgagaatctcatctgctactgctgggagcaaaaatttataccatcattttgaaaataattggcattatctagtaaattgaagataaacataccctgtcatccaattattgcattcccaaatatagaccccagggagacttctgcacatgcgtaactagaggtatataagaatatttactgtggcttttttcatagtagccaaacactagaaaaaactcaagtgaccatgaaaagtagaatggataatggaatggatttcattatcaatggaattttatacagtggcatacactgtaacaaaaaaggatcaactatagcctacacatcatgaaggaatttcaaaaacataatgtttagctaaagaagtcagtcactgatacataccatataacttaaagttcaaaagcagttaaaattaagttgcgtggtttatagatgcactcacaggtggtaaaatcataagtaacaagaaaattgttaaaacaaagagcaagaaagtggttacttccaggcttgaaaggaaaggggatgtgatgagacaggcaacatgacctctggggtactggcaggcagtgttcttgacctgagtggtggttacaaggtgttcattttctatttattcattaaattatgtatgtattccctatgcattctacttaaatatatttcatttttaaaggtaaattttacaaatatttatggattgttcctttattactttttatatgtgagggaaagctccaacttgctttacctttctaagatatcccattttctctataccatttgttgactaatatatctcttgcccactggtttgtaacagtgccttaattagtttttgtgtttgaagttccagaatctcttcctggcctatgtattgtgttccgttgatggatctttccatcccatggtaccctttactattattgtcttcatttttattactattgttatgcccttttctctctccgtgcacatcttcatgtttgaactctaaaaacacaccgccaatctcatgattctacaagtcttttgtgtcctccctaaaacatgcatttctatttggctttcagattttttcacccatagaaatgtctacactaccacaactttgtttttcaaggtttcaatcactttatacagttcttggcatgcttcctgtccaaggacgcaactggtgggtgggagacttgctctcaggcagtgaaggactggcacattgtgtaataaacagaatcaaaggcagaaattagattacaagccacctgatgatgataaaatcaatcaccctcatcaaagggatttgctttgtgtgtgtttttctctttcattcttgtggatgcagacaggatattgaacagcagctgggctccttgatcttggcaacagacatcaacaggcagaatgaatttttgaccagattgaaagctcacctccacaataaagacttaagactggaggatgcacaggacaggcactttatgcttcaggtaaacgaaacaataaaagccattctttttgctgagtgaaaacactcagctgggctgggtgtggtggctcacatctgtagtcccagctacttgggaggctgaggcatggggatcacttgagtccatgagttcaaggctacagtgagctatgattgcaccactgcactccagcctgggtgacagagtgagatcctgtctctaaaaaaacacaaaacaacaacaacaaaaatccactcagggccatgatcaataattttagcacatttgagaaggagttatctccgatggtatgagttagagcagtgacctattttagtaaaggctttgaaatgcatgaaagttataagtggttcccaactaagcaaaatctgggttttaggtcaacaagttgataaagctcatttttcttgttcagtaactgatttatcacagagtaatcccgctggatgcagtaaaggtctaccgcatttggtggcttggtataaaatcagctactgcaatacccacacattttaaaagactgtttctgaaacacaaaagcatattatattaactatagtacatacaaaaattggaaaacaagtgacctccctttaccttaaacctatttaacctgctttatttccttttactacctaaacttctattttcatctgagtcttaaacatttttatctggtcttatttttaggcagcaaaaaataaaattgaactgaattgaattacattggatcaagtccattcctttctgttttactccacggcaagaagccatttgtgacatgacaaattacatcagggcagagtggatgtcacaaataaaaatgtgacctggtatccaaaccagaaccttctttcttgatcttccattttctcttgtcttccttcttttcttttggtgcaaaaaaacatagtgaatggacctagactcatctagatagatgagatggagctacacctggagattgaatggtgcagtcttttttgttccaggctttcatgctaccctttgtagctgtccaaagtgctccatctttgccaggaaataccctactcccagcagtagaactatgactccttccttatttctttccaaactaggcttctagtccctgaatgccacaaggatcaaccaggtgtctgatttgagtgactaaagccaagttgtgaatagctgaaagatttggccttgaacacttgcatttcgaaagaaagccttgctaactcaaatgcattccttaaggcagaggctggaggaggcttctctgacacttacctctacttcaacatgtactggtacccccactaaccaggaaataaatataaacaactaaatttgcaagttgatatgatccaagggtcttccagaccccaacattgctatctgttctgtgatgccaaggaattgggtcaaaccaatggacactgctggtctcttggtagcaggtggtggttaaaagagaatctgcttctctgggaattcaaggtaaccctcatagggtcatcattactgacaaaaagctggcatctcagatccagaccagtgtgaggcaagtcaagaaggccctaatttagctgtgcaaacaaagcattcctgggtttgatacgacttcattccctgactggcagtctgagcttacacatgcagacataaatgccaacacacataatttaagtgatgtatggggtttgtcagtgtggctactgtgagagtgaggtccagatgacctcacttgagcctggccagggaccatgcaacctccctgcatgcaggaggtggagctacagaaggagccaggccatggctttccttggcctgcccacccaagtctcttccagcaagctccatgtccttggactgtggctcttctctcctcactgctataaagccagcattctcaatgcaggctttgtatcatggtgaataagtgcagtttcctgaagaggcatgtcagggaggtactctgtaaatatgggcctggtactgtgagcagactgaacagcttgatagcctctttggcttggggtgcttttgcaactgaaagaacatcctctcacaatttctccccgccctgtcatttctcagatcgccttgaagtgtgctgacatttgcaatccttgtagaatctgggagatgagcaagcagtggagtgaaagggtctgtgaagaattctacaggcaaggttagtagtgatccaacagctgagatttcattgccctgtcttcttttaggcatttatcctaataaaacaggaaatggctgatctatcatgacatttgttctctcatcaactcttgttatcctaacctttctcttttactctcttggaactcatccaaccctttttcggaaaaagttaaaaataaataacattgacgtattgacttactacagaaacaggtagtaatgaggcaaaataaaaatgagcaaaagtgggacattgattataaatggctctcctctgtggatataagaatgtgtgggatagtttgattttgactttgaccttcattttaatgagctgagtgcagcctaaaggctaaatgtcatttgaggtcaatgttttccactctgacagaaggacttagactccttttgtattccttctccttgctttcttaaaaaaaaaaaaataatgaaattggacacagctgaccaaaaagtgagttcttcctttcaaatatagtttcaacagtgaggtagaaggattttgctgtgaaaagacaaatggccctgaattagggtataatttttaaaagattaacctcattcagaaataaagcaatgaattagcaagcaggatcttgatgttgggtggggtatcaacctttaaatacagccttgtttcttcaggctgggtttcaatgtgcaggatgtttgttcaggcatcaacagtgccctcatgctagtgacagaatcaggtttgagaggctgagaacaaataaagcttgaagtgtcccacataccagctctgtggggaggtcaaatagcaacagtgagccttttggagaaggcaccattgaaagatgtgtcaatgacatcgtgatggccccaaagacagaagaattgattgagctcatgtggggccagaagtctctactcactgtatctttctctcagaataaaagtgctcatgtaactcctacaattctgtatataatttcacttgaattgagtaaaagtggttagaaatcaaaatctcagctctagttgcccctaaataaaatctccaaggaaggtaagacaaaaggaaacatgatgaaattggagctagggggctttaaattagatataatcaatattttctttactgtttgatatgttgaatattgaaatagcatagtgagagaggggctaagatctctgtccttgcaaatcaaacaatgaaacagaggaaagagtctactctagcccacttggttttgactcaatcatgcccagcatgattaaagtacacaagtcagcatcgactgcagtgtaaaccttttattttctcatcttgcaccttatttggattctgagcaccttggggcaggaccatgtcacttatgtagatagtaaggcccatagtgccagtaaatcaaagttgtcaactaagtacagtaaatggtatcaaccaagaaatgtaacctataagatctcttttcttgggcctggtgcagtggctcatgcctgtaatcccagcactttgggaggcttaggcaggtggatcacctgaggtcaggaacttgaaaccagcctggccaaatggtgaaactcagtctctaatcaaaatacaaaaatcagccgggcgtggcggcacaacctgtagtcccagctactcgggaggctgaagcaaaagaattgcttgaacccaggaggcggaggttgcagtgagccaagatggtgccactacactccagcctgggcaacagagcaagactccgtctccaaaaaaaaaaaaaaaaaaacccttttctcaaaactgcttattgtcctagtaatatatgcatgcattataagatggaaaaacctagaacatttgtaacactgatctctaaaggcaggcttccatgtaccttcctctggcatgtttcctggcagaggaagaatagaaagtatatctagtcctttttatttaatagccttatggtctagtagaaattctgcttgttttaagagaagattataggctgggcatggtggctcacgcctgtaatcccaagactttgggaggccaaggcgggcggatcatgaggtcaggagatagagatcatcccggctaacacggtgaaaccccgtctctactaaaaatacaaaaaaaaattagccgggcatggtggcgggcacctgtagtcccagttacttgggaggctgaggcaggagaatggcatgaacccgggaggcagagcttgcagtgagccaaggtcacgccactgcactccagcctgggtgacagagcgagactctgtctcaaaaaaaaaaaaaaaaagaaaaagaaaaaaaaaagagtagattccctggtcatccaaactgcctgtcctccctactgaattattatttttttaattctataaggatgacttgtgtcattttgatttatctttcagtttaagatttggactcatctcagctcattccagcctgctcctggcaggcaggcttccacagactactaactgtcctggacaaagtacctttaatgtgattcatgatgttaagcaaaggaaaacccttaaaatcaaggttgaggacacagggggaaaggaaaacaagaacccatgaattagaaaaactgtttcattctcagaacagagattaggactccaaataccatatatctccctcctctccccgaaaaaaccttaaaaaattagactttgtcctcttgtaactacagattgatatcatctcaacctagtttcctagaacattttattgaacatctgcttccagccttgtctaatcctcaacaaaactgattatcctatgtgcaaagccccattggagatattatgaagaatgcaaagaactacaggtagtctatgctttgtactctcaaagtactaattagtatagtttccagaggaaagaaactatgcaaatttcccctttatattctctacattggttagcaaagtgtctgaaacataaacgtgttgaataagtgaatgaataaatgatctaattggaaaacctctaatgatagtggtcacaggagaagatccagtaccttgaaaggtagaatctgagctcagttttgagtgatgtgcattgttctatactttccaatatggtaacaagacacatgtgactggttaaatttaaattaaaagttaataaataaaaaatagagttcctcagtcttgatcatatttcaaggggctgccacagtgggcaacgtagagaacatctccatcattgcagcaaatcccattagagagcgctggtctagatagaatggaatggaaaccactgaggccgggatgcaccctgccttgtagaccagctcagtctcatagaagataagaacgagaggattgtggaggcccctgggcaccaggctacagtagagaacatgacaatgggagttatctcagaaagtgcatttagggcaatatatacagttgaagtggaagaagaattggaggaagaaaactagctaagaagcaacaactaagaataaattatcaacacaccagaccaggttaaagcagagtgaaagggggcaaaaaaagttcttctaagagggagaaacaggatgtgaaacaagatttaagaggaagaaacaagcagggacccttgcagggtccccagccaggctcagatgagatggagggtgaagggaagggagaagtcaaagacaactcctccaaagtgtcacacttgactgaaaaatcactattaacagaattacggaggtgaggagtgaaactggctgtaggagagtttgtcttaatattatatggtgttctggcctgccctcagaaggctatgatcatctggagttgaagagttagggtggccagactgccctgaaccactcaggttaagcccgaatgatttcctcacttcagccttgaggattaccaggcacaagagaccccaggaggcagactacagtcttaaaatgacagaactgcagcctctgtagggcttcagctcaatggttaagtgcagacactttgaagccaaacttcctatgctggaatccaggctccccactttactagtggtgtgacctactagcaacatactgggtcagcatttaaccctccctgtgtctcagtttcttcatctgtaaaatggggattataataaggttgttatttggattaaattaattaacatatgcctgggaggagggctcacacctgtaatcccaatgctttgggaggctgaagcaggaggattgcttgaagccaggagtttgagaccagcctaggcaacgtagagatcctatctctatttaaaaaaaaaatgaacaaaacaatattagccaagagtggtggtacatgcctgtagtcccagctactcaggaggctgaagcaggaggatcccttgagctcaagcgttcaagggtgcagtgagctatgatgacaccactgcactctagcctgggtgacagagtaagagcctgcctcttacaaaaaacaatgacaattttttattaacatatgtaaaatgcttagaacgtgcctggcacacggtagtcactatataaatgttgtgtttttatctcttctactttagcagagtagattcataactgaaccttccactcattaaccagattgttttttccaacacaaaaattactcaatttgttatgctcaggaaggactgatgaagtatttcaataaagttttgtacaatacatttctcctttgatcttctattaggttggtgcaaatgtaattgtgggttttgccacggaaagtaagggcaaaaaaaacacaattacatttgcaccagcctgatagctgaccaaggcattaaaaaaaaacattttgagctgggtgcagaggctcacacctgcaatcccaacagtttggaagatggaggcaggaggatagcttgagctcagaagattaagactagtctggacaacatagcgagacctcatctctactaaaaataaaaatttaaaaatatacattagccgggcatggtggtgcatgcctgtagtccaagctacttgggaggctaaagcagaagggttgtttgagcctaggagtttgaggctgcagtgagccaagatcatgccactgcactcaagcctgggtgacagaatgagactctgtctcaaaaagaaaaaaagaaataccattctgacctttatactttttttcaccttcagttgcattaggtaaaattctaaggaatcagaatgggagattctgattaattttgtggttacagagtgaggtgctactcagatgagatctttctagtccttctacctcatttcctacctacttactgttcctggttgtcctcaggtgaaacaagactagggtcaggcagcgtgaaagtagaggagggagaaggaaggacaaaacctgttttcttaacctgtcacttaaagccataacttttatttcatgtgaggaaatttctcatttgttttcttgtttttgtaggtcttgttcaaaagtttattctagtcccagagcacacctactagcaataagccattatgaacggtcattggcactgtggtattttaaatttttacggaaactactgaagtaaggcagagcaagtcggtgctgaagggtccctaagggataacaagtcaggaaacagtaattcccagaataacttcttccgacgaggtcattaaaattattaatactcattttataagttctagattaccaatgtgtttttttctttctttctttcttcttaggtgaacttgaacagaaatttgaactggaaatcagtcctctttgtaatcaacagaaagattccatccctagtatacaaattggtgagttgaattcagtgttaattccaaataaatacctttggcacatctcacaaaagtgacaaagaaaagatctaaacacagctttcaaaagatcagcactggaggtttaatcaacatccttttgaatggctgagtccaaattaatactttaatcatgactaatctactagctaattatctattgagaacttatgaaacctaggatcgaagctttgttataggcccttaactaacttgtattattttaatttggtagtttagaatagaatcaaaaccaaaaagagtagaagaaaagtaacaggaatcaactattcatactctctgcagggcttgaaggtgggaatcagcagaatctgcctttaggacccttccaatctgggtcgctacccctcatccctaatgctcgctcccaagaacccaatctctaggcctagagcttgtgagccatgctatcccgccgcatcctgggattcccagtttcactagtccttccttcaaaacttattttcaggttattctcctaaaaccacactctctttcaagtgtcactggtgggaaactgttgaagtatgatgccaatgcatccaaaataattattgctttatctaattaagttatgcattagaccaagaagcaaatcaaactgtggaaattttaggcactttagcggaggaaatatttttgcttcggtaagactttctatcacaccttaagacactccatcacgtccacccacctttaaagcaagtctttcttttccttgcagttcccttccattgaatccgaactcagaactttaactcttttccttataaactctgaccctgacatgtaccagttcatgttttatacctgttcctatagacttcagacagctgaacgcattcacagtgctacagacctttgcaaggctcaaagtttaatgctttgacattggtagggaagggggtatctgaaaacataagctgaaaattaagaaaaccagggtaagttagaattacataatatcactgaaggtcaaatctaatccaccgtcccacagtggagtcataaaatcatcctcaggaaataaggacaaaataaatctagctataaagatttcaatggaatatacaactattaaaataggtatgttcgattattgagcatttttttttttcaaattgtccttaatattgttatgtagttttcacaatcaaaccaattcctccaccccaaagctgggagctggggatggtggcatagaaaaaatacaacccagaaaagataatacagagttgctgggtggcttgcaagggaatatcagcaacagaaatgcagcctcagcctcctgggaggcaattctctcctatcaattgccttagccatggaggttctgcagacgtgattcaaaattagatgctaaccaaagtcctaatcctgaggctccctgtgttaagctccagctggaaagaaatttaccaggcaactgtcaatgacattttgaaccccccaaacaaaaggactcacgtggttcagcacacaacctggatttgtgagacagacctgatttcagagattctgtcctgttgttgtcatgagaacacacttattttgtcagatcatatgtcctgattttcagctcaggaaaatgtggttaccatagatacctcttttaaaaaggggctgggggttgagtgaatagggaaatcctatggatgctacaccagcacaccaataataaagagaaagggaaggtgattataaaacaatccttagtacatagatctttctctgcctttgctccacatctgccagctcgtagaggttgagggttgggaagtggggtggcagggacagatcaggctaagccagaaaaatccaaagagataaatggaacttggtggatgctacaggctctagcccccaagacaacaatttttccagtgggtcttcagtaatgcagctatttcctctgtccttattcctctctgactgaaatgttcccctgtttttcctgcctcaatccaaaatgagaattttctgagatctactctcaggcttagatctgatttttctttttaagtaatttatatctacccaagtggaactagggcttaatatctcctccccaactccacgcttccctctctctaccaaattctacattttaaaaggaagatattagccaggcggggtgactcatgcctataatcccagcactttgggaggttgaggcgggcaaatcccttgaggccaggaattcaagaccagcctggacaacaaggcaaaaccccatctccacaaaaaatacaaaaaaataaaattagctgggtgtggtggcatgtgcctgtagtcccagctactcagaaggctgaggcaggaggatcacctgagcccaaggggtcaaggctgcagtgagccatgatcatgctactgcactccagcctgggcgacagggtgagaccccatctgttaaaaaattaattaattaaaacaaaaaaaggtattaaatcaaatgaagctctaattggtgaaatctatagaaggctaaagagaaagaggttttccttcaatccttgtctactctgaggctaccattcctccctactcccccttcctccccgcaaccccccgtcaccccaccatccctccaggaggacaacagcccagcaatgtcagctcatcccttgagaaaagggaggttggcagaacacactgatggaacaggtttccaaatctgataatgtggaagccttccttaatttgaaaaactgcctcttggtgtctattcagactttaaaatcagtttcctacctagcataagaagtctttatatctgaaagtataaatacagatatagtgccagggtcacttaagaaaatgaggcttttctttttttcgagttggattttaaaatgttggatatttaacttttttatactgagataaacttgataaatattcacactttgaacttcagaatagtataattttgcaaagcgtctttttagatatctaatatctcatctctttgaaggtgaatgatattagaaattaaatatggagattgtggaggaggtaaagaaaattcaagaacagcaagcaaaacgtgaaatcctcatctgctgacaccctgtacaaccttaccaaaattccaaatacagacatcaagtcactggtttaactttccccctccagttcaggttctctactatgatctcacaatctttaaatcatatttcacataagatgagacaatgcagaaatgtacaataacagtgtgtattgctgcatccctcttccatctctatggcattctcaaaggccaagtgtctgctgtttgtccaacagaaagataatcaaacctatccttgtaattcacatgcctgtaaacatacaggattagtgttggaaatttttgttaggctgaaaaacatttgcctttctccccacagctacacatcaaggaaatacaacaaaacctaaataagtccaagtttgtgatgattccaacagttcttagactgaaagctatcttttcataataaacaagtcatgtttattatgaaaagcacattaacgcggcaaaacgcgattagaaagtaacaaatcttaaatatgtaagagaacagacatgcaaacaaagaagtctcatatcaaacaatcttatctagtcattaaagctggactttcatacaggtaaaaatctgtattgaaaatgagtgaactttaaacttagttatttaacataactgaaagcaagacagaactgtaaaatgatcatcttgaaaaagatatcccacagggtaagggtatgaattatgcagctgatctaaattcgtgaggtgtccttttctggtgtcatttgccctctccatcccttctccgcctgccttctttagctccagcatacacttttttttttttttttttttttttacttatatgtctttctccctctgcaagtaatagccagtattcactgggagtttactatgtgccaagagttttctaagcattgtacatacattaagtcatttaattgtcataacaaccctacgagtttagtattctctttagcgtctttttgcaagtgaggaaactgaggcacaaagccattcagggacaagcccaaagtgacacatcttatgctcctaggctgagggtagccaccattatcttgcttgcccttctggccccagagctggaaatttttattaggctgaaaacatttgccatttctcctcactggtacacatcaaggaaatacaataaaacctaagtaaggccgggcacagtggctcaggcccgtaatcccagcactttgggaggccgaggcgggcggatcacttgaggtcgggagttcaaggccaacctggccaacatggggaaaccccatctctactaaagatacaaaaattagccgggcgtggtgggtccccagtcatgctcgggagggagtaaggagcgggtttcaccacgctgtgatgctgagccttgacttgcctgttctaggtttcatgagctacatcgtggagccgctcttccgggaatgggcccatttcacgggtaacagcaccctgtcggagaacatgctgggccacctcgcacacaacaaggcccagtggaagagcctgttgcccaggcagcacagaagcaggggcagcagtggcagcgggcctgaccacgaccacgcaggccaagggactgagagcgaggagcaggaaggcgacagcccctaggggccggcccaacttagacgcggctctcctccggcagggcccccagagggcagaagcagcgtggaggggccctcacgcagcagcccagccactttctgagtgttgtcctggggctctttggaacgccatcttcctcccacttacctgcctcccctccttttcgcaaatgtacagaagccatttgtcacctcagcattcgctgccgaaatgagcaactccattcagtaacgtgggagctgatcccacgggcaggctctccctgctccaggagaagactaggaggaagaatgaggtgctcctgccgtgtccgccttgttccgggtcgcactggaacaggcagcaattcctaagtccggagcgtttgagcgtttgctatctgactgctgatctgcgtgacagaaacaccagcatatttgcaacgccaaggatattggtcttaagtgcaagagcacaaatgagagtgtgagagaaagtaccttctattttaataataatattattataaaaataataaatctttttaacttttatattttatgcactagacaatggatctgcaactttggactaaggtcattcaatgtacccaaacttgaacagggggttcattgttttgctattgactttattatgccactttggggcagagacttggcatcttcgcagtttaagaaaccacgtttcctatccaatccgaagggaaggtgctgtacagttcattcctttgcaccattagccaatctgtcttttatggattctgtgacatgtttatattcacccatgtacattttctgtaaataccaaacgctactgattcccatgccaaaatacatgagtattatgggattgctacctgtataaacaatggcactgtgaaaatactgttagttttaatacaagagaatgcatttgtaaatatggtatagagtttattaatatactattgtttgcagataaaggccttaactttaaacatctttcatcttctgaaagctgcccaacttaaatcctcatagatgtctttctcaactgccttcccatgttcatctgtatgttttccagctaaggtcacaaaccaaaactgaataaagtctttgaggaaacattttggaaacttcacatgcattccgcttgagaccatagtgtttaatctatggcaccaagcatcgtttcctcagattaatgagacccttcaacaagcctgaatcagtcacttttcaacacagcgatgttttaacaagccagctgctaagcttgtgtttatgtgactcttgttacagatcatggcggtgcgtcagcctcacaggagacatagcaggtctcagaaaccttctatgaccctgtcatctaaccatcagggaattccctgctcccatgccacacatttgtctattatggctatagtaccaaagtacttttggtgtttggttggtgtgcatttctttagtgtcgatagtaactggatttttctttttccttaatctcatgtgaacaactacccaactgtttagctgaagttcatattatttaagtaaagaaaatatttcagttttataacagactttaccttcctggcaggtcattgtagttaattatgtctctagcttggagtgtcaccttggaatttcgttgccattttttctcagacacctggccgtaaaatcagtttgttacagcattcttctctaggctgctaaacgctgtgcattgaaccttttctttagaagtttcagcgtaactaatgttagatgaaaattgttgatgcccctttctttttactttaaacaatgtggtagtgggagaatgactgtttctgccactatcaacctgatcctcatgctgatagaatgacagctagcacttatttcctaagtgcaactgttttagagatttttctcctaacatgcaaaggaaatactgattggcctataataagttcctatagggagactgaggcttgcagaattaaggttcaggggaaattttggaaagttggttgtattttcattgaagtaggagagattatcagatggtgctaaagaaagtgtgaagatcttatgaaataggtggatggtaagttgaaattattgatgtgggtaagaagggaggttgtggaaagttaacactagctttgtatttttttttctgtaaaactgtgaactgatatattttcctttatcactttagtattctgcagttctcagcttggtgaggctccaaaagagaatatgtcagatgtattcctacttccaaacctgtcttactttggtttgatggtacacatagggcttttgaacagtctatttttaatgtatatgaggtcaaatcaaggaaggcaattgctggggacaagaaaagtagaggtaggaaagaagacactattttagctaatggggtttcttgggactaaaaaatggctttgtttaaattataattatataataatttaaataaatgagattggaggtattcttagtagttctgagttgatagtttacattacaattaggtcttgaagaagagctcacagagaaaaaactaccaaatatccaatgggtaagcccatgatgtagccactagtacaataaaaatctgaagtaaaatgaggcataaacttgatgcagctgcctccctcattcaactggggagttcttgagttcctcatttgttggtaaaaagaaaaagaatgtgaaaatgtctctttttttcttggctattagtggctgtcttgcaatatttcaataggagtccaattactagttaaaacactggcggggtgcggtggctcacgcctgtaatcctagcactttgggaggccaagttgggcagatcacaagttcaagagatcgagaccattctggccaacatggtgaaaccccgtctctactaaaaatacaaaaattagctgggcatggcagtgcgtgcctgcaatcccagctactcaggaagctgaggcaggagaatcgcttgaacctgggaggtggaagttgtagtgaactgagatcgcaccactgcactccagcctggcaacagagctagaatccgtctcaaacaaacaaacaaaaaatcccacagctattggatcatccacagattttttctttacaatcttgttctccttgtccatggaccatcaatagttgacttgccaggtttaattctttcattgcttgagaagaaaggaatcaaaggactgtgtgtagtaagctgacggtaaagttaagattaaattaagacagagagagaatacatatcactgccaggcctgataggaaaaatctgctcttccttttaataacagtgatgaattgtcaggaccttatttaggaaaccctgacctacccataactccctgctaggctaagtagaaaccaggttatttctccctgcttatggctccccgcaaagggacttgcagcgtgtcctgcaactttgtcttcagatagtgcttcctacaaaactaggtcttgttttgtaatcttttctcgtgttgaatcagatctgcttacttatttaggtttggttatgagcttgtatctcactgtatttctcatgctttgttcttttaaacaaatcctttaaactgtgtcattttgtatacacatgtgaggtttgaaaaaaaaaaaaaaaaaaaaaagaactaccttgtgagttttgctcaaaatgtggcctaagtagccattggcatgtctagatgaacaaataaaaataaagataatttctttaaaatatcacaagatgaaaatatcctaattctcaccaggtaacatgttaccagtcaatgaattggattcaataaaaggatcccactgctcaggagaggaaacattcgaggaaagaacacagatgcaaacatggcccacgtgactcattccactttgggggctacagaaacgcccatgtccatgaaggtatcacctgctcgttagtgccaagttagggaaacagggccaccattcagctttacatttccccagagtcctgatatttttctgactcatatttgtcaaactcatatgaatgagaatgaggtacaatgttttaagttgtaaaaacatagccaactcagggcaagaattatttgtgaaaaatatggtctcacatttcaggattactggccatgaagaacaatagaacagttcaggcagaactgttctattctaaatctggtattctaaatccatctggaaatagagaagaagaagaacactgccaatgtttccaatgttttcttgtatctttatgtattctcccatattcattttattaagatctgtgttcagaatctctctgattccttaatgactcccatgtttgaatgcaaagctactttttcatttgtggatgttctatatcacaaagctaatatcaaaagagatgccccactagtatttcatgtaaaggtcaggcatggctttcaaatgtacacgggaacctagctgaaacactgtcaaataggccaagcctacatgagcacttagatttcaattaaagaaatacttattgaggagctactatgtgccagacattgtgctagatattgggatttaaaaagacccagtccctccaggagcattcagacttgtgccagagactggtgttacctgtgaacacttcttagagaatttgtgaacagctatgattgctcaaatgcagctaaagctccctcctggcatacaacacaatagaaagcagatacacttccaacacagaaatggatcccaatcctagttctgtcactaacttatcctctgactagacagaagttactaaaactgctataaaattatttcaagacagctgggtgtggtgtcttatgcctgtaatcccagcactttgggaggccaaggtgggggggtggatcatggcgtcaggagttcgagaccagcctggccaaaatggcgaaaccccatctctactaaaaatacaaaattagccaggcgtggtggtgggctcctgtaatcccagctacttgggaggctgaggcaggagaatcacttgaatctgggaggcagaggttgcagtgagccaagtttgcgccactgtactctagcctgggcaacagagcaagactccgtctcaaaaaaaaaaaaaattatttcaagacaatattttttatagtattgttgtggcaattaaaagagttggcatacaaaaaggcatcaagcctgctcgctggtacatggtagatgctcaatagatacaggttctcccttaaattacaaacaacttgccaaatagccgttcttgcatgaataagaatggggagagtttacagtggagaaaacacagtaaagagttggtttcacattaggaagtcaaacttctaattaagccagagagattattagaaaaaaaagtttaagttgtagctgataatggtttgaaaatgtaagattggcttgtcttagtcatctaagcaatgatgcatcattgattccattgcctgaaattcaaattctcatattaaatgtgctgatataatctttagtattttctttccttttaaggaagcagtgcagtagggttttaaaagcattgtcagggcacagtggctcacatctgtaattgtagcactttgggaggctgacgcaagaggattgcttgagtccaggaatttgagacctgcctgggcaacctagaccccatctctacaaaaaaaaatttaaaaataatacataaagtgttggctttggactgggtacagtggcttacccctgtatcttagcactttggtaggccaaggtgggaggatcacttgaggccaagagttcaagaccagcatgagcaacacagcaagacccctgtctcttgctgtaaaaagtaattaaaaaaaaaaatgtgggctttggagtcagaccagaatttaaatccctcattatcattaactacctaaccctaggcgatttatttaatctctctgagcctccatctcctcatgcataaaatgatagtaacatcaacctcctgggtggtcatgaggatgaaagtaaataacatacataaaatatatagcataatttctagcaaaaagggagtactcaaaacatgtaaattcctacatcacttaaggaaaaaatatctacaaagtggaagttaggatgcatctttcactttctatagattgtgccaatttttgtgcaaatgaaaacaagttgcattaagagagactgacagtgactctatctacaggtggccaggtcggtcataaaaataatccttgtattatggacaaaaaaactattttaaaatgtgattcaagaaaaaagacagtgacccagaggtgctaaggatacactggtaagaccaaggacaaataagggactatttcttgtggttttaaagtaaatattcctcagctcagcgagagagaactagtccatctggttaatctaagactttcctggagttgacaagaatacaaccctggctagacagaagcattagttaaataagcaaaacttgataacctgtcaagttttcatgaagtccattcaaatcctacaattcctatccatcagagttcctggtagccctttcccttgccacctcttcatcagatcctttctggccactgacaatagaggctgaagactcccaggcagtctctgcaagtaggtggccctgggcaacataggaagaccccatctctactaaacattttagaaaattagccaggcatgctggagcacagcggcggtcccagctacttgggaggctgaggtgggagaatcgcttcagaccaggagtacaaggctgcagtaatctatgattgtgccactgcactccagcctgggtgacaagactttgcctcaaaaatttaatttaatttaattttaaatttaaaactcaattctaaactaacattttccaaattgcataaaaatgtatgtgcccaaagatgtctgttaagtgttccctgaaaaaaaaaaatggattcgtagccaaagaattatgagaaacgatgaattaaagacataggttttgctcaaagatatttgttaagtgttctctgggggaaaaaatggcttcatagtcaacgaattttgagaaacaatggattaatacataagttttgctcaaagatgtttgttaagcgtttcctggaaaaaaaaaaaaaggcttcatagtcaaagaattttgagaaacaacggattaaatgcgtaggtgttgctcctgtctgcttcccagaactctcaagtgctaatggacatcttcaacaaggtgatacagatgacattgtctggatctagttttgatttcttatcacaaaaatcttccttaactattgcaacccaggatgatctatcattttatcattagtgattgttagctgttttgtattgtcattaatgatgtatgtgtatgtgttctgcccaatttgaggtataatttggcatggtggttaacttgcccaagtttgtggcttgactttaccacttagtaggtatctgaccttgggagagttttcaaactttctgtgcctcagtttcttcatctgtaaaatggtgataaaaatatgacctatttcataagggttttgaagattaagagttgaggcatggaaagccctttgaatgatgcctgccacagagaaagcactaagtattagcaaaaaccattatcttctcccttcatccccctcttgacttgacttgtaagctctttgataacagggataactacccttttaaaaactactcttggctgggcacagtggctcatgcctgtaatccaagtacttcgggaggccgaggcaggtggatcatgaggtcaggagttcaagaccagcctgaccaagatggtgaaaccccaactccactaaaaatacaaaaattagccaggcgtggtggtaggcacctgtaatcccagctacttgggaggctaaggcaggagaatggcttgaacccaggaggcagaggttccagtgagctgagaccacaccactgcattctagtctgggtgacagagcaaaactccgtctcaaaaatcaaacaaaaaaactattctccatagcgtagcacaggacatactgaataaatacgtcttaaatgaaagaacacatttttgactgacaaattggaaatcatatcagattatgttaacatttaaatccaaacaagtaaactccaattgtaacaatgaatgtcccaataatttgaatgcagatgctgttttttcaggtccacagttgctatctggtagacctttagcgttttgaagaacatagtttgggaaaacaatagttttttctcctctcagtttatgagcatactcttctgagtggtgacagtagaaataatttctctgaaggacttgatatccaaagatctctagatttttctctatccaactggaaaagaaacctacagaaacaccactaaattgcttcctttgcgggacaaatatgaatctattgtaatgcacaatccaagaggagacagagacaaatcccagtgctcatctttaaaaaagaacagggaatggcagatgagtctcttattttatccttgttaaaagcacttcagattacacataacctactcctactcttcttcccagtaagcaattatatgtgcattttttaagttgtcagcaaagtaagcctaatggaccaaaatgtatgatcagttttggggattatttatttcttccttcttcccactgctataatttactttgagcctttttttttttttaacaggagagtcagactttacatttcaatgaattcattttctcagaaacatctgtctcagtccacatttgaaaaaaaaaaacttctacatgaaaacaaaagacctatagtgttatagaacagcataagtgagaattatactctgtaattatcagttttcaagtattaaccttactgagatggagacaacaaaaagttctgatctttcaatacttgagttatgtaacgttctgaaatatttctgagatgcctctactgactttagttattaaaaatgtgttattttagaaatagcttatcaaaaaataccttttggcatctggagctttatcttaaactctaacgggaagcttgagattttttttctcttatcagtgtgggcttttttgttgtttgagaccgagtctcgttctgttgcccaggctggagtgcagtggtgcaatctcggctcactgcaacctcctcctcccgggttcaagtgattcccatgcctcagcctcctgagtagctgggattaggattacaggcacatgccaccatgcccagctaatttttgtatttttagtagagacgaggttttaccatgttagccaggctggtctcaaactcttgacctcaagtgatccaccctcctcagtctcctaaagtgctgggattacagacccgagccaccatgcccagcctccgtgtttttttagtagtaggtttccagttctcaagtatgatttagtgaatgttcagccccaccaccaacctgcagaaatgtcaggcagccaagcacaggccctatccccacagtgattgtctgatcactgcacagactgtgaagtccccaggtaccagtgccagcctctgaggaggataagatgagaagagacttcaacagggtgggcaggccacagtgcaagggctgcgtgccaggacctcattctgctgagagttggggtatgtacaagtgtcattgagaaaggcctaagattgtggagggaggtgggtaacctgacttgaatatctaaaaggtatgtgacatgtcaataaagcttcatttgggctagcaagcaaaccagaagcaattaactagacatcactgtttcttcttggtatagtcagagctaagtgttctaggaacacttaaacatttttgtacatattattggtaaaggctctgaccagatgtcaatgatattggcaaactttgtccatataaatcaggtgacttgtaagaagtgttcactgaggcttaattttatttcagaaacaacggcattactgcctagtttacaatttatagtgagcattagagctgatgtcatatgttccttgcactgtattgacacgtgtgaacagcaggcattggccagaaacaacgctggtgccatctatgttccatttgcagcaagagattactcaactcttactctaactcaaatgagactgtcaacgaagataggaggcatggaggagaactgacaagaggagaaagcttatattgattccgtatcctgtgagggaaaataagcatttaaggaagaataaccaagatgaatcaaattactcactgagtatgagttttctagggctgccctaacagattaccagagtggcttcaaatacaaaaatgtattctctcacagttctggaggctagaagtctgaaatcaaggtatcagcaggtctctgagctctctgaagctaccagggaagagtccttccttccttcttctagctcccagagctcaccagaaatccatgccggtccttgagtggtggcagcataactccaacctttgcctccatcatcacaggccttcgtccccatgggtctgttttcccttcttacatggacacgagccagggactagggcccaccctaatcccatatggcttcatcttaactaattacatctgcaaagactattgccaagtaaggtcatattctgaggttctggatggacagcaactatagggggcagtattcagctgaggacacctagacactcctcactcctcactcactcacccaatgctttacctcctacagacactcctcactcactcacctttacctcctacccatccccggtacacatacacacatacacacacacacacacacacacacacacacacacacacacagtccatacgcatctgtcagactctttaactttttatttggagataattgtagatttaaatgttctcgtaagaaataatacagagttggaacttgggggtaagtagtcaaaatgaaaataaaagaaatagagaagctgagcacagctgctgatgcctgtaatcccaatactttaggaggccgaggcaggaggatcacttgaggctaggagtttgagaccagcctgggcaacatagcaagacctcatctctattaaatttttttttaattagctgggtgtagtggcacacacctgtagtcccagctacttgggaggctgagatgggaggatcacttgagcccaaaggttgaggctgcagggagctgtttcacaccactgcactcctgcctggggcaagagagtgagaccctatctcaaaaaaaaaaaaaaaagaaagaaagaaagaaagaaatagagagatcctgtgaactcttcatccactttacccaattttccccatggtaacgtcttgtataactatattacaataactatattacaaccaggaaatcaacattgataaaaatccggtaacaattcagacttcagcagtgttacatgcatttgtgtgtgtttacatgtgtgtgtgtgtgtttttgtgtgtgtgtatcatatcttgcagatttcacctgattgacagcattgagatagagcgtttcaggtttgagatgtggttgtttttacatatttggaggtagagtgaggaagtgtggagaagtttcatggaaggaggaacaaaacacatctttgtttctctcttccatatcttttccttactaattcagatctggctcaggaaaaaaaacaactttttaaaatcccagtggcatcagccatctggagatgacagtatgattcttgttctacttttcagcttcttcactatttcatcattgatttcccagatactttcattcattcattcattcattcattatttgtgcaacaaatatacatgaagcaccaagtttgtgttaggtgttggggatgcaatgataaatgtcttctctgtgcttacaataaagtgagcaactagggagaattcataatagcaaatcataattagtgaaataacagaagtaggagcagatgggatcacatagaagggaaaccacatgacagggtatgagagaagtcaggaagccctcccagaggaagggatgcctaagtcaagatataaataaagagtgaggcaaggggaggaatctgggaagaactgttcctgaccaagggacaatagttgaagtgtttctgaggatgaaaaatattcccagaaacatcaagaaactgaaaaaaaaattagcgctcaagggagatatgtaggtaattgtgcagataataaggaaaagttaaaggtatagaaaatgataggtgcaccagttcctgataaggatgggactcagagagcaggaggctttggagatgaggtcgactcaccaccattgtgataggtgggaaggagatgacgccatgtgggacacaattatgttcatgcattttgtggcaaaagttgcagaattctcatctggtgacctctacattctgggtccagtacaatgcacaggcatctgctggagtgaagggggccaaaagtgggagaaaaaaagggaggaaatcaatagcatatctgtatatgagagagtgttgactcaagaaagaaagagcatagcagagagagttcactgaagaaacttcacatgatcacgtagagcaccaatgctagaagtcgggagttgatagccacaaccatcttaaacatcctgcagcatctccagcagctctcagcccccggatgaagatgagaaggtagaagtcagattcttccaaggtttggatctttcccagaggaaacaaagtagagcagcaaggcaagggagttgattgtagttgtaatttaagctgagtagaaaaggcagtaaagatgagaagctgttggataaaggcagaatcaagagatgaaagagccttagaagacatgctgagaagaaagaaccagagagagctggaaggttaggcttgtgtggtccaaggctgtggaaggtctgaatgtattattttagaggtgaagtggtttgatgtgaagacaggtccaggagctttgggggcagacagcttcaggagtatggagaagtttattatagttaaggaatcaaaagtacgtggtggtaggtgagttatccacttggttactgaagtcacacagggtattggcaggacttgaagtgagaagaagcctggagcttctccagtaactgaagtggaaagaatgaaatgtcaaatgatgccgcagacatgaggtggtagcacccacggcaagaaccccaagggagacgtgttctcagcttgagtcctcactgagggtagaggactaatggtctagaagtggcagtaacacgctgatcccatgtcccaacactgacatgaaggacagttggtaataagtagcctccatttgagaggcttccataaggcaatgttgtcaggggacagtttcagataaaggaatgtctagtgcatacagtggttgtaagagtgtttatatcctggtttgggagttccagggaaaataatagaagtgtcaggaaggaggattgtgacaggaaatggtaggatccaaatatcatggagcatgagaatgtgggagaagataagtgaaggaatcattcttcttaggtggtaaacaagggttacagggatgcgagttagggtggattaagctggccactagactgccaacagaattagtcccaccatcccccctgcagatgggaggaggctctcagggattcacatagccctgccagatgtacttccaagccttaaaagaaaggggaaactcttagctgttggaagaagtgacctttggtctggattgactgtggtggtcttggggaggttgtgggaatgaagtaacttccactcaggtacccagggagtggtgaaggacaccatacccagaaagcacgggctgggagtgggcgatgagtctaggctctttgagggaacagtgatgaccaggaaatactggcacacaacctgctctgcttctccctctgggactccaagctcagcattgctatggttagagattctgtgtgcaatctgcaggtggtaataaggatctgtagctagcatttttcaatctcccttcatactacatccccagaggtcaactgagagcccaggcagcttgctgttacagggagggccatcagacatgtcagttttctgaatgaaacagagtcctggtatgtttgaaaaacggaaagaaatctgtcttcaattaaccaaatggtcattcttcaataacggaaaagataaggtggcagcaaagaccagaagtgggcactaaaaggtatgtgatcttttttttcaggtgagacaagggtctatattcctatccattacaggtggggtcatttctatgactcaaatctgaacaaaatacaggtagcaatctaaattcaatcatgacaataaaatactttccattttccaagttcgatggtaatatttacatttaaaaaaataatttgttctttttttgtttttaaaaaagacaacatgctcaagattacacagaatctggaaaaaatcacttcatctgagagatcaactgatagtaaaaaaacaatgttcttacatagtaacccaattcaagaatatcaccatggagtctaacatggtgtttatttcaaagacaatattcaagtatgtcatttagaacactatgtctaatgtgtctgtaaagaagcaaacactgctatccaagatcattaggacaagtagcggcgccagctgggagaagaccccatgtgccattaataaggtgctgatgggaagggtgcctgacagggaaggccagccgaatgaaattaaaccaccacccccagaaatgcccccttgacaaaagagacaagaaagcgatggtggttggggacctaggtggtggaggtggtggtacaggagggggtgggggtggaagagttggctgggggtggtggaggaggttagggaggtggtgggggagggggagaagggcagtggcgaggcggtgatggtagaggaggtttccaaggcaggggagattatggtggaagagagggctgtggtggaagaggctatggagatccatatggaggaggaggaggtggtgaaggtaaataatttttaatgaacacttccaattacacattgaaaacccaggcaatccctttgttaaggtacaaatcaagcaacatctagattttaatccaagttcaaggtcctatgcccagttcccagacacactcagttgcgaaagaaaaagaggctcagaaaacagctagaaaaagaggttctactcaagctgtcttacatctgatcagagttggctcccaaaagcaatggagagcatgaagaaaaggagatcacttagacagcatcctctttatgcagtgatttcttattaacccttaatgtaagaaagagacaattcttagaattcaagaatttgctaaaaaacaaaataatttttccctgaaattaacctttgtgttttgaagcttccaagccttcctggaattattgtttattattccagagggttcagtgaagattttcaaatgcaactacatcctctgctaacgttatatgcagaggccttcttcctcctacaatgacagggtgtatcacgcagtcttctctagaagcaaaagtgcaatatgatattctactaccaacaacaaggaccaattcaaccagagtttagtttcaaaattaagactcactttacatgagatctactctcaacaaatatttaagtgtacactatattattgttgactgtaagtataaatgcctatttttcttataagaactctgacatctcaaagttgtaactattcattttccaatcacgtaaataacatgtagaggaaggatcgccatcaaagacttaacacaatttatggaagggagaatgagaaagagccatttcctaaaccaaactcaaagggattcaaggaccagggagtctgtagtcttgagtcaaataattaaaatgtgttcactaaggggactataatatcttatcaaaacataagaataattttgggctagatgcagtggttcacaactataatcctaatgctttgggaggctgagactaaaggattgcttgagtccaggagttcaagaccagcctgaccaacatagcaagatcctctctacaaaaaaatttaaaaatcagccaggcatggtggtgcatacctgcagttttagctacccaggaggccgaggcaggaggatcacttgagcccaggagtttgaggctgaagtgtgctatgatcacaccattgcactccaacctgggcaacggagagagaccctctgtgagggttatccgtgaggcttccacttaacagtagactattagtagttaagcttttggggagtcaaaaattatacatgaattttttactgtgtgtgggtggcaccccaacctccctgttgtccaaaagttaactgtattacaattcattctgccaacgcgagtctttctaaaatgctaatgtaattaacctttttgcagtcatttaatgattccccttgtggcttttcagatggattagtccattcttatgccgctaataaagacatacctgagaccgggtagtttataaaggaaagaggtttaatgcactcacagttccacatgaccggggaggcctcacaatcatggtggaaggtgaaggaagagcaaaggcaagaggcaatgtatgcaggggaactcccttttataaaaccatcagatctcatgaaacttattcactattatgagaacagcatgggaaaaacctacccccatgattcaattacctcccaccaggtcactcccaagacatgtggggattattacaattcaaggtgagattcaggtggggacacagagccaaaccatatcatcagaaatccagttccttgggttagaaccctaagtcttcataatctgaaccctgccaatctctatagccttctcttcatgcactttcccaccctcctcttgccagccaccccattcgcccagtcttaggctccaatcattctaaacacctgcaggtctccaaacccacctgctatttcccacctacgaggcttccaacaaaagctccctccactgggaatgctcatcctccaacccaccctttctgagttttccaattcaaataactacctctgtctgatgtggctatcctcctttagacaatcatagcgccctctatcagggcacttcctacctagtatcttcatcactgattatatgtatgtttctccgactggacttcgagcaacttgaaaatatccatttgctattttaaattcaacacctaaaaccacagtgcttaacaaaagtttgttgaataaaataatgaatgaataacccatgggcaaatgatttaatatatggaaaccagatgggctggctgtaaatggttttatgagctttattccttaaagttgatgtttttacattttagaagctagagaagtttccagagtagtgagaatgaaagcaaggttcgcactgatgaggaaaagtatgtgaggagacttaaaaatatctatgattaattaaaaaatttaattttttaaaaggccgagtgtggtggctcaaacctgtaatcctagcagtttgggaggccgaggtgggcctcggcccaagaggaagatcacttgagtccaagagttcaagaccagcctgggcaacatgatgaaaccctgtctctatcaaaaaaaaaaaaaaaaaaaaaagagagagagaaagaaaaaaaagaaaaaaaactatgattttataaatgtgttgtgagaaggatttttataaaatgctattaaactgtttgttgagtgaataaagcaagcattacttgactgcccttgggcctgtgtcactgaggaagtgagcacacaccaggaaatgtttggcagactaagaacaggacacaatcattgcctccagggggtactatctggttgagagacaagacatgcaggataacattcaatgaagacctcacagaagagaaacgtcttgccttggtctaagtcaaaaaagacttcgcagaggatgggggccttagaactgattttgagagaggatctgtgttagtctgttctcacactgctaataaagacatacccaagactgggtaatttaatttgtaaaataaaaaagttttaattgactcacagttccttatggctgaggaggcctcaggaaatttacaatcatggcggaagatgaaggggaagcaaacaccttcttcacaaggtagcgggaaagagaagtgtaaacaggagaaacgccaggcacttataaaaccatcagatctcatgagacttactcattatcacgagaacagcttggggggaaccgcccctatgattcaattacctctacctggtcctgcccttgacacgtgggaattatagggattacaattcaaggtgagatttggttggggacacagccaaatcatatcaacatctaaatgagagtgacagtgagtgagaaggaagaaatctacactaaagtgtaggaagtagacttaccacaagtaagggcaaaaacttgccattgtgttcacctggtggtgagtccatcaacaagatgaagctgaaagtaatcataaacaggactatagggtcagctgaaaagctacaacaggttcaaatacataggatcttgaatgcctaactaagggcaaagggcaaacgtcctcctagagtggtcagaacatgagggaagtggtgttgactatgtaattggcccgcaagcctactgaaagataaagaaaacagaaagcaatcaaaatatttttgttaccatagtaatacaagcactgaaaggggaaaattggaatgctccatcttcagggagacctcattgaatggaaagtctccacagctggtggaaggagggggccgtggggtgtgatccagccagactgcaaatctaagagtccagaacacagaccagcatggcagaggatggggtagcacaacagacgaaatatccaagcagaagaaatcctaaatctctgtgaggaaggtccatattgaaggaacacatttgtgtaaaagagacaatgcattatcacataatcaagaaaattagcctgagttggccgggcgtggtggctcacgcctgtactcccagcactttgggaggttgaggtggatgaatcacctgaggacaggaattcaagaccagcctgggcaacatggcgaaaccccgtgtctactaaaaatacaaaaattagccgggtatgatggtgtcacacgcctgtaatcccagctactcagaaggctgaggcaggagaatcacttgaacggggaaggcggaggttgcagtgaaccaagatcaagccactgaactccatccagcctgggtgacagagcaagactccatctcaaaaaaaaaaaaaagaaaagaaaagaaaatcagaccaagttagtaataatgatatttaggcaactatagaagttgccacataataataaagggggactttgatgccgtatcaggacaagatgtagagctgagctttccttaaacaacaatgacagcttcaccggggcaggatgagctgccagggcacctggtgaatacaaaaggcctgagaggtgaaaaggcaaatccagacactgaggctagaaactttagacaggtgcctccaatctaattatgcagaaagtttattccaaactgataaataagttcatatttctttatgtttgcttttttctgtttgtttttcacctacgttatttcactggcacctcaaaatgaccctgtcatgtagatggggtaggaattattatcctcattttgtgaccaaggaaactggaactcgacattagtaaatcacttgcccaagatcccacagagagtcaaacatggagctgggtcttgagttcttatttctagttcagctctccttccactataacaggaggcctctctgaattaaggctcaccctacagaaatagaaattaaggaagcgtgcggaattaggaggcatcctggcaaggctacagctccaggcccttgtgggagaagacaagtcagcaagcagcagatctatggggaaccctggaagaggatggcaacctcagtcaccaggtatcccttggggtgacagcaagtgggcagggtcaccaactcatcccagtttgcccaggtctgtccccattttcaaatcggaagtcccgtagcctgggagcttcatgctggtgatctcaagcaaaccaacatagtggttgggagccctgtgtaggagcagaagctctggaatcagaagcaaggcccagctttcagaccacgctgtcacaggacaatgcatgcagccttcagtgtgtcacttaactctctgagttgcagtatggagatggagtctctgagttgcagtatggagatggagtctctgagttgcagtatggagatggagtctctgagttgcagtatggagatggagtctctgagttgcagtatggagatggagtctctgagttgcagtatggagatggagttggtcattagcacctgccccttcttcacctcccgccatgatttagttgaacctttttaagttgcctctttttttagtcaaaaagtgtcacatatttgtatggttctacctaaaacttcatactgcaattaagaagacaaacgaggctgcgtttatgaaaatacttataaacagtaaagagcttataaatataagttattattatcattattacctaaaagaaccctttattatcaatagcaaagtggacacaggctggagtgaccatgagcttcactcagtgggaaagccttgttttgtaatatttttaagacttccaggaaaaatcactgttcttttacattttctcatgtaaaattttttcctgccccagattaatggtcattcagatgcctaccagatagacagcaaaccaagaaaaccatagggttctgacatctggttcgctcttaaaacaagaacacatttctaaggttgcactgtagatatgtatcacgatgggaataaatacatacattcatgaaaagactagtgaaaccaaaagcaaaccacaaaaatgaccctagttaggacactgggaaatatattgggaaatgtaatgacccccccccccatggaggccatgttaactttgtgttacccagaaaaatttgtgtaaataattgattgggaaatgtcatgatattgcctctgtctcacacacatctcagagagatgcagaaaaaagaagacagagctcctaccctcccattccttataaaagaaaaaggaaaaaacaaaaagcaaaagtcctacagaaagggcacaatctatcttctgagccagacatgagctcagacagggagagaaatttagagctgttgaaataaacccctttggccaaagacagctctgtgtatcttctctaacttcacagaacactcacaggctatctataatatgtatacagcttctagaaaatctgactgcttcaaacacacatgctgatttggtgacagtgacataaacaaaacatacatggaaaaatccagggccccaagcaagtagtcttggcagccgcgctgtaaggagggttcagctaacataccagtctcccaagtggaggacagcatggaccagattccaggggctcgtttctgctaattgaactatatttacatgactcgatgctgatgtgttaatttgcaaataatgcccttataacatggaaaatgttctccttataaccctgaaaatggtcatcgcctttagggaaagaaatttttctcaagctcagaaggaatggcacactatttttgacacattcagcactcatatagtagcttcgggagttaatattgctgccaaaacccctttagaacatggaaagtggggtctagagccaccgcctattagtcagtgagaagggacacctgctcctccctcccaacacttgtttgccagccacagtacattggcaaggtcctggcaactggaccttggctgtgggctctccataggacagggcaggcaactgcaatcaccccatgccccaaccccgcagacacacacacacacacacacacacacacacacacaaacctggaactatgcatattgctgcagtcttcataagaggcagtaaagaactccacctttagagaaaataaatagcataagtccaaggaggtctcaaattctggcagcaaatcagtggcaagttatacagggaagcaaagtgagaactgaccacaactgtcagttccatctgaaacccactgatctgaggtgcagggcctaaaatgtgaaactttctgaggcctcattgaggttttcagagagtctatccagaagtccaagcatacagtaatgatgatgaagaagaggagcaagagaaagaggggagagtaggtaacctttactaagcacttcccaaggcattgtttaggagctttgcatgtattaactgacaatgaccctatgcagtgagagctactattttttccagtttctacgttaaaaaaaaagttgagaaccaaagggttaaatcattgtcagggtccatgaaaccaggccagctgggtccagagcctgacaatgttgtatggtcattcaaaggctcctagaagagtcccctctacttgaatacctcgaagcaggcaactctgcatccccagccagccctgccatcaacgtcatcagtgtgaatgtgcgcaactgcacacattctagccacggttgcacctctgggaatttaagatacacatgtgcatgtaggcagttatttgttggtgcatggttatagttcatacagaaaataatccgcatttccatcaacagataactagttaaattcattgccacgtggccacacaggatactagtctataaagctggcttctcccttccactccctgcaaccctggaggcacgtggcttcatcagtggatagcactgtgatgggaagaaaactgtgccctttcctccaagtggaagcagggcacttgtactgcaagccgtgcagccccatagcctcgcaatgaattaccatgcagcagcaataaaaaagaaagtggtgcgcacacatccacgcacagagtttgcgcagaccatctctggaaggacctgtgggaaactgatgaccgcatttgcctctgaagaggagacctggagaactgggggtgggaaggtgtactttttacttataagtctctttgttgtgtttgcattttacatgtatgtgtaaaccaagcataccttttaagaaagactaaaatttcaagttaaaaattcctagcctgggccgcatgacaaaatcccttccctacaaaaaaatacaaaaaattagccaggcatgtacctgtagtcccagctgcttgggaggctgaggtgacaggacaggcttgagcccaggaggtcagggcagcagcaagctgagatcataccactgcactccagcctgggcaacaaagtgagaccctgtctcaaaaaaaatacaaaaaataaatttaagaaaaatttgaataaaccagcaaaaaataaaatattcattaataatcagtcacaagcaaaaaattagaaaaggtaaaacaaaaaaaactaagtgtccaacaatttgggaaatggaatacaaaaattagctgggtatggtggcatatgcctgtaatcccagctactcaggaggctgaggcagcggaatggcttaaacccaagaggcggaggttgcagtgagccgagattgcaccactgcactccagcctgggcgacagagcgagactccatctcaaaaaaaaaaaaaaaaaaaaaaattggggaaatggataagaacataagaggatatgtcttcagtgcaatatcatgtcatcattaaaagttggggaagctatgtagcaacaagggacatgtttagattacaatgtcagtgaaagagcagaatgccaaactgtatgttccatgtgattacaatcacgataatatgaagaaaattgtcttctcttagcagctagaataagtatttcttctaaaggtggggatagggctgagtgagctgagatcgtaccactgcactccagcctgagcgacagagtaagaccttgtcacaagaaaaaaaaaaaaaaagaggcaataagaagcaaatatgttccagctctaaaaggcagttggaaatcttgcagaagacagtgacagcaaagattagtaatgaaacctccacgtttatcagatcctcagggtgcttaggttttttctgccaccatgtccaagcccctcactcctgggatcaggtaaaagtgaaaaagcagcatgagctgcaggagagagggatggataggcagcaggaggaggaaggagttattttttatttcctcgtaggacggagtctcactctatcacccgggctggagtgcaatggtgcaatcttggctcactgcaacctccgcctcccaggttctaatgattctcttgcctcagcctcccgagtagctgggattacaggtgtgtgccaccacaccaggctaatttttgtatttttagtagagacagggtatcaccatgttggccaggctggtctcaaactcctgacctcaggtgatccactcacctcggccttccaaagtgctgggattacaggtgggagccaccgcccccggcagactggaaggagcattttggaaaacaccttaccctaccaatgcatctcaaatagatagctgatcctgatggagaaaataaggctcaaaaacggaaataacaggtctttctcgattatattcgttctgtagagtatataactagacagtcataaggctgcttacctcaaacagcacatgtgatagctaagtaggtagataacaaagagcatgcagtattttataaaccacagttcaatcctttctcctctgctcttctcccccactcctgttcctccttcatccttccgcccacagaatgtaggattcacagtgaaccactgagcctcaagcctgatacttgaacagatcacaactttccacatcacttacgcctcctaagcctcagaatctccatgaataagatgggaacagtaccaatattcagcttttgaggttatcttgagcattaaatgagatcatggatgtgaaaggccgctggaattttaaagcattctataacattattttatcaggggcaaaaaagcttatcctgtttcagaaaatgcagaaaaatatccccaagaaatatgatggctaaaatacacaattttgggataccacataattttataacattagaaattcaaatgttaataaacttaaaactatatattaccatcttgtttttattttattcccatatgtacttataaatagaatctaacttaaagaaaaataggctaatttgactcctcttttactttaattaaggcctcttagaagtaataataaataaataaataaataaataaataaataaataaataaataaataaaatatctttaaaagagaggttgttgctttaaaaaagggacgatgttatttccttgaagtcacctttcaaaatgcagcaacaaagtaggcttcaaattaaattgagtggaaaactcagcgatagcgtcctaaaaattccacgcaccttaatcagaatatttccctttgtttttttatttttctaggtaaaaatattcttttttttttttttagacccaggttggagtacagtggtgggatctcagctcactacaacctccacctcctgggttcaagcaattctcctgcttcagcctcccgagtaactgggattgcaggcacctgccaccacacccggctaatttttgtatttttagtagagacgggggtttcaccatgttggccaggctggtctcgaactcctgacctcaggtgatccacccacctcggcctcccaaagtgctgggattacagtcgtgagccactgtgcccagcaaaaatattctttctaagtttacctttctttttcatcatattgaatataagcatattcatgatattaattggtaaactgctgtgcattatctttactattattactataaataaattggtgttaatcaattgtaagtgaatattctaaatgaaattcaatatctaaaccaggtcacagagccatgaggtcatcgccaaagcccctctggtagtggtccacagtcataatcccaatcattctgcccatctcctctacccagcacatatttagagctgttggacagaaaggacctccaagggaggccatggcagggagctcatggccttacaatgcatacaactccaggctgaacagctcctggtcttagaaggccctcttgactctgagcctctatctaccatcctttgacttccagccatgaacctagagcttccatcttgagcaacacataaaatcagtccccctccatgtgaagagaactaccatgttccccatcagtatcctcttccaaattaaatacatcaaattgcattaactcctccttataaaacaggatatcctgactccttcgccatcctggtgaaacttctctggatacaaacttctctgcatcttcccaaatggatatactattccaaacatcctctaaattattctgtgtacaatggaattcactcctgttatgaatgaatgttacctatataattgtaacataaatttgcatgcattgtattgtttgcttgttttgagaagaggtgtttgttttggaatctttatctcattccaggcttatgttgagcttggtgccttatagttggaattagcatgattatatgaataaatttgtctttaaaatgttcaggaaatatcttaacatttttacttaaattcagcattcttacattcctcaaggtcaaagagaaaagaactacataggtcttaatactaagtattttcagaaaggatgccacaaatctctataaagagtaagggacttctgaaaaatgatgcgtagtcaaagtaaagattatttttcatcttcaaaatatatactagctaagtgtcttgaagggggacattataagaaaatagactgactaggtcctgtaccaactggtgatatctcaaataagaaaggttttagcaaaacatgtgataatcataagctaatctaagcaagagatgcagttggggtgagctttaaaagtgttttattctctctctagcatggtacctggaagacagtaagcattttggaatcaggccttgtttcaatgccagagacacacctgtgaataaagcagacacaattctctatctacacacagcttacacctgcacacataagtatgtatatggtgatggtaagtgtctgtcttagtccattctcacactgctataaggacatacctgagactgggtaatttataaagcgaagaggtttaattgacccactgttctgcatggctgggaggcctcaggtaacttacaatcatggtggaaggggaagtaaacacttccttcttcacagggtggcaggagagagaagtgacagcaaaggggagaaaaagccccctataaaatcatcagatcttgtgagaattcattcattatcatgagaacagcatgagggtaaccaccccatgattcaattacctcccaccaggtccctcccgtgacatgtgggcattatgggaactataattcaagatgagatttgggtggggatacagccaaaccagatcagtgtcaatgaattcataaaagcaaaattcagaaattcatgttccccctcattttccatcaaagagaacaaaccaagactaggcatggtggctcccacctctaatcccaacactttgggaggctgagatgggaggatcacttgaggccaggaatttgagaccagcctggtcagaagagcaagacctgtctctacaaaaataataaattagccaggcatagtggtgcacacctgtagtgccagctacgcagaaggctaaggcaggaggattggttgagtcctggagttcaaggctgcaatgagccatgattgtaccactgcactccagcctgagtgacagagcaagaccctctctctaaaaaaaaaaaaaaaaaaagtataattatactttttttcaggcacaatgctgaaatagaaatgtttcatggttcattgtcttgagggatcattgatgttctatgaattaattgggcaagagaaaatatttcaggcttcaaaataaaataaagaataaacatgacatcttggatttgtttactttacaaaataaggtcgacatacttagtcatttgtgcagctaccataaaggagcctaggtaagtaatgtatcttttaaaaatacacacattttatattctctaagtatttagtcatagggtttttttctaaagtctgcattgtataaagaaggaaattgaggccaaaagacattaaaagacttggctaatgtgactcagtaaatgagggtcattgcaggggctagctctccagtctcccatgctcagtacgctctttctactcactccaacttctacctgtgacttcagacagaggaaaaagagatgagcaactctaataaaatgcacagatcattcttttttaatttaatttaatttttatttttccataagttattggggtgcaggtaatatctggttacatgagtaagttttttaatggtgatttgtgagattttggtgcacccatctcctgagcagtatacactgcaccatatttgtagtcttttaaccctcgcctccttcccactcttttccccaagtccgcaaagtccattgtatcatgcttatgcctctgagtcttcatagcttagctcccacatatcagtgagaatatatgctgcttggttttccattcctgagttacatcacttagaataatagtcctcaatctcatccaggtcactgcaaatgctgttaattcattcctttttatggctgcatagtattccatatatatatatatatggttttatatatatatatatatatgtgatatgattatcacatatatatagatatatatgtatatatcatggtttctttatcaatttgttgattgatgggcatttggattgtcccacaattttgcaattgtgaattgtgctgctataaacatgtgtgtggaagtatctttttcgaataatgacttctttttctctggctagatatccagtagtgggattgttgtagcaaatggtagttctacttttagttcttcaaggaatcttcacaatgctttccacagtggctgtactagtttacatttcgaccagcagtgtagaagtgtttcctgttcaccacatccatgccaacatctattgttttttgattttttgattatggtcattcttgcaggagtagggtggtatcgcattgtggttttgatttgcatttccctgaccattagtgatgttgagcattttttcaaatgtttcttggccatttgtatatcttcttttgagaattgtctattcatgtccttagcccacttttggatgggattgtttgcttttgtcttactgatttgtttgagtttgttgtagatttgcacagatcattttaatatgtttttctaaaactctagatctgaaatcaggtggaaagaaacaaaagttggaattcttacagaaaaaacttgccctaagcactatgaatctagtgctcaacacagcatatggtagattaaatggtcaaaaatcagcagaactcaacaaaatgttttcattcatttcaaactgattatcaccagtattaacaatttaggcagacagattcctgatggcaggcatgtgccattaatgaaagagaaattaacatcagtgatattttaccttccatctgcttttttagtgactgaatttgatcataatattcagttcaagtagaaaataacagatgggtataaaagtcccacgtacattacttcttgaagaatataggaaaacacatgtattttttacacactacttcaatggcttttgtcaaaaccaacctgcttttaacttaaatagtcaaaaatattttcatctttcttcaaattttactctatcatctgttaaaactaactttaaatcttggatccaaacacctatccaggcaatattggtcacaacatatgttgattattttaaagtcttatgactgatttactgacaacactcttaccaggaattctgaaaaatgagtaaattcttcaaaatgagttgtattagttctcacactgctaataaagacacacccaagactgagtaatttataaagaaaaagagttttaatgataaagaggatatcaccacggatcccacagaaatacaaactaccatcagagaatactataaacacctctacacaaataaactagaaaatctagaagagatggataaattcctggacacatacactcccaaaactaaaccaggaagaagtcgagtccctaaatagaccaataacaagttctgaaattgaggtagtaattaatagcctaccaaccaaaaaaagcccatgaccacagccaaattctaccagaggcacaaagaggagacaataccattccttctgaaactattccaaacaattgaaaagaagggactcctccctaactcattttatgaggtcagcgtcatcctgatatcaaaacctggcagagacacacacacacacacacacaaagaaaacttcagaccaatatccctgatgaacactgatgcaaaaatcctcaataaaacactgacaaaccaaatccagcagcacatcaaaaaacttatccaccatgatcaagccggcttcatccctgggatgcaaggctggttcaacatacacaaatcaataaatgtaatccatcacataaaaagaaccgaagacaaaaaccacatgattatctcaatagatgcagaaaaggcctttgataaacttcaacatcccttcatgttaaaaaccctcaataaactaggtattgatggaacatatctcaaaataataagagctatgtatgacaaacccacagccaatatcacattgaatgggcaaaagcaggaagctttccctgtgaaaaccagtacaaaacaaggatgccctctctcaccactcctattcaacatagtgttggaagttctgcccagggcaatcaggcaagagaaaaaaagaaagtgtactcagataagaagagaggaagtcaggccgggcacgttggcccatgcctgtaatctcagcactttgggaggccgtggcaggaggatcacgaggtcaggagttcaagaacagcctgacaagatggtgaaaccctgtctctacctaaaatacaaaaaaattagccagccatggtggcaggcacctgtaatcccagctactcaagagtctgaggcagagaattgcttgaacccaggaggcggagattgcagtgagccgagatcacgccactgcactccagcctgggcaacagagtgagactccatctcaaaaaaaaaagaaagatgaaatcaaattgtctctgtttgcagacaacattattttatatttagaaaaccccatcatctcagcccaaaaactccttaagctgataagcaacttcagcaaagcctcaggatacaaaatcaatgtccaaaactcacaagcatttctttacaccaacaataagcaagcagagagccaaattatgaatgaactcccattcacgattgctataaagagaataaaataccaaggaatacagctacaagggatgtgaaggacctcttcaaggtcctctcttatttccaaaccactgctcaaggaaataagagaggacacaaatggaaaaaattctatcctcacggataggaagaatcaatattgtgaaaatggccatactgcccgaagtaatttatagattcaatgctattcccatcaaactaccattgacattcttcacagaattagaaaaacctactttaggccaggcgcggtagctcacgcctgtaatcccagcactttgggaggccgaggcaggcagataacctgaagtcgggagttccagaccagcctgaccaacatggagaaacccaatctctactaaaaatacaaaattagccaggcatggtggcacatgcctgtaatcccagtaactcgggaggctgaggcaggagaattgcttgaacccaggaggtggaggttgaggtgagccaagatcgcaccactgcaccactctagcttgggcaacaagggcgaaactccgtctcaaaaaaacaaaaaacaaacaaaaaaaaaaaactactttaaatttcatatggaatcaaagaagatcctgtatacccaagacaatcctaagcaaaaagaacaaagctagaggcatcacgctacctgccttcaaagtatacaaggctacagtaaccaaaacagcatggtactcatcccaaaacagacatatagaccaatggaacagaacagaggcctcagaaataacaccacacatctccaaccatctgatcttcgacaaacttgataaaaacaagcaatggggaaaggattccctactcaataaatggtgctgggaaaactggttagccatatgcagaaaactgaaactggaccccttccttataccttatacaaaaattaactcaagatggattaaagacttaaatgtaaaacccaaaaccataaaaaccctagaagaaaacctaggcaatgccattcaggacataggcatgggcaaagacttcatgactaaaatgctgaaagcaattgcaacaaaagccaaaattgacaaacggtttctaattaaactgaagagcttctgcagagcaaaagaaactatcatcagagtgaacaggcaacctacagaatgggagaaaatttttgcaatctacccatctgacaaagatctaatagtcagaatttataaggaacttcaacaaatttacaagaaaaaaatcaaacaaccccatcaaaaagtgggcaaaggatatgaacagacacttctcaaaagaagacatttacacagccaacaaacatatgaaagaaagctcaacatcactgatcattagagaaatgcaaatcaaaaccacaatgaaataacaatctcacgccagtcagcatggtgattattaaaaagtcaagaaacagatgctggcgaggctgtggagaaacaggaatgcttttacactgttggtgggaatgtaaattagttcaaccattgtggaagacagtacagtgattcctcaaggatctagaaccagaaataccatttgactcagcaatctcattactgagtatatacccaaaggaatataaatcattctactatgaaaacacatgcacatgtatgtttattgcagcactatttacaatagcaaagtcatggaaccaacccaaatgcccatcaatgatggactgaataaagaaaatgtggtccatatacacgatggaatactatgcagccataaaaaggaataagatcatgtcatttgcaggagcttggaagaagctagaagtcatcatcctcagcaaactaacacaggaacagaaatccaaacaccacatattctcactcgtaactgggaattgagcaatgagagcacatggacacaggtaggagaacaacacacaccagggcccgttgcgggatggggaaaaagaagagggaacttaaaggatgggtccataggtgcagcaaaccaccatggcacacgtatacctatgtgacaaacctgcactttctgcacatatatcccggaacttaaagtaaaataaaatagataaataaataaataaaattagattaaattttaaaaaagaagaggtttaatggactcacagttccacatggctggggaggcctcacaatcatggtggaagccaaaggaggagcaaaggcatgtcttatatggtggcaggcaagagagtaggtgcagggaaactgccctttataaaaccagcagatcacatgagacttactcactgtcacaagaacagcacgggaaaaccccacccccatgactcaattacctctcaccaggtccccccccacgacacttggggatccagcagacaccaccaccacttcatcccacttcaaatgtggtctcccatgctcgagaagcagtactcaccttctggtctgcaaagcgccatcctggcataatttgccttggcatttgtcttttaacgagtattttaaacgatcttttaaacgaatataatatctttggaagcccttatttgcatgtattagttatgatatacctaataaacattccaccactctaatttaccaatctttaccagttataaaagcagaaactataatcatgtctttcaaaataagccttgggctgttttgtagcagtgaaatcgatagttgtacttaacctaaagaacctgtgagaatcccactgcagtgttgaaatttaacaattaagcaatactatccctggctttcatcattgaatttcacaaaatatgttatttgctgggaaaacagttgaatcggcctgatgacgtgaataatctcaggcctgacaaggatatagctgtattataattccttagtgtccttaaatgtaagctacttttgcaattaatactaaatctaacctcgctttttccgtaatttctataatttcatctgaacgtagtaacaggttagcagggggccaccagcctgggcgctctcggtgttatactgtcctctcgtggtaaatatggagaactgcagcctgacggctttttcctctttcagtttcctgttccattattttgccgtgctatacatatccttgtaaactgccttaaattctttctaggacacagcaaaatctaaaataaatagataaacaaatgtataagatgagaactgttgactaggagcttaaaacatgggttggaaaacccatctgcttgggttcaaatcccagctcttaaagcccagcacagtggcacgcacctgtagtcccagcttcttggaaggttgaggcagaagaatggctcaggttcaggggaaaaataaaaaatgaaaattccagctctgccacttaatcagctgtgagaacctgggttatctactggggtggagatagtctctctctatgcctagctcctcatctgtagaatgaagataacaatagcctgcattgcatagtgctgatatacctccatggcaagcactaggaacagaactactactccttctcaaaaacaaacaaaaaacaaaaaaccaaagtgagagctttatcacctaaaaggtcaattacagcttattcttaaatacagtggaacagaagttctctgggacctacagaccacttccccactgtgtccaaattggacacagagtgcagaaaactgaaactgcaacccagctgagctgtgattgtgtcttttttcactggaagaagtaaatcatagaatgttagtgttgtacattggactttggagcacattccgtttggcctcctcattttacagttgaggagtttgaggcccagagaagtgataactcagttctcccgatgcatttccatgatgcgatcactgcttcatgctctgagtccttgtaaacacaggaatttccaggaagaggaaagggcaaagctgtgatcaaccagccatagttttcccagccctagttttccccatgcagctgcagaagtcaccgtggaatgacccacgagcaaggccacaggcacagacacttcgggagctgacaggaatagatctttagagacaggaaggctttcctacccaaccccaccatcaattttttaaaagcaagcatttcccacaaggtaaatataagaactagtctggtcaaaggataacaaggcagtaggtactggaaattccggacaatttgtactactcaagctaactgcaatgcaagacaggctctggaacttaaggcaaagctattatgtccggctctgccacaattttagaatccgcgtcccctgtagtggactgtgatgcaccaccatgttctgtcctcaacagaggttgtcctctgacaaccctctctgaaaactgccctcagctcaagaaggttgctttgttcaaggtcaagccccccagtacttagtcaacgagaaagtgtagagactcagcactcccagagtgatgggggaccactccagagcccctggggttctgctgaggccctgctgagattgcatcacagcccagctgccccctcacctgagtattatcctgaggacacgcccagagagatgtcctgcacattcatctctactcagagcctgcttgccagagaaaccaaatcaacagcccttttctgatataaaatctcacacgtcactcttcttgacctgttcgggttttgtggggttttttgtttgtttttgtttggttggttggtttttttgaggggaagaggatcaatttaaaataaatccattgtatacttagcctctccaatctgagaagagagtgtgctttatatctggcaaaacctgtttaaaatgctgtttcccgattgctaccacctaaattatcctccgtgtaaatggctgtttctccccaaacctaattccaatggatggaacgtttctgttcccccaaaattcacacgttgaaatcctaactcccaaggtgatcgtatttaggaggtgaggcttttgggagatgattaggtcaagagggcggagtcctcgtgattgcgattagtgcccttgtaaaaaaccccagagagctctctcaccccttcagctacgtgaagacacagcaagaagatggctaggccttctatgaaccaggaagcaggcccacccccagacaccaaatctgccagcaccttgatcttgggcttcccagcctccagaactgtgagaaataaatttctgttgtttataagcccctctgtttacggtattttgttataggaaccttaatggactgttggaaatttttatttagatttcataattaaaacacaaatacatagtcattataaaagtatgaccttttgatccgccatccccagggggcccatgccactgtttccaatctgggtcctctccagattttgatacacactcctaggtagtcacgtctcccctccctgctttgaaaaccactaccatctgcatatcaaccagtcaagattttgaacattaacttcttgcagtctatattataaaaccctttttaaaatttttccaaatataaaatactattagaatgttttgtgaaacatccttgctcaaacaccttagtttgagggcactaactaacacccagtttggagggaaatgaaacccactcaaaggcatttgaggaagtgggagaagggacttctccagggcaagcaagagaagtgtttcagagtcaggaaaggaagctattaacgtaacttgcaagagaaagctgcagcatttacagtaatttcatcgaattttaaagtaatcaaatctgaattttataacatttggcatgaggtcatttatgtataggctcatgaggaaggcctaaactgaatccccaatcctcaagaattctaaagtgaacacaacagttaccgggagcccaaaattaggccactgcagattttagggcatatggtcatgtcctcccagataccaggagttatacttcgaaacacagggaagcataaagtcaactcaattctaatgcatcactggtgttgaaatgtgctttgggaaggcaggaaatccattctaacgaagagcaaaaaagcccaccaaaaagccaacttggggtttgtcaagaaatgatatacttcacttggcagaggatagtatcttccaaagattcctgctggttgttgaaggattgttgattacacatttttgaacaaggaaactagaacactgaaaatgcaagcctacctacttgggaaataaaaaaagttatttcaagagaaaacaaactcttattacaaggataatgagaaaagtcagcgtggggaaaacgtttaagaggggcaggaacaacagcaagaacaaaaactattggtagctagataagaaatgtcaaaaacaatcacaggctgggtgcagtggctcatgccagtaatcccaccactttgggaggctgaggtgggtggatcacttaaacccaggaatttgagactagcctgggcaacatggtgaaaccccgtctctacaaaaaatacaaaacgtagccaggcatgatggcatgtgcctgtagtcccagctactcaggaggctgaggtgtgaggatcacttaagcccaggaattggaggctgcagtgagccatcactgtaccactgcactccagcctgggcaacagagcaagaccctgtctccaagaaaaaaaaaaaaaaatcacagaaggaataacaaataacaggcaggcattgaaactacactacgacaggtgcagcaactcatgcttataatcctagcactttgggaggccaaggcaggaggatcacttgaggccaggagttcaagaccagcctaggcaacgtgagaccctgtctctacaaattagccaggatggtggtacacacttatattccagctacttcagaggctgagggaggaagagcgcttgaacccaggaatttgagcttgcagtgagccatgactgagccactcaccccatcctgagcaacagagtgagaccttatctctaaaaaaaaaaaaaaaaaaaaaaaaaaattacactactatacttgctgtatcattacaaatgcttttggctgcatgtgacagaaaacacacggggcatatttttctcatatatctttctttaagaagtctgcaaacaggacttgttgatgttggttcaacagctcagtgatgtcatctctgtgattctaacccttttcttcatggtcataactgccacacagccactcctaactggagctgttgatgttggttcaacagctcagtgatgtcatctctgtgattctaacccttttcttcatggtcataactgccacacagccactcctagctggggctaggcaagcaactctctaccacaacaacaagaaaactgtaggaaacctgggctttgctgaaagtgaagagcttggcaaaatgggtggggctgagtccattccagtggtgacctcagctccctggctgttgcacacagtctgaaaggtccagggaaacatgtaaatttccatatcacattagtatgtgggagaagagggacaaaatatctgttgcaaacttatgtttcatttctattatccaagaaactctacctatggcattcctcacaaaaaacaacaacaaaaaaaggtcagactatgtggtgagaaaacatgaattttggttgctacaaaacacaagcaagttcaaaaagaatgtttattttaagctctatgtacagaagaacagagtataaacgtaaaaaggaacaaaggaaacaaaaatgacaggcatacatatttacatagcaagtgtaggcaaaatgtgtcaagaagagtctttaaatacatctacttttagcctttaacagtccaaatcagtttctaagaataatttatcatccaggaagaagttttggaagtttaaagctcaaccttaagttgagtttaaatccttgagtttagaaggcttgtgttgctgataccttggtcaacagcttttgtgttgaccatttcttctttagttcgctgtccttctgactgtgaaatgtgatgtccaaactgaaataaagcaaatatttaacacagaaattattctaatgtcaaaaaaaaaaaagaatggcaagacaaaggccagatgaccctctgaggtttcattcacaatatttatttaccgtatttattactataatacatagttatttggctatgtatcaggtactacgctcagagccaaggacaaaagtgaacgagacactctcagcggcacagactgagctcttaggcaactaaaatttgagtccctatgtgcccagcctgaaattaagtgctaaaaactatgtaaaaaaaaaaaaaaaaaaaaaaagaagattatctaaaatacttgtaattggctggaaaaagtgctaagagacactgaactaatagcaagcagtaaatgacaacctagaaacacttcgtttatccactatcactgggaaacagtgtgttccacctacgggaacttcttacataaatgcatcctcaaattttcaaacatcctcaaattttaagaaaccaagttctagtctctgctctgccccttagatatgggattataggcactacagggatcatttccctcacattttcgggggaaaagggattgctgctgtgaagatctagtgagatgagtaaaaaaggtactttgcaagttacaaactgctctacaaatgttaaaattaaacatttattttagacacacttgcatttttatagtaatagttctaaagtgtcttcttaaatagttaaaagaatataattttctaagtcaacatgctaaacatcagatatatacacacacacacacaatggtgagcacagaggctgcacacactggagtggcaatgtgtgtgtgtgacaagtccctccactctgttacactctttttctttttttgttttttttgagactgactctagctctgtcgccaggctggactgcagtggcacaatcttggctcactgcaacctccacctcccgggttcaaccaattctcctgcctcagcctcctgagtagctggaattaattacagatgcgtgccaccacacccggctaattttcgtatttttagtagagacgaggtttcaccgtgttggtcaggctggtctcgaactcctgacctcatgcatgatctgcccacctcagcctcccaaagtgctgggatgaccacgcccggccctgttacactcttggagggctcaatgcatctgagttttccagtctcttcctctgctgacgtctgtccttcctcagtgctatctagctgactttagatgctgttcctcttccacactcctgtcattctcaaggcttattcttatgtgttaatactacctcaactaaattaagacatgtgaaaaccaccccaaaattagaattacttctaaatttaagaaaagagacttcaagtaaggagtaatcttaaggctcaaatgcttaaaatccagtgtttgtcatcctaggcatccagtaagtgctgtcactaaagataactataatcccatttgcttttttacatgcagagttaacattatattcaacaaaatatccaaagtctgtatatttgacagagaaaaatcttggcgtattcacattccatatggttagggggaatctattgcaccattcttccctggccctctcaaactgtcagacacccagttcatactgcagatggcaacatcaaattggcacctaagataagtcattataaacatatgcacaaatatttttcaaattaagtattttatttcaaaagagctcatgataggctaaaagtgaaaatgagcatataaaattaacaacaaaaaaaccccagaaacattagcagcatcaataaacaattatatagcccattctgcacaattacttcaagagaacttgaacacaaagctgtaacataaacaacacatctgagaaaaactgaaaaattaattttacattagtgtagcttacccttgaagtttctggactagaaaatggggaagattcccaagatctattctctttctcaaaagaatcatcttcttgaaatgcaaatttctgtttaagtgcatgagatattaaagaaactggatcccaatgtgaattctgtcttttcctcttatgaatgggtctaccgccaggtgacctattttttaaaaaaaaaaattgaatttattaaaacttggatgtaattttagctccttgttgacaaacatggcaggaatacaagcatatcttacaatttaattagtcttcaagagattgaaaataatctaatcttcaagaaattttcgcaatgaaataaggaaggcacaatgaatgaagaatcagaaaaccaagaacccatgtgacttgagactctgccataaccttgttatgacctgagatttgtcagatgtcactatgctgaagatctttattatggtaattttctaatttcctaatgggtaggaaaattcaaataaataagaacttttaaaaggacgagagttcatgccaaaaaaaaaaaaattacgcaaattgttcatttgtttggttgttcattcatttaatcttcattgaatgcccactaccacatccgactccattttatgctttgggagtattctgctcccaattcttacagcaagattatcatcaatatacaagtaagatcatttggctggtaataagagctgtgaataaaacaaaacagaggctgggcacggtagctcatgcctataatcccagcactttaggaggccaaggtgggaggactgcctgagcccaggagttcgagagcagcttgggtaacatagcgagaccccatctctagaaaaaatttaaaaattagccaggcaactacttgggaggttaaggcaggaggatcacttgagccaaggaggtcaagcctgcagcaagtcatggcaccactacactccagcctgggtgacagagcaacaccctgtctcaaaaaaaaaaaaaaaaaactaaattaaaaaataaaaaatagggaaatgtaatagtgattagggacagaagcactttagatatgatcagaaaaaaagcctctttaaggaagcaacatcctctttaagaaaatgacaaggggtcagttttagtgtaaacatctggggctgcatcaggaaggagcttggcatgtgtgagaaacggaaaaaagaaagcaactgcagctggagtgcagtgggcaaacatggggcataggagaggagctcagcgagagaagtgagggctggctcctggaggggcctacggacacagcaagggctctagaactgattcaagcacaacggaaacccacagaagagtctgaagcaggagaatggcctgatctgacttctggtcactatctgcagaataaataaggaggcaagaatgaaaacagatcactgaggaggctgctgcggaagtctaagctagataagaatgggcttagcctggggagttggcagtggaggtcaagaggtccacagaattgagctatgtgctgatgggaacggtgggagatagaatggaaaataaagatgaaggatgattcctagatatttgtttttgtttttttgagacggagtctcgctttgtcaccaaggctggagtatagtggctcactgcaacctccgcctcccgggctcaaacaattaattctcctgcctcagcctcctagtagctgggattacaggtgtgcgccatcatgtcagggtaatttttgtatttttagtagagactgggtttcaccatgttggccaggctggtctcgaactcctgacctcgagtgatctgcccacctcagcctctcaaagtgctgtgtttactggtgtgagccaccgcacctggcctgattcctagatcttaagcaaccgggtgatcgtgttgccatttgctaatatgcaaaagacgtgggaaagaacaggttttcaaggtggcggaaaagaacaggtaggaaggaaaagtcctgttttggacctgtgaaacgagatacctgtgagacaggcaaataaagatgtcaagtaggcatttcagtatgtgcatctgggctcaagaggagaggtcagggctagaaaaataaacgtttgagtcataagcatacagctggtatttagagtcataggactaggtgagctcaccaaaggaaacagcatggacagagaagagagggggctgaggtctgaaccaggtatttcaacatttaaagaccaggcccagggggaagagtttaaggaataagaaggaatagctgatgaggtcagaggaaacctgggggtatgctttcccagaaaccaagtaaagaaagtgctccaggctaggcgcagtggctcatgcctgtaatcccagcactttgggaggccaaggtggtcggatcatgcggtcaagagatcgagaccatcctggccaatacggtgaaaccctatctctactaaaaatacaaaaattagctgagcatggtggcacatgcctgtagtcccagctactcgggaggccgaggcaggagaatcacttgaatccaggaggcagaggttgcagtgagccgagatcacgccactgcactccagcctggcaacagagcgagactccgtctcaaaaaaaaaaagaaagtgctccaaggaggtggggaccataggctgtatcaaatgctgccaagaggtcaactaagacgagcaatgctaagagaccagtggatttagccacatggagtcactggtgaagcagttttcaatggagttttcatgggtagaaggcagcagcgatagacagaaacaaattatagacgacttcaagaattcatatcagaaaggggagcagaacaacagaacaacggctgagagtacatgtgttttgaaggtgggaagtactcaggtgtgaggagaaggatgaagtatagaaggaagactcagtgatgcagaagggctcattttaagtgaaatccttgtgaagaggaaagagaagggaaaccagtaaccaaaggaagagcctggccatgaatgatgacacttggctcccaacagcaagatggaaggcagagaatctgcacggggaatctgtaggtgtaaagaggtgagagagctcatctgattcctcagcaacgtacaaaacaaagttagctgtagaggcaactcaggagagaatagggggacaggaggcagaggctactggccttttagttgtttttccagtgatggtaacagtcacagagttgccacttgatactaagcccgacaacacaagtacaagatctagttgggaccaagcatgcacctacagccatgagattcttctcaacaagctgcctcatgctcttcctgtggttactggtttcccttctctttcctcttcacaaggatttcacttaaaatgagcccttctgcatcgttgcaaggatcaaactcacaacctcattaaaaacagaactgacttatctgtcccaggactatcatacagaaaatatatctattttctcaccgaaaacctcactgagggatttccaagtaagcatggcaaatcccttgtgaaatcctactaaaatgacagtaaagaaatgaaaaagatctatatatccacaaggacaaagagattagaaggggagacaggagataagaattgcaaccagatgccggaagctggaaagctgatgaaagtgagagcatggggcgtgggcgccctgctgaacacagggcgtgtgctaaataagacacttctctcttgctcctctttccccactcagctctccaatgacctgacttgcacccgctgtgtaatccccatccctcctgaccacaagggagaatgaagaactttctaaggaaaatcctgtagcccaaaagaaaagacatacagctctggggtgtggccaacaaaatggtcctctccctaatcactaaactgtgaagctcccaagttgataagcccacctcacacaaagaacatgcgatcagcttttccttgcctcattttaaataagaatcaccagatgcttacccaaggctacaaaactaaagatagagatcaaagctaaaaggaaaaaagaaactcacaaaaaatacagtaattcaagaacagaggaaacttaaaacaaacctacacttttaatactgtcagtgggataagaccaacaaaaccaaaaagattttaacaagaagcatttgaagaaaaagaaacagctcttaaaaattaaaaatgtgggccaggtgtggtggctcacacctgtaatcccagcactttgggaggccgaggccggcagatcacaaggtcaggagttcatgaccagcctggccaacatggtgaaaccctgtctctactaaaactacaaaaattagctgggcatggtggcacgtgcctgtaatcccagctactcgggaggctgcagcaaaagaattgcttgaaccaagacccaggaggcagaagctgcagtgagccaagatcatgccactgcactccagcccgggcgacagagccagactccatctaaaaaaaaaaaagaataaaagaacatttttggacatgcaaagtagtaaactaatctaccctttatgtttctcaggaagctataggaagatatgacatttaggaaatcagtgatgcagcatagaaaaaagggggcaagaatgctcaagaggtaagcgaaggaaatccttcaggcacagagggatccttgaggagaatcaccaagaactaaatggagggtcatccaaaaattagaaatagaactaccctatgatccagcaatcccacttctgggtacttatccaaaagaagtgaaatcagcatctcaaagagatatctgcacacccacattcattgcagtgctatttacaatagacaagacatggaagcaaactaaatgtctatcaacagatgaatggattaagaaatgggatatatacatacaatatacagcatgctaagtgaaataagccagtcacaaaaagataaatgctgcatgattcacttatatgaggcatctaaagtaatcaaactgggccagacacagtggctcttgcctgtaatcccagtactttgagagaccgaggcaggaggatcacttgagccgagttcaagaccagcctgggcaacacagtgaaatcctgtctctattttttttaataagataaaataaaaaataaagtaatcaaactatagaagtagaaagaagaatggcagttgccaggggatgaggggagagggaaatgattactgttcagtgagtataaaatttcagttatgcaagatgaaaaagctctagagatctgttgtacaacattgtgcttaacgatactgtattatacacataaaaatttgttaacagaatagagctcattatgttttttcaccacacacacacacacacacacacacacacatggaactcagagaggcaattattaactctaaaaaaattattcaacaaataaaatgtagtcaaaatatatgaaatggggccaggcacagtggctcacacctgtaatcccagcgctttgggaggccaacatgggcagatcgcttgagctcaggagttagagaccagcctgggcaacatggcgaaaccccatctctacaaaaaaatacaaaaattagccaggcatggtggcacatgcctatagtcccagctactaaggaagctgaggtgggaggatcacttgagcccaggaggtcgaggctgcagtgagctgtaatttcaacactgccctacagcctgggttacaatatgagaaatggcttactgtggatgttcactgttataataaggatattaattctgaatactcatttaactaaagattgtggtttaactatttcaggaagacgtggcaagatgtgtgtgtgtgtcctgggtagagtatctaagaaaatatattcctaatatcctacaattggaagtcaacataattaaaatatcaagaaatagcaaataagtatgttgtttcaaaaatatggtgataagagactagaagaagaaatagtcaaaaataattgaatgtcattatctctaggagaggtattcaggggtgaagaagaataagaaaaaagacatatatgttaattttcataaacataataatttttctaaacataaaattgacaaaatttcagttcacttttcaaattacaacaacataccgctcaattgcacgaagcttaaccttattcatatcctttagaacgtccaacatgtttggaatatctttatttctctggctttttgaatgatgactataattggtcttattagcagccgggttctgtttgctcatttcagttgctggattatctgagtcacaaatattattagatcctggttgtacgggaggaaaacacggtggctggagagatgaaaactgaggaggaagtggtggaggaggaggaggagaaagcactgaacctggaagctgatctgggtccacactcagatgggcagcccgcgatgatgacagctgacccaaactaatgcgctcgtcactcaagccaaaggaacctacaaacaaagtggtttattacaaaatcatgcacaattatctctaacgtaatatatattaataacactaattagaaccaaaacaggagcaatttctgtaatgctagtagcgatatggtagcaaggaaagagtgtcaatcccatctgcttagtaatttaagagtcaagtcaaattgtgaattcatttttaatccagttaggaattttcagtgtaggtccaagagcagagcggggaggagaatgcatcttaaacaaacaaaaaaaagagttttttcagtaattcacatacactctgaacttcatcctctattttaaaaaagctaaaacagaaatcaacaacttgtagttagaaacacaaattgatgtattcactgtataatgacattggagaaataagcatattattttctaagcaaagcttaagatgggtactgagtatttaacttttccactttaagatttgctcataaaggactgtgggtaaacacgattgcttaagaaaactgtgtatagttatatatcattttatttattatgtataaatataagttattgtatattatataatgtgtttatatgtaaatgttataaatatacactgtataaatatcttaaattatatgtgtatttatgcatttgtatatatacatatgtattaaaaaatttttagcaattatatttacacacagccctttacagccaaatctgttgtgaaaagcattcagtacctagattgctttacattttatacacgcatacatacatgttgtgtgtatgtgtgtgcataagtttaaagcaagttgtatctctataaatttataaaacaatcatctggaaaacatgactcacctcaacttggtggaagtgtagcagcaataactaaaaactataaacatatgatgcctcaaacctatatcctctttcaaaccaatgcattcttcctctttaatatccaatgctttcatgaagagttagaaaagcttactgagggccgggcgcggtggctcacgcctgtaatcccagcactttgggaggccaaggcgggcagatcacgaggtcaggagatcgagaccatcctggctaacacggtgaaaccccgtctctactaaaaatacaaaaaattagccgagcgtggtggcgggcgcctgtagtcccagctactcgagaggctgaggcaggagaatggcgtgaacccgggaggtggagcttgcagtgagccaagatcgtgccactgcactccagcctgggcgacagagcaagactgcgtctcaaaaaaaaaaaaaaaaagcttacttagaagacaacagactttttaatacaaaaatacaatcttctagtatagtaaagctagttcttctttaaatcaaagccatcccctcactacaaatgtgtcttaatttatcctgaataaacatcagatataataattttgtatattcaacatccttttatgtacatttaatgttttcatggtacttattcagaattgtactcacttaaatactagatgttcctgtatgctactatacgtactatattcagtacagtatcatgctgtacaggttggtataggctataccatgagtatcatctaactgaaacaaaaatcctactgttacttactagaatttgtactatttttcagttcctgcatttccacaattgctgcaatctgagagcgaagaaaagtcagctcattttcaagggcagctatttttctaattgcagcttcatttacaggcaggtcatttttcacagtttctttctgtcttacagcaggtgacagtggatcccgaactagtcgcaaaggatgaaaaatttccactttctcttcttcatttttccatatactatttctgtgggtgaaaaaaaataggaaatggagggaagatatatttccaatcaaaagaggtataaactcttacactcctacgtgaaaatcaaaagacaataaaacaaaataaaagctactctcaggccgggcacagtggctcacacctgtaatcccaacactttgggggctgaggcagtgaatcacctgaggccaggagttcgagaccagcctggtcaaaatggcgaaaccctgtctctactaaaaatatttttaaaaattcgccggtgtgatgacgtgcccctgtagtcccagctactcaggaggctgaggcaggagaatcacttgagcctgggaggcagaggttgtggtgagccaagatcgtgccattgcactccagcctggtcgacagagtaagactctgtctcaaaaaaaaaaaaaaaaaaaaaaaaaaaaacctactctctatcccccatgattgtttctagagtcaccactgaggacaaggaaaatatcttatttagctttgtattcccaatataaacagaacatagcctccaatggaggaccagtcagtgaccagggaatgaacaaaacaaactttgcttttagattataaaaccaaaataattacctgcaattgttctacttattaactttaaacgcaggtaagttaatttatttagaagttctatataagttaataaagagccttacattcaggattatgttagggtgaaatgtatgttattttaactatttgaaaattggtgccagtttgatacataataaaatcagccggaatacttaaataattgacacttaatgtgcttagagcctgtatctgaatatactaacatataaagtaatactccctaggagtaacacatccaaattttgaaatacatttaacatcattgcctggtgcacagtaaacagtatataagttttggctaaaaacatgattctaatatccctttaataaccactccctcctaggcctggtgttaggtttaaatgtgcactaaaaaaaaaacaactggctaaaaaaatgaaaagcagccagtcttctttattaagaagatacagtagggcacagcacagtttgaagataaacaaaacaaaaaagctcaatcaatcttaacaagcttcgacacatgcaagaattcagtttatagcccacttcccaagataagcatataaaattaccgaaatctgagataactggcttcttcatcatttgccacatacaaaa

SEQ ID NO: 123 - DNA, 1371 bp, Homo sapiens
ctccttccaagaagagcagcaaagctgaagtagcagcaacagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagggcatctgaaaaacctagaacaagtttaactgtgactactgaaatgacaagaattctacagtaggaaactgagacttttctatggttttgtgactttcaacttttgtacagttatgtgaaggatgaaaggtgggtgaaaggaccaaaaacagaaatacagtcttcctgaatgaatgacaatcagaattccactgcccaaaggagtccagcaattaaatggatttctaggaaaagctaccttaagaaaggctggttaccatcggagtttacaaagtgctttcacgttcttacttgttgtattatacattcatgcatttctaggctagagaaccttctagatttgatgcttacaactattctgttgtgactatgagaacatttctgtctctagaagttatctgtctgtattgatctttatgctatattactatctgtggttacagtggagacattgacattattactggagtcaagcccttataagtcaaaagcatctatgtgtcgtaaagcattcctcaaacattttttcatgcaaatacacayttctttccccaaatatcatgtagcacatcaatatgtagggaaacattcttatgcatcatttggtttgttttataaccaattcattaaatgtaattcataaaatgtactatgaaaaaaattatacgctatgggatactggcaacagtgcacatatttcataaccaaattagcagcaccggtcttaatttgatgtttttcaacttttattcattgagatgttttgaagcaattaggatatgtgtgtttactgtactttttgttttgatccgtttgtataaatgatagcaatatcttggacacatttgaaatacaaaatgtttttgtctaccaaagaaaaatgttgaaaaataagcaaatgtatacctagcaatcacttttactttttgtaattctgtctcttagaaaaatacataatctaatcaaaaaaaaaaaaaaaaaaaaaa

SEQ ID NO: 124 - DNA, 2566 bp, Homo sapiens
ggcacgagttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatataccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaatttcctgaatcagaaacaaaagaatgtcctttcagactcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagacctttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaacctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatgtggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttgggtggataagctatccctgttgccggttcatggattacttctctataaaaaatatatatttaccaaaaaattttgtgacattccttctcccatctcttccttgacatgcattgtaaataggttcttcttgttctgagattcaatattgaatttctcctatgctattgacaataaaatattattgaactacc

SEQ ID NO: 125 - DNA, 613 bp, Homo sapiens
  modified_base (563)..(563): a, c, g, t, unknown, or other
  modified_base (566)..(566): a, c, g, t, unknown, or other
  modified_base (613)..(613): a, c, g, t, unknown, or other
actttgctgatttagcttatggaagaggaaccagaaatttgtccttgaataatgtttcccgtgttgggctggatcttgatagcagttgttatcatcattcttctgatttttacatctgtcacccgatgcctatctccagttagttttctgcagctgaaattctggaaaatctatttggaacaggagcagcagatccttaaaagtaaagccacagagcatgcaactgaattggcaaaagagaatattaaatgtttctttgagggctcgcatccaaaagaatataacactccaagcatgaaagagtggcagcaaatttcatcactgtatactttcaatccgaagggccagtactacagcatgttgcacaaatatgtcaacagaaaagagaagactcacagtatcaggtctactgaaggagatacggtgattcctgttcttggctttgtagattcatctggtataaacagcactcctgagttatgaccttttgaatgagtagaaaaaaaaattgttttgaattattgctttattaaaaaataaacattggcaaaaaaaaaaaaaanaanaaaaagcggcccgcttcgagctcacttggcctcgcccttatagtggn

SEQ ID NO: 126 - DNA, 1138 bp, Homo sapiens
caaagsbagtcattttvgttaaatatacattagagcctttttagaaggctgcaaataaacactatgtcaaaatgtgtagttttaaactcagactcgaaagchaagawaagcacctccttcagtwattactctgaccaaggcataagaattcacttagacaaaaagmtttcaaaacctacctaaaaataagatagttcataaatkttcaamackgtccttccctgtggcggacagcccttgakcttkgtcagasttagcaaatcccsscatgccctcatgtcagcctttymagtcactgacaactcctataaatttagcatcatttctcaaatctgtatagttttctcattccgaatgcttaaacatttaggtcaaaaattaaaataccagtagaaaaatattcatctttagccaggttgtatagttaacaacatggcaagaaactgatgagaacatttaaacattcagagcataaaaatacttcaaagcattacgaaacttgaacttagcattttcctaaattttagtagttccaactacaggaaaataaaactgccataaggactgagatgatttaagccaactcaaattttttcctgattcctgacatcaatattatagttttattatagtaacaaatagttgtsacagtgagacctacacacatttacagaattatatttaaattcatatagaatatttacatttttaagtkatatttttgaaattagaagacgarkacagctgaagtttgataacaaagaaatatatataagacaaaaatagacaagagttaacaataaaaacacaactatctgttgacataacatatggaaactttttgtcagaaagctacatcttcttaatctgattgtccaaatcattaaaatatggatgattcagtgccattttgccagarattcgtttgggctggatcatagattaamattttcgagagcaatccaagccattctcatccaagtttttgacatgggatgctaggcttcctggttccaatttgggaaatgtattcttatagtctgtaagatttcacttctggcacamttcaatattkggagtcccmagcctgaaatcctgaagagtgayaattctgaatccatggaaagtggtctwagtg

SEQ ID NO: 127 - DNA, 1005 bp, Homo sapiens
aatttcggcacgggggggaggcacagtgagtccactggggcacggcagcgtctaagccacaagccgactgacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggacttggaggcggcgggaactgcaattggtggctttgaagggcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggagttagaagctactgggaaaatctacctccgacaagaggagatcattttagatattaccgaaatgaagaaagcttgcaattagtgaacatgaaaggaaaataaaaattcctcacagtcaaaaaaaaaaaaaaa

SEQ ID NO: 128 - DNA, 5818 bp, Homo sapiens
aagcgagacaacaaagagatccggacctacaactgcagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacttgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaag

SEQ ID NO: 129 - DNA, 1518 bp, Homo sapiens
taatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattggagacggggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttactt

SEQ ID NO: 130 - DNA, 3171 bp, Homo sapiens
gcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccacgtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaaaggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctaggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaa

SEQ ID NO: 131 - DNA, 807 bp, Homo sapiens
gaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgtgaacttcttatccgaccagtacagaggttacccagtgttgcattacttttaaatgatcttaagaagcatacagctgatgaaaatccagacaaaagcactttagaaaaagctatggatcactgaaggaagtaatgacgcatattaatgaggataagagaaaaacagaagctcaaaagcaaattttgatgtgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggcaaacccgaccccagcttctcttaagcatattcacctaatgcctctttctcagattacagaaggtatcggcaccatacagagagacagaaagatgccataatggctttgccttgctttgtgaggccaccaaacagagcaggcaatgtgctactcagtttcccagatgacccaagatgaacttccaaaagaaaactggtaaaaaatgctgtgtcgaccttgtgctaaacacatttgtaaagcagagctgagatcttattataactggtgatccaaatcttgacatca

SEQ ID NO: 132 - DNA, 2470 bp, Homo sapiens
ttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatat

SEQ ID NO: 133 - DNA, 1865 bp, Homo sapiens
gccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttagaaaaaaaaaaaaaaaaaaa

SEQ ID NO: 134 - DNA, 3227 bp, Homo sapiens
atagaagactcctcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgggatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgagcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgttgagcaagaatcaagagaagttgaagagactgctacagctaagaatgttctgaaactcctttctgatttcttagatagtgaggcatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcag

SEQ ID NO: 135 - DNA, 439 bp, Homo sapiens
atcccatgttttgtttcctgctttcttttgaattgtttgaatgtttttttgaattctgtctattggccttttattattttaatcatacctcttttaatgattgtttagaggttgctttaggaaatatcatgtacagctttaacttttcatagtctacttgaggttagtattgtattatctcatgtaaaatatagaaaacttgcaaccatgtaggtccatttgtccacccacccttgcagccagcatgtcttatgttatagccgtcatgtgaatttcatacatctaaatacattagaaactccataagactgttacaatttttgtattaatccattgtgggtattgtaaagaaagaggaaaaaagtagtcatttagttttacccaaatatgtaccatttctgatactcttcatttgttactgaagattggttttccctcc

SEQ ID NO: 136 - DNA, 8257 bp, Homo sapiens
taaatttaaaggcggggcggcctgtgagccctgaagtgccggccgcggagggtcctggccattttggtgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattcttcagaattccttgggaggaaatccaaagacacgtattatctgcacaattactccagtatcttttgatgaaactcttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatcgagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagttgaaggagaaaatgaaagaacttgcaactacatacaagcaaatggaaaatgatattcagttatatcaaagccaattggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctccgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaaaaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaacttaatataaaacaaattagtgaggttcaggaaaacgtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcaagaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgagccaaactatctatgcaagtgtgagatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttatggaaagcctgagagaaaagtgctctagaataaaagagcttttgaagagatactcagagatggatgatcattatgagtgcttgaatagattgtctcttgacttggagaaggaaattgaattccacagaatcatgaagaaactgaagtatgtgttaagctatgttacaaaaataaaagaagaacaacatgaatgcatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttag

SEQ ID NO: 137 - DNA, 543 bp, Homo sapiens
  modified_base (431)..(431): a, c, g, t, unknown, or other
  modified_base (476)..(476): a, c, g, t, unknown, or other
  modified_base (497)..(497): a, c, g, t, unknown, or other
  modified_base (519)..(519): a, c, g, t, unknown, or other
ttttttttgaggttacaacatgaatctttaatcataagggattgttccatcaggctaatttataaaaaaatagctctactgttattataaaactgaaagatactttgttacaaagtaaaatacataaaagtacaacatatgtattatacattcagaatcccaccactagagataagtagttatatgtcctctcccacatctttttttctctgttgctctaaacatacacacagaaaaacatactaacaaaatggggtcatgctataattgttgttctaaaactctcctggttcactaaatacttcatgagcaacctgcactgtcattatctgtgtgcctgaagatttctagtggctttccattgcatacatatgcctgaacttatctaaaaaatttcctaccaatgggaaactggaatattaacatttgcnattttaaaaatggttttaaatttaaaaactccaccttctgcatgnggttttggcccagtggggganctatctccccaggtatccattnactacataattaccgggcacctct

SEQ ID NO: 138 - DNA, 2356 bp, Homo sapiens
ttagaaggtgagattagcataagcagaggtttgagggaagagtgggagcaaggagtggaggacaggaaacaggaaggagactgggctgctggtggggaggaggcaggacaggccctgtgagggcagggcaaagtgggagtcagcgttggccaaagcgagagagccccaggcagtggagcctttgatgtcaggcctgaaggcagtggggactgtcttagaattttatgctgagatgaaaatgtatgactgaaaaattggtctggtggcaggaggtgatcagagtgggtggccgcaagaggcttcctggggaatgggcttcctcagtatccgggtgcagcaggtgggccagaggcgacccatggcagcccccagtgtcaacgtgagcaagtgcaggactgtggacaagactgtgatgccatgcccggggcagagaagatgatggaaaaggagaagttgccccagatccagtggctcacagaagcactcttcctgaggaagagcttgttcttgaagtttgcacccacagcttctcctaggcgatgggcttggagagctgtggtcagcatcaagagctagcctggcagcagggcaaggatgtggctgcgagatggcatcgtggtacccactctctctcggtgcctcagtgtccttgtggaggatctggcctctatgacttgagtgatggtaaagtgagatgatcccatatggcgtttgacgttgtgctgcacacggggtgggtgcccagtaaatgggagtggttattattttgaagatcctttagggaaaaaatgtccattctttaagaagctaaagcagaaatgaagggaatgagcactcagacatcttccactctgcaaacatttttgttaataacaggaaggaagagaagcagccacattttttctgtggttctcatataacattgtcgtgtacttggtggaaattacagagggagctagactttgaaaagccttaagacttgtcaacccagcttatcagatgaggtctccagtatttttcagaaggtaatcacttgagaggctttgtttcttcttatcaattcacaattaatgtgtttttattaaactggcagattataattttgcattagagttctggggctcttaagtgcataaaattcatttgcctacacctttttttcaactacgtatttcaattcagtgtttattggcatttgctaactacatattcattaccttactggtcaaataaaacaatatatgtgtgtctcactcctaaaggatcttatcagaaaggactgtcaaatgatgatagaagacggtaagtgaatgaggactaacaggagtggtctagacagtgagctctccagaactggaaggaagttagaaccgggcactaaaatcctcagcagaggccttgcaaggtgagataagaagccgggttttgaaaaggtggtctggtgtgggcagtgggaggtcagtgtgaggagagatgaccaacatgagcagagagacccgagtgggtctgagcaggcctccaccaaaggatgggcagacctggccaaagagacattttgagtaagtctgagggggcctgatagccacagtccgtgtgactctatttcactcctacgattctatgaaaataggctggaatgatgttttagggggagagaatgggagccaggggggtgttttattttcaaattaattgcatgtgactgaaaatgaaatttcaaagtatatatgcttaccatccaatttgtcttatacttgctgctgaataaaaagtcctgaaattcagtttaaatattggtctttgttatcccaaaatagcaatcataattatggtaaattagttgaattcacctttcatttattttgtagtaaatatctatttcacttaactttagtagataaagtaaccaactattgttcagctttttaaaaagccttcacaatacaattaaaaaaattatatgtagtaactaataaaagtaaaccatttctttaaaattcacggggtgtacttgcaaaacagttcatgcacacctgggaagatggagagagaactatgaaataagaatgcacagggccgggcgcggtggctcatgcctgtaatcccagcactttgggaggccgaggcgggcagatcacgaggtcaggagatcgagaccatcctggctaacacagtgaaaccccgtctctactaaaaatacaaaaatttagctgagcatggtggtgcgtgcctgtagtcccagctagtggggagtctgagggaggagaatcgcttgaacctgggaggtggaggtcacagtgagccgagatcgtgccacggcactccagcctgggtgacagagtgagactccgtctcc

SEQ ID NO: 139 - DNA, 3050 bp, Homo sapiens
cagaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagaggctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaacagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttcctaagtgctgatattacaggcataatatgtgatcttttgtgtctggttgctttcatgttgaatgctatttttgaggttcgtgcctgttgtagaccacagtcacacactgctgtagtcttcccgagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctccccacgtc

SEQ ID NO: 140 - DNA, 1172 bp, Homo sapiens
gagacattcctcaattgcttagacatattctgagcctacagcagaggaacctccagtctcagcaccatgaatcaaactgcgattctgatttgctgccttatctttctgactctaagtggcattcaaggagtacctctctctagaaccgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaatgtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtataagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaataaaaatgaggtactctcctggaaatattaagaaagactatctaaatgttgaaagatcaaaaggttaataaagtaattataact

SEQ ID NO: 141 - DNA, 495 bp, Homo sapiens
  modified_base (395)..(395): a, c, g, t, unknown, or other
  modified_base (419)..(419): a, c, g, t, unknown, or other
  modified_base (427)..(427): a, c, g, t, unknown, or other
ttggcagctcactccaggtttatttcagggcagtttgggggtgggggacaaagaccccctccagctcctaaactgggtcacttttctcccaggtgaaggggaccatcctcatgggatcctatcgatgtgagagctttgtgtccaccaggtgtggctgggtgcaccaaggtgaagggtttgagggctgcacagggacccccagcactgggagtttggcctcctccctcagactggatggtttcccagggttggaaaggggcaggtctcccctctcagcttgggacttctcagagggaggagctgagtgtctcctccctcagacccgcagcccctcaaggtgctgcgatctgtgccaccctctttgaccggtccctctgccctcagactaagcggangaaattacacctgaaagtggaagnagcgggtntctttctttcttagacccagggcaatttggcaaagtcttagaagccgaaaggaatcagcgggggtcca

SEQ ID NO: 142 - DNA, 648 bp, Homo sapiens
gtggagcagtgaactgtgtgtggttccttctacttggggatcatgcagagagcttcgcgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcct

SEQ ID NO: 143 - DNA, 1719 bp, Homo sapiens
ccgaattcgggggcagcagccacattggcagtgaggccgtggcagcgtcagcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgttaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaaaaaaaaaaaaaa

SEQ ID NO: 144 - DNA, 1328 bp, Homo sapiens
gtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttaaaaaaaaaaaaaaaaaaaa

SEQ ID NO: 145 - DNA, 691 bp, Homo sapiens
cttctgaggatctccgaggtaaaactggttgtcccatcttacgaagaggagctagctgccattttttaatttcattatctctacagtctgatgaatttctgccttcaccagactcccgttttaaaattttgaccttgtgcttcactgtatcatctatatatttggttctatcatttgttgtgtgttttgataatccaagcttttcacactccattgttttatctccactatggaattcaactgtagcttggttttccaaagtatctggatctagtatttcagtctttttgtcttcttcagcacaacattttacacagacatattctttgtcttcctcgcccatctgctgtgcttgagaaagacttaacccaacacaatcaccatgaaaccagtcatcacatctcccacagccaaccataaacctgttgccatgtggttggttgcaaaacccacactgcttgctgggagtccacatatatttgctttcaaatgaggagctatgatcagagccttctctttctatggtacctatgttatctggaatgaacaatggtggctgatctaaaggaaaacttgtgcttgctgttctgttgccgggttgtaggttcttctcaggttgtttcaatgtcaatttatcctgctgcttgaaatgcctgaccccctgaggttcaacctcttgcgtcaccttact

SEQ ID NO: 146 - DNA, 3224 bp, Homo sapiens
gtcccacatcccgcatccggcatcccagcggccgggcatgtagcagcggcagcaacggcggaatatgggcgggaaccactcccacaagccccccgtgtttgacgagaatgaggaagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctgatctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattccttc

SEQ ID NO: 147 - DNA, 753 bp, Homo sapiens
atgagtgagaacgccgcaccagacttttattacgttgccatggatttcggaggtcatgggctctcgtcccattacagcccaggtgtcccatattacctccagacttttgtgagtgagatccgaagagttgtggcaggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtag

SEQ ID NO: 148 - DNA, 1345 bp, Homo sapiens
atacaggtctgtgaagcaggcaggttgctcagctgcccccggagcggttcctccacctgaggcagactccacgtcggctggcatgagccggcgcccctgcagcgccctcgaccctcggatagttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtagaacttaaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaagttttagactgcagaatataattggcagaaaaatgggcctagaatgtgtagatattctcagcgaactctttcgaaggggactcagacgtgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagcgtctctgtaattatcatactactaaagactgttcagatggcaagctcctcaaagccagttgtaaaataggtcccctgcctggtacaaaaaaaaaaaaaaaaa

SEQ ID NO: 149 - DNA, 550 bp, Homo sapiens
tttttttttttttttttacaataaggccaaatgtctacccagtagttagtatcccagaaaatgtctacatgcacccaattatacatacctaaagtattatttctattatcttccacttgtattataattaaggccatgacagtaagctactgtctcttggcttcaaacccactctttggaattctgcaagcatttctgtctccctgttaggctctgccaatagagggaccagcgtgacacttcacaggtagagaaggaagaaggaatttgctgtttccttcggatgggtttcttaatcctgttaagtctcactctagcaacaattcttcactccgaaagcaatagtgcctgctagtagtagcagctgattgcaatttgggggtttcccaacacttatagaaccaatctcaatgtgccttcttgagatgccagctccaattactgggtgcttcttcctcagatacctggttcccaggtctataggctccctcctctgaactcagagaaatcagttacaggcaagcagtgacctgttctcaaaagtctgaat

SEQ ID NO: 150 - DNA, 2788 bp, Homo sapiens
ggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaaaaaaa

SEQ ID NO: 151 - DNA, 1837 bp, Homo sapiens
ctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgactgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacaaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaatgatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactaaaaaaaaaaaaaaa

SEQ ID NO: 152 - DNA, 1786 bp, Homo sapiens
gcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcgtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggcct

SEQ ID NO: 153 - DNA, 782 bp, Homo sapiens
  modified_base (357)..(357): a, c, g, t, unknown, or other
  modified_base (666)..(666): a, c, g, t, unknown, or other
ttttaagaagtttaaaggagtttattcaaaagttgaacatttttaaaatttcacaaaactaaccagcaaagacagtaagccaatcctccatttaccccctttctgtcttggttaagggcagagacacatgtcagagggagactgcgtcccatgtagggagctaatgtgttcactagctattgcttctcgcagggtcgcagcatctacactcacttgcctcatccacactgtcacgttcaaagacaagaaataatcctgaaagtagatcccaaggccagaatgcaaaggaatagccagaagcccagaccagatcagtgggctaagggtttgtcaaaggcagaatctggtgacagctanggtgaggggggctttgtcattggaagcgaatccatcgcccatcttcgttgtcatcacggtttatgttttccttggcccttgcgatccagaagttgccacggctgctagttgcgtcatccagtggacacctttatatgtacaatttggatcctcaggatggaggagagtgtgtcttaatcaaaacccacaggtgaagagactgcttttcaaaagacagcctttcgagaggctggcgtgtagagttgtcccttcgccaagaacgacaagcctcaagggcccttgccattgatttgttctttcactggcagnctcagtggcaaaaacctttagtgggcaagtgctctgcacccgggctctgtggcaggtgcccctcaaacatgtggtaattcatcctggtggtccttgaaaagaaccagagggactaa

SEQ ID NO: 154 - DNA, 2500 bp, Homo sapiens
cccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggttgacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgttttgtactcacggcggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcataaaaaaaaaaaaaaaaaaaaaaaaa

SEQ ID NO: 155 - DNA, 2225 bp, Homo sapiens
ggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcgctgagcacgggcatgaaggccatgatgtcagaattctgcacccagggagctgagatgtgccgcagggcctgtggcggacatggctactcaaagctgagtggcctgccatcactggtcaccaaattgtcggcctcctgcacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcccttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattag

SEQ ID NO: 156 - DNA, 615 bp, Homo sapiens
tttttttttttttttttttttttttttttttttttttttttttttttttactaacagtgtttttatttacaaataattgtttttattaggccatttggaaaaccactaacattttttattttagaaaacattaaataataaacaagatgttatacagtactttggataacttcttccatcagtttagtgcaatgtatcattggcatcgaaaagtaaaattttcatttattttcccctttcatcttcagctgtgcagttatatgaccataaaggaaatgaaccattaaaaatggatctacagccatatattctgccgttactcaaaggcttaatgatttattttccccctccagccctgcctttaccaggttaaatgacagaagaccttctattgtacctattgttcaaaaaatattactgttctgtggaacctgggagagtccaattgataagagaaactgaatcatactgatgaggtgaaggaaaggtctgccggtgtggggcagggcactctttctcagcagccaagataacttgtcacacacgaagcagagagaatgccccgatgaaaatctctctgaactgtgttccttgaaggatctcttaaaaaaaaaa

SEQ ID NO: 157 - DNA, 447 bp, Homo sapiens
aaacacagagaattttgttttagcctgacaaatttcaaagaggctttgcaagtgcaaacagacttcagctttttcacattcctatgcccagaaactgggacgtgaaaatgccaggaaccctttcaataactagactatgtgatagatgcaggagaaactctccaaccaccaagattactcctatggagctgccaaagaaccagatgcttccttcaaaagcatatcaatttggcggtgaaaaaccctgtggcctcagctccagtcgggaagggcaggtgggatggcatggtgcaggatgcctgttcccacttgcctcagcaaccatcttcttctgacagcaaaactgtgttactcccaggcttgaaggcatgagcaaaatacatggctttgctatatataaggacgggacttggaaatatttggtctgaggccatgcaaaatgaattc

SEQ ID NO: 158 - DNA, 1995 bp, Homo sapiens
gagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaaaaaaaaaaaaaaaagg

SEQ ID NO: 159 - DNA, 2398 bp, Homo sapiens
gcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttcttttcctttatgttctcaccgtttgaatgcatgatctgtacggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttatttttttttaaacaatgattaaattgaatgtgtaatgtgcaaaagccctggaacgcaattaaatacactagtaaggagttcattttatgaagatatttgctttaataatgcctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaact

SEQ ID NO: 160 - DNA, 777 bp, Homo sapiens
  modified_base (2)..(2): a, c, g, t, unknown, or other
  modified_base (6)..(6): a, c, g, t, unknown, or other
  modified_base (13)..(13): a, c, g, t, unknown, or other
  modified_base (627)..(627): a, c, g, t, unknown, or other
  modified_base (751)..(751): a, c, g, t, unknown, or other
  modified_base (760)..(760): a, c, g, t, unknown, or other
  modified_base (774)..(774): a, c, g, t, unknown, or other
gntganttcgaangccccaaacctgctttataaggctgcgtggccccactggcttctctgctgagatatgaggtgccagccaggcagacaggtgacagagggtgacccttcctcaccttctccccatcactaccatccctccggccctacaaatacccatctctataatgcaaccacttcaaaaaatactctgaggagggacagggtgaaaggggtagggggtcagactggtctgaacagcaggctggttcccgtgaggtagctgatgcccatgctcctgggcagaggcttttggagagaggccagttatgggctcacagccaggagggagtcactgattgactggaaagtggaggaagcagaaagtcttgaagtctgcccagagcacttgatcacaggtaacgtctgggtagaaaggctgggctctttgctggtgtcctcactgtcctttgaggaactgggtttctggggataaggggaaaggccagcttgagtcttcttggatttgggcgtggtcccgtcttcagagagtagtaggctaacctcacaggagctttgttttcccagcttgctagtctctgatttgctgaaggcattgagtatcacgtcatcctttgagatagtcanaaagtgatgtccgggagagacccacactggagcagaatcagaagacaactcccatgtgggaaacccttttgtagcaccaacttccgggagcagatctactcctttaagcttgttggccatgggnattttctgnttcccatttgggtnggg

SEQ ID NO: 161 - DNA, 2624 bp, Homo sapiens
cccacgcgtccggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtctagctcctcaatggctccgagtcgagctccacggacaacgccaaatttaaattctgggtcaaatcgaagggcttccagctgggccagccggacgaggtccgcgggggaggcggcggcgccaagcaagtgctctagtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaa

(The sequence listing continues in the following parts.)

The invention claimed is:

1. A method for predicting disease outcome, the method comprising the steps of:
    obtaining gene expression profiles from a plurality of genes from tumor samples, wherein said tumor samples may be mutant or wildtype for the p53 gene;
    comparing said gene expression profiles to determine which genes are differentially expressed in the tumor samples that may be mutant or wild type for the p53 gene;
    deriving from said differentially expressed genes a set of sequences to predict p53 mutational status; and
    assessing the ability of the set of sequences based on microarray analysis and Kaplan-Meier analysis to predict disease outcome, wherein the sequences consist of SEQ ID NO: 22, SEQ ID NO: 31, SEQ ID NO: 11, SEQ ID NO: 9, SEQ ID NO: 1, SEQ ID NO: 29, SEQ ID NO: 28, SEQ ID NO: 5 and SEQ ID NO: 25 and wherein the disease is late-stage breast cancer.

2. The method of claim 1 wherein disease outcome is selected from the group consisting of disease-specific survival, disease-free survival, tumor recurrence and therapeutic response.

3. The method of claim 1 wherein predicted p53 mutational status is obtained by ranking the differentially expressed genes according to their association with p53 mutational status, ER status and histologic grade of the tumor.

4. The method of claim 3 wherein the genes are ranked according to a multivariate ranking procedure.

5. The method of claim 4 wherein the multivariate ranking procedure is Linear Model-Fit.

6. The method of claim 3 wherein predicted p53 mutational status is obtained by employing a supervised learning method.

7. The method of claim 6 wherein the supervised learning method is Diagonal Linear Discriminant Analysis.

8. The method of claim 2 wherein the disease outcome is disease-specific survival.

9. A method of identifying a group of sequences for predicting disease outcome in a patient, the method comprising the steps of:
- obtaining gene expression profiles from a plurality of genes from tumor samples, wherein said tumor samples may be mutant or wildtype for the p53 gene;
- comparing said gene expression profiles to determine which genes are differentially expressed in the tumor samples that may be mutant or wild type for the p53 gene;
- ranking the differentially expressed genes according to their ability to predict p53 mutational status;
- employing a supervised learning method to distinguish between mutant and wildtype p53 gene expression profiles;
- obtaining a p53 classifier including a set of sequences capable of predicting p53 mutational status;
- validating the p53 classifier in independent datasets; and
- assessing the ability of the p53 classifier based on microarray analysis and Kaplan-Meier analysis to predict disease outcome in the patient, wherein the p53 classifier includes sequences consisting of SEQ ID NO: 22, SEQ ID NO: 31, SEQ ID NO: 11, SEQ ID NO: 9, SEQ ID NO: 1, SEQ ID NO: 29, SEQ ID NO: 28, SEQ ID NO: 5, and SEQ ID NO: 25 and wherein the disease is late-stage breast cancer.

10. The method of claim 9 wherein the differentially expressed genes are ranked by a multivariate ranking procedure according to their association with p53 status, ER status and histologic grade of the tumor.

11. The method of claim 10 wherein the multivariate ranking procedure is a Linear Model-Fit.

12. The method of claim 9 wherein the supervised learning method is a Diagonal Linear Discriminant Analysis.

13. The method of claim 9 wherein disease outcome is selected from the group consisting of disease-specific survival, disease-free survival, tumor recurrence and therapeutic response.

14. The method of claim 13 wherein the disease outcome is disease-specific survival.

15. A computer system for predicting disease outcome in a patient, the computer system comprising:
- a computer having a processor and a memory, the memory having executable code stored thereon for execution by the processor for performing the steps of:
  - obtaining gene expression profiles from a plurality of genes from tumor samples, wherein said tumor samples may be mutant or wildtype for the p53 gene;
  - comparing said gene expression profiles to determine which genes are differentially expressed in the tumor samples that may be mutant or wild type for the p53 gene;
  - deriving from said differentially expressed genes a set of sequences to predict p53 mutational status; and
  - assessing the ability of the set of sequences based on microarray analysis and Kaplan-Meier analysis to predict disease outcome in the patient, wherein the set includes sequences consisting of SEQ ID NO: 22, SEQ ID NO: 31, SEQ ID NO: 11, SEQ ID NO: 9, SEQ ID NO: 1, SEQ ID NO: 29, SEQ ID NO: 28, SEQ ID NO: 5, and SEQ ID NO: 25 and wherein the disease is late-stage breast cancer.

16. The method of claim 15 wherein the disease outcome is disease-specific survival.

17. A method for predicting disease outcome for a late-stage breast cancer patient, the method comprising the steps of
- obtaining tumor tissue from the late-stage breast cancer patient;
- extracting RNA from the tumor tissue;
- determining by an empirical method if the RNA from the tumor tissue expresses a set of nucleotide sequences consisting of SEQ ID NO: 22, SEQ ID NO: 31, SEQ ID NO: 11, SEQ ID NO: 9, SEQ ID NO: 1, SEQ ID NO: 29, SEQ ID NO: 28, SEQ ID NO: 5 and SEQ ID NO: 25; and
- predicting the disease outcome for the late-stage breast cancer patient based on the determination.

18. The method of claim 17, wherein the disease outcome is disease-specific survival.

19. The method of claim 17, wherein the set of sequences is immobilized on a solid support.

20. The method of claim 19, wherein the solid support is a microarray.

21. The method of claim 17, wherein the disease outcome is disease-free survival.

22. The method of claim 17, wherein the tumor tissue is frozen prior to RNA extraction from the tumor tissue.

23. The method of claim 17, wherein the determination step is performed using cRNA.

24. The method of claim 17, wherein the empirical method is hybridization of the RNA from the tumor tissue to the set of nucleotide sequences.

* * * * *